United States Patent 11,098,302 (IDENTIFICATION OF POLYNUCLEOTIDES ASSOCIATED WITH A SAMPLE) - sequence listing, part 119

SEQ ID NO: 411845 - DNA, 650 bp, Homo sapiens
  misc_feature: GZ8MTXP02F0AAP.17.28.C06.1.454.CMB.2.raw
  modified_base (280)..(280): a, c, t, g, unknown or other
  modified_base (305)..(305): a, c, t, g, unknown or other
  modified_base (342)..(342): a, c, t, g, unknown or other
  modified_base (379)..(379): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtgggggtccctgagactctcctgtgcagcctccggacttcccctnagtagttatggatgacttgggtccnccagactccgagggaggggctggagtgggtggccaanagtaaagcaaagatggaactgccccgtagttttacgngtactcgtgtggacgggtccgtttcaccgtatctaccagacgaacaacgacccaaagaacttacacttgtactactaacaactagaacagcccgtagaacggtagtaccgacaacgaaccgaccgggtccgttaggttacttacgtggtcgacggtaagtagtaggtaaagggtaaaaaagttagtacgggtacgttggtttaggttttaaacggttgggggtacccgtaagggggtaccgtccccggttacggggtacccgttaccccgg

SEQ ID NO: 411846 - DNA, 604 bp, Homo sapiens
  misc_feature: GZ8MTXP02JSGKO.17.28.C06.1.454.CMB.2.raw
  modified_base (206)..(206): a, c, t, g, unknown or other
  modified_base (237)..(237): a, c, t, g, unknown or other
  modified_base (243)..(243): a, c, t, g, unknown or other
  modified_base (258)..(258): a, c, t, g, unknown or other
  modified_base (305)..(305): a, c, t, g, unknown or other
  modified_base (355)..(355): a, c, t, g, unknown or other
  modified_base (381)..(381): a, c, t, g, unknown or other
  modified_base (387)..(387): a, c, t, g, unknown or other
tcagcgtagactagcacgaccggtgctcgatttagagctcacgtattgggtttgggcagcttcagctgtggtagagaagacaggattcaggacaatctccagcatggccggcttccctctcctcctcaccctcctcactcactgtgcagggtcctgggcccagtctgtgctgactcacgccaccctcagtgtctcgggaccccggnaggagggtcaccatatcttgttctggaaacngctcgnatctacaactaactntttgctgtacagctactccagctccgccccactcctcatctaataanaatgatcacgtccggccgtccggtcctacgacccgtattctcgtcgctcntcgtcgtgccactctacgtcctcccncgaccnctcgacggtcggccgtccggcgaggacgtacggacgtctaggttactttacgttacgttgtacgccggtacggtggacgtcgactacgtacgtagtacggtcgggttccggttcgggttaccgggacgggacgggtaccggtacggtaccgttacggacccggttaaccgtaacggtaccgaccggacccgtaccggtcccgttacccggtaccccg

SEQ ID NO: 411847 - DNA, 645 bp, Homo sapiens
  misc_feature: GZ8MTXP02JM58P.17.28.C06.1.454.CMB.2.raw
  modified_base (378)..(378): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaggtgtcagtgtgaggtcagttggtgaggtcggggagcctggtccagccgtgggggtcctgagactctctgtgcagccctcggtacttccctcagtagttatggatgacgttggtccgcagactccgaggggaggggctgggaggtggggtacggaccaaacgagtaaaagcaagagtaggaactgacggtaagtttttacgnggtactcgtgagacgggtccgtttcactatacctacgagaacaaccgaaccgacctaaaggtaacttacacttacgtaattacctaaactaacgtacgaaacacgtacctaggaaacggcgtacgacgaacggaccggacgggtaccgtaggttactacgtagtggacgagagttaggtaaggaaaagttcgtacggtacgtggtttagtttagggtaacgggggacctacggggacgtacccggtaggtacccgtacctttcccgg

SEQ ID NO: 411848 - DNA, 682 bp, Homo sapiens
  misc_feature: GZ8MTXP02JB6MJ.17.28.C06.1.454.CMB.2.raw
  modified_base (208)..(208): a, c, t, g, unknown or other
  modified_base (212)..(212): a, c, t, g, unknown or other
  modified_base (237)..(237): a, c, t, g, unknown or other
  modified_base (395)..(395): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccggnaggnggtcaccatatcttgtctaggaacngctccgcatctactaactaactatttgctaggtaccagactaacttcccaggactccccggccccccgtactcctctatcctaataagtaaactgaactccacgtcccggccccggtccgggtccctcgaccccgtcttcgtcgtcggtcctaccgtntcgtcgtcggaccctacctccacgtccccctccctacgaccctacgtcgacggtcgggtcccgtccggacgaggagtggacggtcttagtacttacgttactcggtacaccggtacggttgggaactcgtaaccgtcgttactacgggtacggttcgggttaccgggtcgggttaccggggtaccggggaacgggaacccggtacgggtcccgtaccggtacccgttaaccggtaacgtacccggaaaccggcccggtaaacggttccccgtcccggtaacccccgg

SEQ ID NO: 411849 - DNA, 639 bp, Homo sapiens
  misc_feature: GZ8MTXP02GAP1E.17.28.C06.1.454.CMB.2.raw
  modified_base (280)..(280): a, c, t, g, unknown or other
  modified_base (304)..(304): a, c, t, g, unknown or other
  modified_base (377)..(377): a, c, t, g, unknown or other
  modified_base (407)..(407): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtccagtgtgaggtccagttggttgaggtccgggggagctggtccagccgtgggggtccctgagactctcctgtgcagccctccggacttccccttnagtagttatggatgacttggtccncagctccgagggaggggctggagtgggtgccaaacagtaaagcaaagataggaactggacccgtagtttacgngtactctggtaggacgggtccttacacctntcctacagacgacaacgaccaagaactcattagatactaacaacgtagaacacgacctaggacgacgtacgacgaacgacccgaccgggtaccgttagttaacgttaccgtggtacggacgtaaggtagttagggtaaaacgggtaaaaagttaggtcgggtaacgttggttaggtttaacggtttcggggaccgttacgggggaccgtcccggttaggtacccgtacccgg

SEQ ID NO: 411850 - DNA, 540 bp, Homo sapiens
  misc_feature: GZ8MTXP02H2ZIT.17.28.C06.1.454.CMB.2.raw
  modified_base (454)..(454): a, c, t, g, unknown or other
  modified_base (479)..(479): a, c, t, g, unknown or other
  modified_base (530)..(540): a, c, t, g, unknown or other
tcagcgtagactagcacgaccggtgctcgatttagagctcacgtattgggtttggagggtgtggtggtctccactcccgcccagtctgtgctgactcagcccaccctcagtgtctgggaccccccgggcagagggtcaccatatcttgttctggaaacagctccggcatctcaactaaactatttttgctggtaccagcaattcccaggactccggccccccgactcctcatctatagaaatgatcatccggccccgtccgggtccctgaccgattctctggctccatgtctggccacctcacgccctccctgacccatcgaggtcggggcctcccggtccgaggatggaggtctagtatttattactgtcgcgtaccggtgggactgactgtcctagacgtgggtccgtggtcggcgggagaccaggcgtcgccgtactagtcacgaccagcnccgcccctgtcactctccgtccccnccttcacctacgtctacgctcgacgcgggtcaggtaccaggcacgactcgnnnnnnnnnnn

SEQ ID NO: 411851 - DNA, 678 bp, Homo sapiens
  misc_feature: GZ8MTXP02GKU87.17.28.C06.1.454.CMB.2.raw
  modified_base (280)..(280): a, c, t, g, unknown or other
  modified_base (305)..(305): a, c, t, g, unknown or other
  modified_base (384)..(384): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggagcctggtccaggccgtggggggtccctgagactctcctgtgcagccctccggacttccccttnagtagttatggatgacttgggtccnccagacctccgaggggagggctgggaggtgggtgaccaaacaataaaagcaagataggaactggaccgtagttttacgnggtactcgtggtacggaacggggtccctttacaacctatcctaccaagacgaccaaacgccaaaagtaactttcgaacttagtaactacctaaactaaacgtagaaaacctacggaccttagggaagtaacggtcgacaaacggaccgaccgggtaccgttagtaactttaacgtggtacgagaaggtacgtaggtaaaagggaaaaaagttactaggggtctttagggttagttttaacggtgggggacccgaagggggtaccgtccccgtagggtacccacccggtttcccg

SEQ ID NO: 411852 - DNA, 658 bp, Homo sapiens
  misc_feature: GZ8MTXP02F89K5.17.28.C06.1.454.CMB.2.raw
  modified_base (278)..(278): a, c, t, g, unknown or other
  modified_base (302)..(302): a, c, t, g, unknown or other
  modified_base (364)..(364): a, c, t, g, unknown or other
  modified_base (392)..(392): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgttttagaaggtgtccagtgtgaggtccagttggtgaggtcgggggagctggtccagccgtgggggtccctgagctctcctgtgcagccctcggacttccccttnagtagttatggatgacgttggccncagaccgtccggaggggacggggtctggggaggtggggtcgacaaacgaataaagacaaagngtaggaactcggacccgttagtttacgnggtactcgtggtagggacgggtccgttcaacctatcctacgagtacgaaccaacgccaaagtaaacttccaacgttgtaactactaactactaacgaacacggcctagaggtacgacgacgacgaaccgccgggtaccgttagttaacttacggtagtgggacgtaagtagttaggggtaaaaggtaaaagttagtccgggtagttagggtttagtttaagggcgggggtacgacgggggtcctaccggtcggtacccgttcccgg

SEQ ID NO: 411853 - DNA, 694 bp, Homo sapiens
  misc_feature: GZ8MTXP02HQ8IK.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgttttagaaggtgtccagtgtgaggtcagttggttgaggtcggggagcctggtcagccgtgggggtcctgagactctcctgtgcagccctccggactttccccttcagtagtttattggatgtacgttgggtcccgccagacctccggaggggaaggggcgtggaggtggggtcggaccaaaacaagtaaaagacaaagagtaggaaactcggtaccccgttaaggtttttacggtggtaccttcgttggtaggtacgggggttccgtttaccacctactcctaccgaagaacgaaccaaaccgaccaaagtaacttctaacttagttactacttaaacaactagaaacacgaccgtagaggtagtccgacgacgaaccgaccgggtaccgttagttacttacgtggtagacggtaagtagttagggtaaaaggtaaaaagttacgtaggtacgtttaggtttaggtttaacgggtttacggggacggtacggggtacggtcccggtcggttccgtacccg

SEQ ID NO: 411854 - DNA, 641 bp, Homo sapiens
  misc_feature: GZ8MTXP02F8VMN.17.28.C06.1.454.CMB.2.raw
  modified_base (238)..(238): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccggcagagggtcaccatatcttgttctaggaaacngctccggcatctacaaactaactattttgctggtaccagcaattccccgaggactccggcccccgactcctcatctataagaaatgatcactccggccccgtccggggtccctgaccccgtattcctctcggcctcatcgtcctggccacctcacgccctccctcgaccatcgacggtcggccgtcccggtaccgaggtagtgacggtctcgtatttagttactgtcgacgtacggtggaatcgacgtacttccgtagtaacggttcgggtccgggttcgggttaccggggaccggggtaaacggggtacccgaggggtaccttaccgggtaaccccgtaaccgttaaaacggacccggaaccggtacccccgaacgggttcccgtaccccggttccccccgg

SEQ ID NO: 411855 - DNA, 656 bp, Homo sapiens
  misc_feature: GZ8MTXP02H1LU8.17.28.C06.1.454.CMB.2.raw
  modified_base (240)..(240): a, c, t, g, unknown or other
  modified_base (274)..(274): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtcgtcgggacccccggcaggaggtcaaccatattcttgtctagaaacngctccgcatctacaactaaatattttgctgtacngcaactccagactccgccccactcctcatactaatagaaatgactcacgtccggcccgtccggggtcctcggaccccgtattccgtcgtcggtctcgtattcgtctcggcctaccgtcaccgtcccttccctacgacctagtcgtacggtcgggcccgttacccgggtacgaggtacgtcggacggtcgtaagttacgtttacttacgtgggtaccgcggtaccgggtagggtactacggtactacgttaccgtaggtaacggttcggggttccgggttacggttcggggaaccggacggggaacccgtaggggtacctaccggtacccggtaacgttaacggaccgacccggaccgaaccggtccgttccccggtaccccg

SEQ ID NO: 411856 - DNA, 703 bp, Homo sapiens
  misc_feature: GZ8MTXP02FTQJN.17.28.C06.1.454.CMB.2.raw
  modified_base (371)..(371): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagcctggtccagcctgggggtccctgagactctcctgtgcagcctccggattccccttcagtagttatgatgacttggtccgcagactccgagggaaggggctggaggtggtggaccaacataaagcaagatggaactgcccgtagttttacgnggtactcgtgtaggacgggtccgtttacacctagtctacccgagacgaaaccaaacggaccctaaaagtaaacttaccaacgttacggttaacttaccttaaacctaaacgttacggaaaccacggacccttagggaacggtaacggttcccgacgaaacggaacccgtaccggggtacccggttagttaaactttaccgtggttacggacgaagtagttagggtaaagggtaaaaaaacgttacgtaggggtacttagggtttaggttttaaaggtcgggggtacccgaaagggggttaccgtcccggttacggggtacccttaaccccgg

SEQ ID NO: 411857 - DNA, 594 bp, Homo sapiens
  misc_feature: GZ8MTXP02GC1YO.17.28.C06.1.454.CMB.2.raw
  modified_base (273)..(273): a, c, t, g, unknown or other
  modified_base (295)..(295): a, c, t, g, unknown or other
  modified_base (332)..(332): a, c, t, g, unknown or other
  modified_base (369)..(369): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttccttgttgctgttttagaaggtgtccagtgtgaggtccagttggtgagtcggggagcctggtccagccgtgggggtcctgagactctcctgtgcagcctcggattccccttnagtattatgatgacttggtccnccagctccgagggaggggctggagtgggtggaccaanataaagcaaagataggaactgccccgtagttttacgngactcgtgtgagggtccttacacctatcctcagacaacaacgacccaaagtaactcgactgaattctaacaactagaacaggcctagagacgtcgacaagaccgacgggtaccgtgttaattaccgtgtcgagaaggtataggtaaagggtaaaaaagtagtaggtacttggtttaggtttaaggttcgggggaccctaggggacgtccgtcggtacctaccccg

SEQ ID NO: 411858 - DNA, 665 bp, Homo sapiens
  misc_feature: GZ8MTXP02F4YPL.17.28.C06.1.454.CMB.2.raw
  modified_base (269)..(269): a, c, t, g, unknown or other
  modified_base (296)..(296): a, c, t, g, unknown or other
  modified_base (385)..(385): a, c, t, g, unknown or other
  modified_base (517)..(517): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtcagtgtgagtcagttggtgagtcggggagctggtcagccgtgggggtcctgagctctcctgtgcagcctccggacttccccttnagtagttattggatgacgttgggtccncagactccgaggggaggggctggaggtgggtcggaccaaacaagtaaagcgaaagagtaggaaactggaccccgtaagtttttaccggngggtaccttcgtaggttagggacgggggttcccgtttaccacctacttcctaccgaaggaacgaaccaaaccggacccaaagtaacttaccacttagtacttactaaacaactacgaaacacgcctaggagngtaccgacgacgaaccgaccggtccgttagttaacttacgtagtgacgtaagtagtaggtaaaggtaaaaagtagtacggtcgttaggtttaggtttaaggttcgggggacgtaacgggggtacgtcccggtcgggtaccctaccccg

SEQ ID NO: 411859 - DNA, 612 bp, Homo sapiens
  misc_feature: GZ8MTXP02FHUTM.17.28.C06.1.454.CMB.2.raw
  modified_base (209)..(209): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggaccccccgggnaggagggtcaccatatcttgttctggaaacagctccggcatctcaactaaacattttgctggtaccagcaattccccaggactccggccccccgactcctcatctatagaatgatcatccggcccctccggggtcccctgaccccgtattcctctggcctccatcgtctcggcaccctcacgccctccctgacccatcaggtgggcctccggtccgaggactggaggtctagattagttactggtcgccgtaaccggtggggataggactactccgtagtaaacgttcggggtccgggttggttaccgggggcggggaaccgggggaccacggggtcctcgggtaacccgttaaccgtaaaggtccgacggaccccgaaaggggtcccctccggtccccccgg

SEQ ID NO: 411860 - DNA, 687 bp, Homo sapiens
  misc_feature: GZ8MTXP02JSR7A.17.28.C06.1.454.CMB.2.raw
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtcgtccgtcggggaccccccgggcaggacgggtccaaccatatcttgttctggaaacagctccggcatctacaactaaactattttgctggtaccagactaattcccgaggactccggcccccgactcctcactctaataagaaatcgatcacgtccggtccccgtccggggtccctcggtacctacgttcctcgtcggtcctccctagttcgtccgtcgggacctaccctccgaccgtcccctacccgtacgaccctacgtccgtacggtcgggcgtcccgggtacgaggtacgtgacggtcgtagtagtttacttacgtgtcgaccgtacgggtggtaacttcggaactacgtccgtaggtacgttcggggtaccggttacgggttccgggacggggtaaaccgggacctacggggtccgtacccggtaacccgttacgtaaacggttccgaaccggtacccggaacggtcccgtccccggacccccgtttcccggg

SEQ ID NO: 411861 - DNA, 771 bp, Homo sapiens
  misc_feature: GZ8MTXP02HEZDC.17.28.C06.1.454.CMB.2.raw
  modified_base (239)..(239): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcgggacccccggcaggaggtcaccatatcttgttctaggaaacngctccggcatctacaactaaactattttgctggtaccagactaacttccccgaggacctcccggccccccgtactcctacatcctaataagtaaatcgaactcacgtccccggaccccgttcccggggtcccctagacccccgttattccgtcgtcggtccttacccagttcggtccttcgggccctaccctccgacgtccccctacccgtacgaaccctacgtccgtaagggtcccggggtaccgtccccggggtaccggaagggtacgtacggggtacggtccttaaggttaactttaacgtttaccgtcgggtacggtacccggttaaccgggtggggtaacttccgggaaactccgttaccgtagggttaaacggttccgggggttaccgggttcggggttaccgggggaccgggttaaccgggggaaacccgcgggggttaccccgtacggttaaaccccggttccgttaaaacggtcccggaaaccggtacccggaacgggtcccgttacccccggtccccccggg

SEQ ID NO: 411862 - DNA, 739 bp, Homo sapiens
  misc_feature: GZ8MTXP02IKSXF.17.28.C06.1.454.CMB.2.raw
  modified_base (205)..(205): a, c, t, g, unknown or other
  modified_base (258)..(258): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggnagagggtcaccatatcttgttctaggaacagctcggcatctacaaactaactnttttgctggtaccagacaattcacaggactccggaccccccgatcctcactctaataagaaaatcgactcacgtcccggtaccccgtccggggtccctcggtaaccccgtacttcctcgtcggcctaccgatcgtcgtcggacctacccgtaccaccgtcccctttaccccgacgtaccctaaacgttcccgaacggggttccggggtccccgttacccgggggtacccgggtaagggtaaacgttcggggaacgggttaccgttaggttaaactttttaaacgttacccggttaggtaccgggtacccggtaacccgggttggggtaactttacgggaaacctacggttacccgtaggtaacggttcggggttccgggttacggttaccgggggacggaacggggtaccgtacggtccgtacggtacccgttaacgtaacgccgtaccggaacccgtacggtcccgtacccgtcccccgg

SEQ ID NO: 411863 - DNA, 573 bp, Homo sapiens
  misc_feature: GZ8MTXP02JFZ40.17.28.C06.1.454.CMB.2.raw
  modified_base (278)..(278): a, c, t, g, unknown or other
  modified_base (302)..(302): a, c, t, g, unknown or other
  modified_base (332)..(332): a, c, t, g, unknown or other
  modified_base (339)..(339): a, c, t, g, unknown or other
  modified_base (353)..(353): a, c, t, g, unknown or other
  modified_base (376)..(376): a, c, t, g, unknown or other
  modified_base (384)..(384): a, c, t, g, unknown or other
  modified_base (457)..(457): a, c, t, g, unknown or other
  modified_base (493)..(493): a, c, t, g, unknown or other
tcagcgtagactagcacgaccggtgctcgatttagagctcacgtattgggtttggggaggtctcagagaggaggcttagccctggactccaaggcctttccacttgttgatcagcactgagcacagaggactcaccatggagttggggctgaactgggttttccttgttgctgttttagaaggtgtccagtgtgaggtccagttggttgagtccgggggagcctggtccagccgtggggggtccctgagactctcctgtgcagcctccgattcccctnagtagttatggatgacttggtccncagactccgagggaaggggctggagtgggngccaaanataaaagcaaaganggaaactgacccgtagtttacgngactctgnaggggtcttcaccatcgtcaagagaacaacgaccaaagaattcactgactcaacaactagaacagcctagganacgtcgacaacacaacgggtcctgtaattaactggngagagtagtaagtaaaggaaaagtaaagtagtacgtagttagttaaggtgggtacggacggacgaccgtcgtacgtaccg

SEQ ID NO: 411864 - DNA, 591 bp, Homo sapiens
  misc_feature: GZ8MTXP02F6FJH.17.28.C06.1.454.CMB.2.raw
  modified_base (303)..(303): a, c, t, g, unknown or other
  modified_base (376)..(376): a, c, t, g, unknown or other
  modified_base (406)..(406): a, c, t, g, unknown or other
  modified_base (448)..(448): a, c, t, g, unknown or other
  modified_base (457)..(457): a, c, t, g, unknown or other
  modified_base (482)..(482): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagcctggggggtccctgagactctcctgtgcagcctccggattccccttcagtagttattggatgacttggggtcccnccagacctccgaggggaaggggctggagtggggtggccaacataaagcaagataggactgccgtagtttacgnggactctgtgaagggtccgttcaccatccnccagagacaacgccaaagattcactgtatctacaactgaacngacctgagngtcgcagacacggccgtgtattacngtgcggataagtaggtaaggtaaaaagtagtgggtacgttggttaaggttttaggtaacgggggtcccgaagggggtacgtcccgttcggggtacctaccccggtttcc

SEQ ID NO: 411865 - DNA, 706 bp, Homo sapiens
  misc_feature: GZ8MTXP02JF7J1.17.28.C06.1.454.CMB.2.raw
  modified_base (397)..(397): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggtgaggtccggggagcctggtccagcgtgggggtcctggagactctcctgtgcacgcctccggtacttccccttcagttagttattggatgtacgttgggtcccgccagacctccgaggggaaggggctggggaggtggggtcggaccaaacaagtaaagacaaaggagtaggaactgacccgtagtttacgngtactgtgtaggacggggtcctttcacctatcctacgaagacgaaccaaccgaccaaagaacttacatagtactactaacaactagaaacacgtaccgtaggaacgacgtacgaccgaacgaaaccgacccgggtaccggttagtaacgttaaccgtgggtacgaacggtaaggtaagttaaagggtaaaaggggtaaaaaaagttaaggttacggggttaccgtttaaggtttacgggtttaagggtaccgggggtaccggtaaacgggggtacccgtcccggttaccgggttaccgttaacccccgg

SEQ ID NO: 411866 - DNA, 581 bp, Homo sapiens
  misc_feature: GZ8MTXP02FHP4Q.17.28.C06.1.454.CMB.2.raw
  modified_base (277)..(277): a, c, t, g, unknown or other
  modified_base (339)..(339): a, c, t, g, unknown or other
  modified_base (352)..(352): a, c, t, g, unknown or other
  modified_base (377)..(377): a, c, t, g, unknown or other
  modified_base (503)..(503): a, c, t, g, unknown or other
  modified_base (511)..(511): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgttttagaaggtgtccagtgtgaggtccagttggttgagtcggggagctggtccagccgtgggggtccctgagactctcctgtgcagcctccggattccccttnagtagttatggatgacttgggtccgcagactcgagggaaggggctggagtgggtggccaaanataaagcaaaganggaaactggccccgtagttttacgnggactcgtgtaggacggggtccgtttcacctatcctaccgagaagacaaacgaccaaagaacttcactgtatactaacaactagaacagcctagagagtcgacagaccgacggccgtgtactacgngtgcgganagtgtaaagaaaaagtagtgtctggttagttaaggtcggggacgaggggacgtccgtacggtctaacccg

SEQ ID NO: 411867 - DNA, 615 bp, Homo sapiens
  misc_feature: GZ8MTXP02GSXDX.17.28.C06.1.454.CMB.2.raw
  modified_base (307)..(307): a, c, t, g, unknown or other
  modified_base (339)..(339): a, c, t, g, unknown or other
  modified_base (382)..(382): a, c, t, g, unknown or other
  modified_base (423)..(423): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgtgctgttttagaaggtgtccagtgtgagtccagttggttgaggtccgggggaggcctggtccaggccgtggggggtccctgagactctcctgtgcagcctccggacttccccttcagtagttattggatgacttggtccncagctccgagggagggctggagtggtgccaanataaagcaagataggaactgaccgtagtttacgtgactcgtgnggacggggtccttacacctatcctacagacacaacgacaanactcatatatctaacaactagaacagcctagacgtagtaccgacgtacgaccgaccggtaccgttagtacttaacgtggtacgaggtaagtagttaaagggtaaaggtaaaaagttacgtaggtcttaggtttaggtttaaggttcggggaccgaacgggggtcctaccccggtttagggtcccctacccgg

SEQ ID NO: 411868 - DNA, 692 bp, Homo sapiens
  misc_feature: GZ8MTXP02IAHLI.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttccttgttgctgttttagaaggtgtccagtgtgaggtcagttggttgaggtccggggagcctggtccagccgtggggtccctgagactctcctgtgcagccctccggtacttccccttcagttagttattggatcgtacgttcgggtcccgccagacctccgaaggggaaggggcgtagggaggtggggtcggaccaaacgaagtaaaacgcgaaagagtaggaaacgtcggtaccccgtagttttaccggtggtacttcgtggttacgggtacggggttcccgtttacaacccgtattccctaccgaaggaaccgaaaccgaaaccgaccaaaagtaacttaccaacgttagttacttactaaacctaaactacgaacacgtcccttaggacgtacgtaccgacgacgaaccgaccggtccgtagtaacttacgtgtcgacgaagtagtaggtaaagaaaaagtagtcgtacgttgttaggtttaaggttcggggaccgtacggggtaccgtccggtacggtccctacccg

SEQ ID NO: 411869 - DNA, 558 bp, Homo sapiens
  misc_feature: GZ8MTXP02I7VDN.17.28.C06.1.454.CMB.2.raw
  modified_base (293)..(293): a, c, t, g, unknown or other
  modified_base (326)..(326): a, c, t, g, unknown or other
  modified_base (364)..(364): a, c, t, g, unknown or other
  modified_base (392)..(392): a, c, t, g, unknown or other
  modified_base (399)..(399): a, c, t, g, unknown or other
  modified_base (411)..(411): a, c, t, g, unknown or other
  modified_base (416)..(416): a, c, t, g, unknown or other
  modified_base (433)..(433): a, c, t, g, unknown or other
  modified_base (438)..(438): a, c, t, g, unknown or other
  modified_base (450)..(450): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtcagtgtgaggtcagttgtgagtccggggagcctggtcagctgggggtcctgagactctcctgtgcagcctccggattccccttcagtagtattggatgacttggccncagactcagggagggctggagtgggtgccaaanaataaagcaaagatggaaactgccccgtagttttacgnggactctgttgaggggtcttcacaatcncaagaanaacaacacaaanaatanatatatactaacaacanaacanacagagagcganagacgacgacgtagtattagtagtgagagagtagtaaaggaaaaagtaaaagtagtacgtagttagttaaggtacgggtacggacgggacgtaccgtacgtacgtacg

SEQ ID NO: 411870 - DNA, 675 bp, Homo sapiens
  misc_feature: GZ8MTXP02GKL5Y.17.28.C06.1.454.CMB.2.raw
  modified_base (346)..(346): a, c, t, g, unknown or other
  modified_base (369)..(369): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttccttgttgctgtttagaaggtgtcagtgtgaggtcagttggtgagtcggggagctggtcagccgtgggggtccctgagactctcctgtgcagcctcggacttccccttcagtagttatggatgacttgggtccgccagactccgagggaggggctggagtgggtgccaaacgataaagcaaaganggaaactgcccgtagttttacgngactcgtgtgaggggtccgtttacaccgtactcctaccaagacgaacaaacgccaaagtaacttcaacttagtacttactaaacaactacgaaacacgtccgtagaagacgtcgacgagaaccgacgggtacccgttagttaacttaccggtagttacggacggtaacggtaagttaggggttaaaaggggtaaaaaaagttaagttcggggtaccgtttagggttttaggttttaaacgggtttcggggggaacccctaaggggggacccgttccccggttacgggggttccttaaacccccggg

SEQ ID NO: 411871 - DNA, 659 bp, Homo sapiens
  misc_feature: GZ8MTXP02FQ8AA.17.28.C06.1.454.CMB.2.raw
  modified_base (190)..(190): a, c, t, g, unknown or other
  modified_base (211)..(211): a, c, t, g, unknown or other
  modified_base (251)..(251): a, c, t, g, unknown or other
  modified_base (268)..(268): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcgagggtcctcgggcccagtctgtgctgactcagcccaccctnagtgtcgtcgggacccccggnaggaggtcaccatatcttgttctaggaaacagcctccggnatctacaaactaaactntttgctggtaccagcctaacttccccgaggactccccggcccccctactccctcgactactaataagaatgactaccgacgtcccggtccccgtccggggtcccctagaccccgtacttcctcgtcgtcctccagtcggtcctcggcctaccctcacgtcccctaccctagaccctagtcgtacgggtcgggcccgttccgggtccggaggtactggaggtcttagtacgttaattacgtgtcgtacggtaccgggttagggacttacggaacttacgtccgtaggtaacggtcgggtcggttacgggtcgggacgggagggaccgtacggtcgtaccgaaccgttccgtaaacgccgaccggtacccgaagggcccctcccggtcccccg

SEQ ID NO: 411872 - DNA, 738 bp, Homo sapiens
  misc_feature: GZ8MTXP02JY24M.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtcagtgtgaggtccagttggttgaggtccggggaggcctggtccagccgtgggggtccctgagactctcctgtgcacgccctccggtacttccccttcagttagttattggatgtacgttgggtcccgccagactccggaggggaacggggctgggaggtggggtcggaccaaacgaagtaaaacgcgaaaaggtaagtaggggtaaactcggtacccccggttaaggttttttaccggtagggtaaccttcgttaggttacgggtaacgggggtccccgtttttaccgaaccccttaacttcccctaccgaaaggaacgaaacccgaaacccggacccaaaacggtaaacttacctaaccgttagtacttacctaactaactacgaaacacgtccctaggacgtagtccgacgacgaaccgaccgggtccgttacgttaactttacgttggtgtacggaggtagtaggttaaacggtaaaaaagttagtacggtacgttggtttaggtttaaggtcggggacgtacggggaccgtccgtacggtcctacccg

SEQ ID NO: 411873 - DNA, 691 bp, Homo sapiens
  misc_feature: GZ8MTXP02JFC9Y.17.28.C06.1.454.CMB.2.raw
  modified_base (279)..(279): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagccgtgggggtccctgagactctcctgtgcagcctccggacttccccttnagtagttattggatgtacgttcggtcccgccgagacctccggaggggaaggggcgtggaggtggggtcggacccaaacgaagtaaacggacaaaggtagtacgggaaaccgttcggtaccccccggttaggtttttaccggtcggtaacctttcgttaggtacgggtacgggggttcccgttttaccaacccgtacttccgtacccgaaggacgaaacccacgaacccaagtaacttcgacttagtactacaactaactagaacacgtctaggagacgtcgacgaacgaccgaccggtcgttagtaacttacgtgtcgaggaagtagtaggtaaaagggtaaaagtacgtggtacgttaggttgtttaagggcggggtaccgaggggtaccgccggttcgtacccgtacccg

SEQ ID NO: 411874 - DNA, 657 bp, Homo sapiens
  misc_feature: GZ8MTXP02ISRP3.17.28.C06.1.454.CMB.2.raw
  modified_base (207)..(207): a, c, t, g, unknown or other
  modified_base (240)..(240): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtcgtcggggaccccggnaggagggtcaccatattcttgttctaggaaacngcctccggcatctacaaactaaactattttgctggtaccagacaacttcccgaggactcccggaccccccgtatccctcatctaataagaaatgactcacgtccggccccgtccggggtaccctacggaccgttactttcctcgtacggtccttctacgttcgtcgtcggacctaccctccgaccgtcccctaccctacgaccctacgtcgtacggcgggtccgtcccgggtaccgaggacgtcggaggtcttagtaatttacgttacgtcggtacgaccgtacggggtaggtaactagactactcgtagtacgtcgggtccgggtacggtccggggacggacggaccgtacggtccgtacgtacccgttacgtaaggtacccgacgtacccggagtcccgtaccggtccccgtacg

SEQ ID NO: 411875 - DNA, 630 bp, Homo sapiens
  misc_feature: GZ8MTXP02H9J2V.17.28.C06.1.454.CMB.2.raw
  modified_base (404)..(404): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggaggcctggtccagccgtgggggtccctgagactctcctgtgcacgcctcccggtacttccccttcagtagttagttggatgtacgttcgggtccgccgagacctccgaggggaaggggcgtggaggtggggtcggaccaaacagtaaaagacgaaagataggaactggaccccgtagttttacgnggactcgtggtggtacgggtccgtttcacctatcctaccagacgaccaacgaccaagtaactacacttagtatactaacaacctagaacacgcctaggagtagtcgacagtttacgacggtaccgtgtacttacgtgtcgacgtagagtaggtaaagtaaaagtaagtacgtcgttagttaggttaaggttcgggacgtacgggacggtccgtcggtccgtacccg

SEQ ID NO: 411876 - DNA, 863 bp, Homo sapiens
  misc_feature: GZ8MTXP02IWATO.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgtttagaggtgtccagtgtgagtccagttggtgaggtcggggagctggtccagccgtgggggtcctgagctctcctgtgcacgccctccggtacttccccttcagttagttagttggattggtacgttcggggtccccgcccgaagtacccgtcccgggaagggggaaacgggggtcgtacggggagggttggggggtacggaaccccgaaaacgtaaagttaaaaacggaccgaaaaagggtaacgttaacggggtaaaacccgttcggggtaccccccccggggtttaaagggtttttttaacccggggtacgggttaaaacccgtttccgggtttaggggttaacggggtaaaccggggggtttccccccgtttttaacccgtaaacccccgttaacgtttcccccgttaacccccgaaaggggtaaacccggaaacccgtaaaacccgaaaccccggtaaaagtaaaccgtttaaccctaaccgttacgtttaaacccttaaccttaaaaccccgtaaaaccgttacgaaaaccaaccggtacccgttaaggaacggtacgtaccgacgaacgacccgacggtccgtagttacttacgtgtcgagtaagtagtagtaaaggtaaaagtagtggtacgttggttacgtttaaggtcggggacgacgggtcgccggtacggtcctaccg

SEQ ID NO: 411877 - DNA, 609 bp, Homo sapiens
  misc_feature: GZ8MTXP02GXLM7.17.28.C06.1.454.CMB.2.raw
  modified_base (278)..(278): a, c, t, g, unknown or other
  modified_base (303)..(303): a, c, t, g, unknown or other
  modified_base (333)..(333): a, c, t, g, unknown or other
  modified_base (370)..(370): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtggggggtccctgagactctcctgtgcagcctccggattccccttnagtagttattggatgacttgggccnccagacctccgagggagggctggagtgggngccaacataaagcaagatgaactgccgtagtttacgngactctgtggaacgggtccgtttcacctatcctccaagacgaccaacgaccaaagtattacactgtatctaacaactagaaacagacctaggagagtcgacacgacgaccggtccgtagtattacgtgtacgacgaagagtaggtaaaggaaaaacgtagtaggtacgttaggttagtttaacggtcgggggtacccgaggggtaccggtcccgtacggtacccgtacccggtttcccg

SEQ ID NO: 411878 - DNA, 602 bp, Homo sapiens
  misc_feature: GZ8MTXP02HKI9B.17.28.C06.1.454.CMB.2.raw
  modified_base (297)..(297): a, c, t, g, unknown or other
  modified_base (380)..(380): a, c, t, g, unknown or other
  modified_base (416)..(416): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagctggtcagccgtgggggtccctgagactctcctgtgcagcctcggacttccccttcagttagttattggatgacttgggtccnccagacctccgaggggaaggggcgtgggaggtggggtggccaaacgataaaagcaagataggaactggaccgtagttttacgngactctggtgaacgggtcctttcacatcctccaganacaacgccaaagtaactcactagtactcctaacaactagaaacacgacctagagagtcgacagaccacggccgtagtacttacgtgtgacgagtataggtaaaggaaaaagttagtaggtacgttagttaggttttaggtcgggggacacgggggtacgtacccgtggtacccgtaccgtttcccg

SEQ ID NO: 411879 - DNA, 686 bp, Homo sapiens
  misc_feature: GZ8MTXP02JXIQH.17.28.C06.1.454.CMB.2.raw
  modified_base (239)..(239): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggcagagggtcaccatatcttgttctaggaaacngctccggcatctacaactaaactattttgctggtaccagcaacttcccaggacgtcccggccccccgactcctacactctaataagaaatgtatcacgtccggccccgtcccggggtcccctgaccccgtacttctcgtcggcctccagtcgtcgtcggccacctccacgtccccttcccgtacgacccatccgaggtcggggcccgttccgggtccggaggtagtcggacggtcttagtatttattacgtgtcgaccgtacggtggacgttacgactcgtacgttacggtaacgttcgggggttccgggtgggtttcccgggggacggggtaaccgggggtaccggtaaccgggtcccggttaccgggtaacccggttaaccgttaaaccgggtaccgaaccgggtaccccggaacgggttccccgtccccggttaccccccccgg

SEQ ID NO: 411880 - DNA, 648 bp, Homo sapiens
  misc_feature: GZ8MTXP02HIMHY.17.28.C06.1.454.CMB.2.raw
  modified_base (189)..(189): a, c, t, g, unknown or other
  modified_base (214)..(214): a, c, t, g, unknown or other
  modified_base (249)..(249): a, c, t, g, unknown or other
  modified_base (279)..(279): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcacgcccaccctnagtcgtcgtccggggacccccgggnaggacggtcaccattacttcttgttctaggaaacncgcctccggcatcctacaaacttaaacttntttgctaggtacagactaactccgaggacctccccggccccctactcctctactactaataagaatcgactcacgtcccggtcccgttccgggtcctagtacccgtctctcgtacgtctctatcgtctcgccctacctcgacccgtcccttacccgagtaccctagtccggtacgggtccggtcccgttaccgggaccggaggtaacgtggacggttcttaagttactttaacgttcgtgtcgtacggtacggtaggacttacgactacgtcgtaggtacggttccgggtacggtggtacgggacggtacgacgtcgtcgtacggtaccgtaacgacgtaccgaccgtacgccgtccgtcccgtacccg

SEQ ID NO: 411881 - DNA, 585 bp, Homo sapiens
  misc_feature: GZ8MTXP02GFX9I.17.28.C06.1.454.CMB.2.raw
  modified_base (339)..(339): a, c, t, g, unknown or other
  modified_base (373)..(373): a, c, t, g, unknown or other
  modified_base (431)..(431): a, c, t, g, unknown or other
  modified_base (446)..(446): a, c, t, g, unknown or other
  modified_base (487)..(487): a, c, t, g, unknown or other
  modified_base (493)..(493): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtgggggtccctgagactctcctgtgcagcctccggattccccttcagtagttattggatgacttgggtccgccagactccgagggaagggctggagtggtggccaaanataaagcaagatggaactgaccgtagttttacgnggactctgtgaacgggtccttcaccatcctccagagacaacgccaaagatcactgtanctacgaactgaaacngcctagagtacgcgacagactaccggccgttgtaacttacngtacgngagtatagtaggaaaaataggcgtacgttcggttagttttaacgcgggggtacccgaaggggacgtaccccggtggttaccaccggtttccc

SEQ ID NO: 411882 - DNA, 775 bp, Homo sapiens
  misc_feature: GZ8MTXP02H6FCA.17.28.C06.1.454.CMB.2.raw
  modified_base (210)..(210): a, c, t, g, unknown or other
  modified_base (241)..(241): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcgagggtcctgggcccagtctgtgctgactcagcccacctcagtgtcgtcggggacccccgggnaggacggtcacatatcttgtactaggaaacngctcggcatctacaaactaaacttattttcgctacggtaccagactaacttcccaaggtcctcccggacccccccgtatcccctactactactaagtaaagtaaaatcggtaactccgtaacggtccccgggtcccccggtccccgggggttacccctcggtaacccgttccttccgttacgtccggtccttaccgtagtttcggtccgtccggtacctacccctacgtacccgtcccctacccctacggtaccccagtccggtacggtccggggtacccgttcccggggtaaccgaagggtcgtacgggacggtacgttagtaacgtttaaaccgtttcgtcgggttacgacccggtaacggggttggggaaactacggtaactacgttccggttaaggtaacggtttcgggggttacccgggttggggttaccggggacggggtaaccgggaccggtacggtccgtaccggtaaccgttacgtaacgtccgaaacggtcccgaacggtccctcccgggttacccccgtccgg

SEQ ID NO: 411883 - DNA, 611 bp, Homo sapiens
  misc_feature: GZ8MTXP02GHXD0.17.28.C06.1.454.CMB.2.raw
  modified_base (278)..(278): a, c, t, g, unknown or other
  modified_base (304)..(304): a, c, t, g, unknown or other
  modified_base (388)..(388): a, c, t, g, unknown or other
  modified_base (479)..(479): a, c, t, g, unknown or other
  modified_base (534)..(534): a, c, t, g, unknown or other
  modified_base (597)..(597): a, c, t, g, unknown or other
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgctgttttagaaggtgtccagtgtgagtccagttggtgaggtcgggggagcctggtccagccgtgggggtccctgagactctcctgtgcagcctccggattccccctnagtagttattggatgacttgggtccncagactccgagggagggggctggagtgggtcggaccaaacgaataaaagcaaaggtataggaaactgacccgtagtttttacgnggaactctggttggacggggcctcgttacaccctatcctaccagacgacgaaaccgaccaaaagacttcactgtactactaacaaacctanaaactcgaccttgaagtacgacgcaacgacgaccggtcgttacgtattacgtggngacgaagtatggtaaaaggaaaatagtaggctttaggtaagtttaggtacggcgagggtaccncccgttagtacccg

SEQ ID NO: 411884 - DNA, 591 bp, Homo sapiens
  misc_feature: GZ8MTXP02JK3R6.17.28.C06.1.454.CMB.2.raw
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggtttccttgttgctgttttagaaggtgtccagtgtgaggtccagttggttgaggtccgggggaggcctggtccagccgtggggggtccctgacgactctcctgtgcagcctccggacttccccttcagtagttattggatgacttgggccgccagactccgaggggaaggggctgggagtggtggccaacataaaagcaagatggaactggccgtagttttacgtgactctggtgaacgggtcctttcacctatcctccagacacaaacgcaaagtaatcactgtatactacaactagaacagacctagagagtcgcagacacggccgtagtactagtcgtgcgtagagtaggtaaggtaaaaacgtagtacggtctacggttgtttaaggtcgggggacgtaacggggacgtcccggtacggtcctacccgttcccg

SEQ ID NO: 411885 - DNA, 582 bp, Homo sapiens
  misc_feature: GZ8MTXP02HUXCI.17.28.C06.1.454.CMB.2.raw
  modified_base (377)..(377): a, c, t, g, unknown or other
  modified_base (491)..(491): a, c, t, g, unknown or other
  modified_base (530)..(530): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggttgagtccggggagcctggtccagccgtgggggtccctgagactctcctgtgcagccctccggattccccttcagtagttattggatgacttgggtccgccagactccgagggaaggggctggagtgggtggccaacataaagcaaagatggaactgcccgtagttttacgngactctgtgaggggtccttacaccatctaccagagaccaaagccaagaattcactgtactctacaactagaacagtcctgaagagtcgacagacgaccggcgttgaactttacngtgcgtagagttacgaaggtaaaaagtagtacggggttnttggtttagttaaggttcggggacgtacgggacgtccggtcggtacctaccg

SEQ ID NO: 411886 - DNA, 663 bp, Homo sapiens
  misc_feature: GZ8MTXP02HE3VK.17.28.C06.1.454.CMB.2.raw
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggcaggagggtccaccatatcttgttctaggaaacagctccggcatctacaactaaacatttttgctggtaccagcaacttcccaggtactcccggcccccgactcctcatctaatagaaatgactcgagtccggcccgttcccggggtccctacgaccccgtacttcctcgtcggtctccatcgtctcggccctacctcgacgccctccctacgaccctactcgacggtcgggccctcccgggtacccgaggtacgtacggacggtcttaggtaacttttacgttacgttcggtcgtaccgtaccggtagggtactacggtaactacgttcccgtagtaacgttcggggttacccggttggttaccgggggacgggtaacgggaccgacgggtaccgtcggtaacccgtaaccgttaaacgtccgaaccggtccgaacggtccttccggtacccccg

SEQ ID NO: 411887 - DNA, 842 bp, Homo sapiens
  misc_feature: GZ8MTXP02JEUE3.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttccttgttgctgttttagaaggtgtccagtgtgaggtccagttggtgagtccggggagcctggtccagccgtgggggtccctgagactctcctgtgcagcctccggacttccccttcagttagttatggatgacgttgggtcccgcagcctccgaggggagggcgtggaggtggggtacgaccaaacgaagtaaacgcgaaaggagtacggaaacgttcggacccccggttaaggtttttaccggtagggtaccttacgttggtaacgggtaccgggggttccccgttttaccaacccgttacgttccctaacccgaacgggaaacgaaacccgaaacccgtacccaaaaggtaactttaccaacgtttacgttaaaccttaccctaaaaccgtaaacgttaccgaaacgtaaccggtaccccgttaaggggaacgtaccggtaccccggaacgtaaccgggaaccccggtacccggggtacccgtttaagtttaaccgtttaaccggtgggttccggaccggtaaggttaagttaaaggggtaaaacgggtaaaaaaacggtttaggtacggggttaccgtttagggtttaaaggggttttaaccgggttaacgggggtaccggggtaacgggggttaaccccggtaccccggttttccgggtacccgtttaacccccggg

SEQ ID NO: 411888 - DNA, 614 bp, Homo sapiens
  misc_feature: GZ8MTXP02ITZLR.17.28.C06.1.454.CMB.2.raw
  modified_base (438)..(438): a, c, t, g, unknown or other
  modified_base (454)..(454): a, c, t, g, unknown or other
  modified_base (527)..(527): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtgggggtccctgagactctcctgtgcacgcccgtccggactttcccccttcagttagttagttggatgtacgttgggtcccgccgagtaccgtccggaggggaaggggtctggggaggtggggtcggaccaacgaataaacgcaagagtaggaactcgaccgttagtttacgtgactcgtgtgacgggtccttacacactcncagagaacacaccaanagtcattgatctaacaatacgaactcgccgtagagtcgtacacgagaccgtcggacctttgtacgttacgtgngacgagtagtaggtaaaggtaaaagtagtcgtagttagtttaggttaagtacgggggcgaacgggtaccgccgtcgtacctacccgg

SEQ ID NO: 411889 - DNA, 679 bp, Homo sapiens
  misc_feature: GZ8MTXP02H571U.17.28.C06.1.454.CMB.2.raw
  modified_base (598)..(598): a, c, t, g, unknown or other
  modified_base (677)..(677): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggtttcttgttgctgttttagaggtgtcagtgtgaggtccagttggttgaggtcggggagcgtggtcagccgtgggggtcctgagactctcctgtgcacgcctccggtacttcccctcagtagttattggatggtacgttcgggtccgccgagtacctccggaaggggaacggggcgttaggggaggtggggtcgggaccaaaacgtaagtaaaaacggacgaaaggacgttaacggggaaactcggacccccggtaaggtttttaaccggcggtaacttcgtgggttacgggacgggttcccgtttacaccgtactccgtacccgaagaacacccgaaacgcccgtaaaagtaacttccgaactttgtaactacaaacctacgtacgaaacgacgcgtagagtacgacgacgtaacggcgacggtcgtattacgtagtcgngagtataggttaggaaaacgaaaaggtcgtcggtaagttgtttaccggtggtcggacggtaggcccttcgacgttcccncg

SEQ ID NO: 411890 - DNA, 622 bp, Homo sapiens
  misc_feature: GZ8MTXP02HBK92.17.28.C06.1.454.CMB.2.raw
  modified_base (382)..(382): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcgggggagcctggtccagcctgggggtcctgagactctcctgtgcagcctccggattccccttcagtagttattggatgtacttgggtcccgcagactccgaggggaacggggctggaggtggggtgaccaacataaagcaaagatggaaactgaccccgtagtttacgnggactctggtagagggtccgtttacacgtatcctccgagacgacaacgaccaagaacttcaacttgtatctacaactcgaaacagcctaggacgtagtcgacacgaacacgggcccgttagtacttactaggtcgcgaagtagttaggtaaacgggtaaaaagtagtacggggtacttggttagtttaagggtcggggaccgtaaacgggggcctcccggttagggtcccttaaccccgg

SEQ ID NO: 411891 - DNA, 582 bp, Homo sapiens
  misc_feature: GZ8MTXP02JSQYP.17.28.C06.1.454.CMB.2.raw
  modified_base (280)..(280): a, c, t, g, unknown or other
  modified_base (336)..(336): a, c, t, g, unknown or other
  modified_base (378)..(378): a, c, t, g, unknown or other
  modified_base (472)..(472): a, c, t, g, unknown or other
  modified_base (481)..(481): a, c, t, g, unknown or other
  modified_base (504)..(504): a, c, t, g, unknown or other
  modified_base (512)..(512): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagccgtgggggtccctgagactctcctgtgcagcctccggacttccccttnagtagttattggatgacttgggtccgccagactccgagggaggggctggagtgggngaccaacataaagcaagataggaactgccccgtagtttacgnggactctggtaggacgggtccgttcacctatctacgagagaaccaaccgaccaaagtaacttcaactgtactctaaacactagaacagcctagngtagtcganagaccacggccttgtacttacgngtgacganagtagaaaggtaaaatagtcgcgtggtttagttaaggtcggggacaggggacctccggtacgtcctaccg

SEQ ID NO: 411892 - DNA, 582 bp, Homo sapiens
  misc_feature: GZ8MTXP02GEWCF.17.28.C06.1.454.CMB.2.raw
  modified_base (257)..(257): a, c, t, g, unknown or other
  modified_base (277)..(277): a, c, t, g, unknown or other
  modified_base (379)..(379): a, c, t, g, unknown or other
  modified_base (388)..(388): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagccgtgggggtccctgagctctcctgtncagcctccggattccccttnagtagttattggatgacttggtccgccagactccgaggggaaggggctggagtggggtggaccaacagtaaagcaaagatggaactgccccgtagtttacgnggactgtgngacgggccgttacaccatcctcagacacaacgccaaagattacatagtatctaacaactacgaacacgcctagacgagtcgcgaagaccgacgggccgtagtacttacgtgtgtcggagagtagtaaggaaaaagtagtggagttgttagttaaggttcggggaccgtacggggacgtccgtcggtactacccg

SEQ ID NO: 411893 - DNA, 619 bp, Homo sapiens
  misc_feature: GZ8MTXP02FKDJS.17.28.C06.1.454.CMB.2.raw
  modified_base (277)..(277): a, c, t, g, unknown or other
  modified_base (301)..(301): a, c, t, g, unknown or other
  modified_base (386)..(386): a, c, t, g, unknown or other
  modified_base (533)..(533): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagctggtcagcctgggggtccctgagactctcctgtgcagtccctccggattccccttnagtagttatggatgacttggtccncagactccgaaggggaaggggcgtggaggtggggtggaccaaacgaataaaagcaaagagtaggaactgtcccgtagttttacgnggactcgtggtacgaggggtcctttacacctattccgtaccaagacgaaccaaacgacccaaagtaacttcaacttagtacttactaaaccaaactagaacagacctagacgagtcgacagaccgacggcgtagtattacgtgtcgngaagtataggtaaaggaaaaagtagtaggtacttggttagtttaagtcgggggaccacgggggcgtacccggtggtaccgtacccg

SEQ ID NO: 411894 - DNA, 638 bp, Homo sapiens
  misc_feature: GZ8MTXP02FUVUG.17.28.C06.1.454.CMB.2.raw
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggcaggagggtcaccatatcttgttctggaaacagctccggcatctacaactaaactatttttgctggtaccagcaacttcccaggactccggccccccgactcctcatctataagaaatgatcactccggccccgtccggggtccctgaccccgtacttctcgtcgctccatgtcgtggccacctcacgccctccctagaccctatcgaggtcgggccgtccgggtccgaggatggaggcttaggtaatttacgttacgtggtcggaccgtaccgggtgggtactacggtaactaccgtacgtaggtaacgggtcggggttaccgggttcgggttaccgggggacgggtaacgggaccggtacggtccgtaccggtaaccgtaaccgtaacggaccaccggacccgaacggtcccgtacccggttcccccgg

SEQ ID NO: 411895 - DNA, 566 bp, Homo sapiens
  misc_feature: GZ8MTXP02H0NXC.17.28.C06.1.454.CMB.2.raw
  modified_base (372)..(372): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagctggtcagccgtgggggtcctgagactctcctgtgcagcctccggtacttccccttcagtagttattggatgtactggtccgcagactcgagggaaggggctggagtgggtgccaacataaagcaaagataggaactgcccgtagttttacgnggactctgtggagggtccgtttcacctatctaccgagacgaacacgaccaaagtaacttcactagtatactaacaactgaacacgcctagagagtcgacagacgacggcgttagtattactgtgcgtagataggtacgaaaaagtagtggacttgtagtttaagtggggacgagggctcccgtggtactacccg

SEQ ID NO: 411896 - DNA, 761 bp, Homo sapiens
  misc_feature: GZ8MTXP02HD4IV.17.28.C06.1.454.CMB.2.raw
  modified_base (209)..(209): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtctcgggacccccgggnaggagggtcaccatatcttgttctaggaaacagctccggcatctacaaactaaactattttgctggtaccagcaattccccaggactcccggcccccactcctcatctatagaaatgatcgactccggccctccggggtcctcgaccccgtattctctggcctccatcgtctggacctaccctcgaccgtccctccccgtcgaaccctacgtccgacgggttcgggcccgtttacccgggtacccggagggtaacgtcgggtaacgggtccttaacgggttaattttaacgttaacccgtttgggtaccgacccggttaacccggggttggggaattacgggtaaccctaacgttaccccggttagtaaaaccgggtttcgggggttacccgggttcgggtttaacccgggggcccgggaaaccgggggtaaccccgtacgggggtccccgttaacccgggtaaccccgggttaacccgttaaaacgggttcccgaaaccggggtaacccccgaaacgggggtacccctttacccccgggtaccccccccgg

SEQ ID NO: 411897 - DNA, 606 bp, Homo sapiens
  misc_feature: GZ8MTXP02HSWMY.17.28.C06.1.454.CMB.2.raw
  modified_base (313)..(313): a, c, t, g, unknown or other
  modified_base (387)..(387): a, c, t, g, unknown or other
  modified_base (397)..(397): a, c, t, g, unknown or other
tcagcgtagactagcacgaccggtgctcgatttagagctcacgtattgggttttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggagcctggtccagccgtgggggtccctgagactctcctgtgcacgccctccggacttccccttcagttagttattggatgtacgttgggtcccncagactccgaggggaggggctggaggtgggtgaccaacataaagcaaagagtggaactgcccgtagttttacgngtactcgtgngacgggtccgttcactatcctcgagacgacaacgccaaagtactcacttgtactctaaacaacgtagaaacagccctagacggtacgtcgacgaagaccgacgggtccgttagtacttaccgtggtcgacgtagagtttaggaaagtaaaagtagtcggacttggttagtttaaggtcggggacaggggctacccgtggtacctacccg

SEQ ID NO: 411898 - DNA, 566 bp, Homo sapiens
  misc_feature: GZ8MTXP02IC40U.17.28.C06.1.454.CMB.2.raw
  modified_base (328)..(328): a, c, t, g, unknown or other
  modified_base (363)..(363): a, c, t, g, unknown or other
  modified_base (397)..(397): a, c, t, g, unknown or other
  modified_base (451)..(451): a, c, t, g, unknown or other
  modified_base (480)..(480): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttctgttgctgttttagaagtgtcagtgtgaggtcagttgtgagtcggggagctggtcagccgtgggggtcctgagactctcctgtgcagcctccggacttcccctcagtagttattggatgacttggtccgcagactcgaggggaagggctggagtgggtggccaaanataaagcaaagataggaactgcccgtagtttacgnggactgtgtgagggccgtttacacatctacaganacaacgacctaaagaattcactgatactaacaatagaacagcctagacgagcgngaagacgacggccgtagtactacgtaggngagagagtaggaaacgtaaaagtagtcgtacgttaggttaggtttaaggtcggggaccggaggaccgtccggtcggtaccgtaccg

SEQ ID NO: 411899 - DNA, 684 bp, Homo sapiens
  misc_feature: GZ8MTXP02FLIDS.17.28.C06.1.454.CMB.2.raw
  modified_base (209)..(209): a, c, t, g, unknown or other
  modified_base (265)..(265): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtcgtcggggacccccgggnaggagggtcaccatatcttgttctggaaacagctccggcatctacaaactaaactnttttgctggtaccagcaattcccaggactccggccccccgactcctcatctaataagaaatgatcacgtcccgggccccgttccggggtccctggaccgtactttcctcgtcggcctcctattcggtctcggcctacccgtccacgtcccctccctcgaaccatcgacggtcgggtccgtcccgggtaccgaggtactaggacgctagtatttagttaccgtggtacgaccgtaccgggtggtaactcgactaacgttcccgtaggtaacggtttcggggttacccgggttgggtttacccgggggacggggtaaccggggaccggtaacgggtccgttacccgggtaacccgttaccgttaaacggtaccgaaccggaccccgtaaacgggtcccttacccggccccccgtttaccgg

SEQ ID NO: 411900 - DNA, 699 bp, Homo sapiens
  misc_feature: GZ8MTXP02JRTTZ.17.28.C06.1.454.CMB.2.raw
  modified_base (408)..(408): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtccagtgtgaggtccagtggtgagtccggggagcctggtccagccgtgggggtcctgagactctcctgtgcacgcctccggacttccccttcagttagttagttcggatgtacgttgggtcccgaccgagacctcccgaaggggaacggggcgtggggaggtggggtcggaccgaaacaagtaaaacgcaaagagtaggaaacgtgaccccgtagtttttacgnggtactcgtgtacggacggggtccctttacgacctattcctaccgaagtaacgaaccaaccgacccgaaagtaacttacaacgttagtactacttaaccaacttacgaaaccacgtccgtagaaggtacgtccgacgaacgaccgaccgggtacccgttgtaactttactggtacgacgtaagagttaggtaaaggtaaaaagtagttaggtacgtttaggtttacggtttaaggttacgggggaccgtaaacgggggtacccgtcccggttcggtaccccgtttacccgg

SEQ ID NO: 411901 - DNA, 631 bp, Homo sapiens
  misc_feature: GZ8MTXP02GJVDC.17.28.C06.1.454.CMB.2.raw
  modified_base (211)..(211): a, c, t, g, unknown or other
  modified_base (242)..(242): a, c, t, g, unknown or other
  modified_base (425)..(425): a, c, t, g, unknown or other
tcagcgtagactagcacgaccggtgctcgatttagagctcacgtattgggtttggggcagcttcagctgtggtagagaagacaggattcaggacaatctccagcatggccggcttccctttcctcctcaccctcctcactcactgtgcagggtcctgggcccagtctgtgctgactcagccaccctcagtgtcgtcgggaaaacccccggnaggaggtcaccatatcttgttctaggaaacngcctccggcatctacaaactaaactattttgctggtaccagactaactccgaggactccccggccccccgactcctctactctaataagaaatgactcacgtcccggtccccgtcccgggtcctacgacctcttctcgtcgcctcatcgtctcgcctacctccaccgtccctcccacgacccngtccgagggtcggccctccgggtacgaggtatggagtctagtattacgttacgtgtcgcgtacgggtgactcgactcgtacgtggtaacgttcggggttccggtagggtccggggacgggtaccgggaccgtacggtccgtacggtaacccgttacggtaacgtccgaaccggacccggacggtcccgtcccggtccccgttccgg

SEQ ID NO: 411902 - DNA, 576 bp, Homo sapiens
  misc_feature: GZ8MTXP02J2EDC.17.28.C06.1.454.CMB.2.raw
  modified_base (381)..(381): a, c, t, g, unknown or other
  modified_base (460)..(460): a, c, t, g, unknown or other
  modified_base (492)..(492): a, c, t, g, unknown or other
  modified_base (574)..(574): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggaggctggtccagcctgggggtccctgagactctcctgtgcagcctccggattccccttcagtattattggatgacgttggtccgccagactccgaggggaacggggctgggagtgggtggcaaacataaagcaaagatggaaactggcccgtagttttacgnggactcgtgtgacggggccgtttacacctatctaccgagacgaccaaacgccaaagaacttcactgtatctaacaactnaacgagacctgagagtcgcaagcacgggtccnggttaacttcgtgtgcgtagagtgaaagggaaaatagtggcgttagttggttaagcggggacgtaggacgtccgtcgtaccncg

SEQ ID NO: 411903 - DNA, 633 bp, Homo sapiens
  misc_feature: GZ8MTXP02G11ND.17.28.C06.1.454.CMB.2.raw
  modified_base (282)..(282): a, c, t, g, unknown or other
  modified_base (312)..(312): a, c, t, g, unknown or other
  modified_base (397)..(397): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggagcctggtccagccgtgggggtccctgagctctcctgtgcacgcctccggacttcccccttnagttagttattggatgtacgttgggtcccnccagacctcgaggggaaggggctggaggtggggtcggaccaaacaagtaaagcaaagagtaggaaactgaccccgtagtttacgnggactcgtggtaggtacggggtcctttacacctatcctaccgagacgaacacgaccaaagtacttacactagtactctaacaactagaacagcctagagtcgcacgacgacgacggcgtagttactacgtgtagacgtaagtagtaggtaaaggtaaaaagttagtggtacttggtttaggtttaaggttcgggggaccgtaacgggggtccgtcccgttcgggtaccctacccgg

SEQ ID NO: 411904 - DNA, 634 bp, Homo sapiens
  misc_feature: GZ8MTXP02IJ9SB.17.28.C06.1.454.CMB.2.raw
  modified_base (343)..(343): a, c, t, g, unknown or other
  modified_base (381)..(381): a, c, t, g, unknown or other
  modified_base (386)..(386): a, c, t, g, unknown or other
  modified_base (406)..(406): a, c, t, g, unknown or other
  modified_base (413)..(413): a, c, t, g, unknown or other
  modified_base (501)..(501): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaggtgtcagtgtgaggtccagttggttgaggtcggggagctggtccagccgtgggggtcctgagactctcctgtgcagcctccggtacttccccttcagttagttattggatgtacgttcggtccgccagacctccgaggggagggctggagtgggtgaccaaanagtaaagcaaagataggaactgaccccgtagtttacgngactntagtggagggtcctttcacntctcagnacacgacaagatcactgtactacaacaactagaaacacggtacctggaaggtagtccgacgagaccgaaccggtcgtagtacttaacnggttagaacggtgtaagttagggtaaaacggtaaaaaagttacggtaggtaccgtttaaggtttacggttttaaagggtcgggggtaaccggaacgggggtacccgtcccgttacggggtacccttaacccgg

SEQ ID NO: 411905 - DNA, 765 bp, Homo sapiens
  misc_feature: GZ8MTXP02GNH79.17.28.C06.1.454.CMB.2.raw
  modified_base (249)..(249): a, c, t, g, unknown or other
tcagcgtagactagcacgaccggtgctcgatttagagctcacgtattgggtttggggagcttcagctgtggtagagaagacaggattcaggacaatctccagcatggccggcttcccctctcctcctaaccctcctcactcactgtgcagggtcctgggcccagtctgtgctgactcagccaccctcagtgtcgtcgggaccccccggcagagggtcaccatatcttgttctaggaaacagcctccggnatctacaactaaactattttgctgtaccagcattcccgagactcccggccccccgactcctcataccttaataagaaaatgactcgacgtcccgggccccgttcccggggtcccctacgaccgtacttccctcgtcgcttccagtcgttacgtggaccctaccctaccgaccgtccccttccctacgtaccctaagttccgagggttccggggtcccgttaccccgggggtacgacggggagttacgggacgtacgttaggttaatttaaaccgtttccttgggttacggacccgtaaccggggtttagggtactaacgtaaccgtacgttacccggttaaggtaacggtttccgggggttcccggggtttaacggggtttccggggaacccgggggtaggggtacccccgaaggggttccgtaaccggtaaccccggttaccgtttaaaacgcccgaaaccggacccccgtaaagggtcccccgtacccggtaccccccgttacgggttaccccc

SEQ ID NO: 411906 - DNA, 662 bp, Homo sapiens
  misc_feature: GZ8MTXP02GV579.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtccggggagcctggtccagccgtgggggtccctgagactctcctgtgcagccctccggacttccccttcagttagttattggatgacgttggtcccgccagacctccgaggggaaggggctggaggtgggtggaccaaacaagtaaaagcaaagataggaactgacccgtagtttacgtggactcgtgtgacgggtccgttacaccatccaccagacgaccaacgaccaaagtaacttcactagtactctaaacaactacgaacacgtcctaggaacgtacgtccgacgaacgaacccgaccgggtccgttagttaaactttaccgtggtagaccggtaagaagttagggtaaaaggtaaaaacggttatggggtacgttaggtttaggtttaacgggtttacgggggacccgtaggggtacccggtcccgttacggtacccgtaaccccgg

SEQ ID NO: 411907 - DNA, 617 bp, Homo sapiens
  misc_feature: GZ8MTXP02FK50Z.17.28.C06.1.454.CMB.2.raw
  modified_base (225)..(225): a, c, t, g, unknown or other
  modified_base (270)..(270): a, c, t, g, unknown or other
  modified_base (294)..(294): a, c, t, g, unknown or other
  modified_base (320)..(320): a, c, t, g, unknown or other
  modified_base (326)..(326): a, c, t, g, unknown or other
  modified_base (361)..(361): a, c, t, g, unknown or other
  modified_base (367)..(367): a, c, t, g, unknown or other
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgctgttttagaaggtgtcagtgtgaggtcagttggtgagtcggggagctggtccngccgtgggggtcctgagctctcctgtgcagcctcggattcccctnagtagttatggatgacttggtccncagctcgagggagggctggagtgggngccaanataaagcaagatggaactgacccgtagttttacgngtactntgtagacggggtccttacacctatcctacagacgaacaaccgacaaagtaattacatagtactactaacaactacgaaactacgcctagacggtacgtacgacaagaccgaccgggtccgttagttacttacgtgtcggacgtaagtagttaggtaaagggaaaaagttagtaggtacttggtttaggtttaaggtttcgggggaccggtaacgggggtacggtacccgtacgggtaccgttaaccccgg

SEQ ID NO: 411908 - DNA, 806 bp, Homo sapiens
  misc_feature: GZ8MTXP02JA4ST.17.28.C06.1.454.CMB.2.raw
  modified_base (241)..(241): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgtgctgtttagaggtgtccagtgtgaggtcagttggtgaggtccggggagcctggtccaggccgggtcgggtccngacgtctctcgtgtcgcgcgtccgtccgtcccttcccctatagttagttgtagtagtcgtacggttccggtccacgacgtaccgtaccgggaagggggacgggtcggtaggggagggtggggtaccggaaccaaaacgtaaaagtaaacggaacgtaaaggtacgtaacggaaacgtaccggtaccggtttaacggttttacgggacgtacctttcgggtaggtaacggggtaccggggtttccccgtttaaaccgaaccgttaccgttacccgtaaccggaaacgggaaaccgtaaaacccggaaccccgaaaacggtaaaacttaaccttaacctacgtttaattaccctaaactaaacccgtaaagtaaccgaaacgtaccggtccgtaaaggtaacggtacccgtaccgaacgaaaccggaaccggccccggggttaattacgttaaagttcgttgggaccgaaggtataagggtaggtaaaaaaggaaaagttggtcggtagtttagtttggttaacgggacggggtacggaacggtccgtacccgtcggaccgttcccg

SEQ ID NO: 411909 - DNA, 754 bp, Homo sapiens
  misc_feature: GZ8MTXP02ISCWN.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggtgagtcggggagctggtccagccgtgggggtcctgagactctctgtgcagcctccggacttccccttctagttagttattggatgtacgttcgggtcccgcacgactccgaggggaaggggcgtggaggtggggtcggaccaaacgaataaaggacaaagagtaggaaacgtggtaccccgtaggttttacgtggtaccttcgttaggtacgggtacgggggtcccgttttacaccctagttccctaccaaagtaacgaaacccgaaaccgaccaaaacgtaacttacctaacgttagttaattacctaaacaacttacgaaactacggaccgttaggaacgtacggtacggaccgaacggaacccgaccgggtacccggttagttaaacgtttacgtcggttacggacggtaaaggtagttaagggttaaaagggtaaaaaaaggttaaagttcggggtaacgtttagggtttagggttttaacgggttacgggggtacccggtacgggggtaccggtacccccggttcgggtaccccgttaccccgg

SEQ ID NO: 411910 - DNA, 649 bp, Homo sapiens
  misc_feature: GZ8MTXP02HM79H.17.28.C06.1.454.CMB.2.raw
  modified_base (282)..(282): a, c, t, g, unknown or other
  modified_base (307)..(307): a, c, t, g, unknown or other
  modified_base (394)..(394): a, c, t, g, unknown or other
  modified_base (536)..(536): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaacttgggttttccttgttgcttgttttagaaggtgtccagtgtgaggtcagttggtgaggtccggggagcctggtccagccgtggggggtccctgacgactctcctgtgcacgccctccggtactttccccttnagttagttatggatgacgttggccncagactccggaggggagggcgtgggaggtggggtacggaccaaacaagtaaaagcaaagagtaggaactgaccgttagtttttacgnggtactcgtaggtacggaacgggttcccgtttaccaaccgtattcccgtaccgaaggaacgaaacccgaaaccgaaccaaagtaacttacacttagttactacctaactaaacgtacgaactacgacctagagacgttcganacgacgacggtccgtagtacttagtcgtagacgagtagtaggtaaaggtaaaagtagtaggtcgtgttaggttaggtcggcggacgggtcgtaccgtcggtcctaccgttccc

SEQ ID NO: 411911 - DNA, 632 bp, Homo sapiens
  misc_feature: GZ8MTXP02GID6M.17.28.C06.1.454.CMB.2.raw
  modified_base (239)..(239): a, c, t, g, unknown or other
  modified_base (253)..(253): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttccttgttgctgttttagaaggtgtccagtgtgaggtccagttggttgagtcggggagcctggtcagccgtggggtccngagactctcctgtncacgcctccggacttccccttcagttagttattggatgacgttggtccgcacgacctccgaggggaacggggcgtggaggtggggtcggaccaacaagtaaagacgaaagagtaggaaactgcccgttagtttacgtggactgtgtggacgggtccgtttacacctatctacagacgacaacgaccaagtaacttcactagtactactacaacgttacgaaacacgcctagagacgtcgacacgaccgacggtccgtagttacttagtcgtacgacgagtagtaggtaaaaggtaaaaagtacgttgggacgtttggttacggtttaagggttacggggaccgtaggggtaccgtcccggttacggtacccgtaacccg

SEQ ID NO: 411912 - DNA, 616 bp, Homo sapiens
  misc_feature: GZ8MTXP02I6EW7.17.28.C06.1.454.CMB.2.raw
  modified_base (300)..(300): a, c, t, g, unknown or other
  modified_base (594)..(594): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagcctggtccagcctgggggtccctgagactctcctgtgcagcctccggattccccttcagtagttatggatgacttggtccncagactccgagggaggggctggagtggtgccaacataaagcaagatggaactgccccgtagtttacgtggacttctagtgacggggtccgtttacaccgtatcctaccgagtagaccaacgacccgaaagtaattcactagtactctaacaactagaaactacgcctaggagtagtccgacaacgacgacggtccgtggttaacttaccgtgtagacggagtagtaggtaacggtaaaaaagtacggtacggtacgttggtttagtttaaggttcgggggacctagggggtacncccggttacgggtcctacccgg

SEQ ID NO: 411913 - DNA, 623 bp, Homo sapiens
  misc_feature: GZ8MTXP02HB2EB.17.28.C06.1.454.CMB.2.raw
  modified_base (278)..(278): a, c, t, g, unknown or other
  modified_base (304)..(304): a, c, t, g, unknown or other
  modified_base (380)..(380): a, c, t, g, unknown or other
  modified_base (385)..(385): a, c, t, g, unknown or other
  modified_base (388)..(388): a, c, t, g, unknown or other
  modified_base (415)..(415): a, c, t, g, unknown or other
  modified_base (426)..(426): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgaggtccggggagcctggtccagccgtgggggtccctgagctctcctgtgcagcctccggattcccccttnagtagttattggatgacgttggtccnccagacctccgaggggaacggggctggaggtgggtgaccaacataaagcaagatggaactgccccgtagtttacgngactntgngacggggtcctttcacctatcctacgngaacacgaacnccaaagatcgatgtactcgaacaactacgacacgacctagacgtacgtcgacgacgaacgaccgggtaccgttgttaaacttccgtggtaccgaggaaagagtaggtaaaaggaaaaagttggtaacggtcgttaggtttacggtttaaggttacgggggacctagggggtacctcccggtaggtaccttaccccgg

SEQ ID NO: 411914 - DNA, 634 bp, Homo sapiens
  misc_feature: GZ8MTXP02ID12C.17.28.C06.1.454.CMB.2.raw
  modified_base (300)..(300): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagcctgtcagccgtgggggtcctgagctctcctgtgcagcctccggacttccccttcagtagttattggatgtacttgggtccnccgagacctccgaggggaaggggctggaggtggggtgaccaacaagtaaagcaaagagtaggaactgccccgtagttttacgtgacttcgtggtcgaggggtcccgtttacacctattcctaccgagacgaaaccaacgaccaaagacttacaacgttgtactactaacaatacgaacacgcctagagagtcgacagacccgacggtacgtacgtagttacgtgtagacgtagtagttaggtaaaggtaaaaacgttagtaggtacgtttaggttggttttaaggttcgggggaccgtaacggggtaccgtcccggttacggtcccgtaccccg

SEQ ID NO: 411915 - DNA, 613 bp, Homo sapiens
  misc_feature: GZ8MTXP02GPWUO.17.28.C06.1.454.CMB.2.raw
  modified_base (188)..(188): a, c, t, g, unknown or other
  modified_base (245)..(245): a, c, t, g, unknown or other
  modified_base (326)..(326): a, c, t, g, unknown or other
  modified_base (390)..(390): a, c, t, g, unknown or other
  modified_base (450)..(450): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctnagtgtcgtcggggacccccgggcaggacgggtcaccatattcttgttctaggaaacngctccggcatctacaaactaaactattttgctggtaccagctaacttcccgaggactcccggcccccgctcctcatctaanaagaatgatcacgtccggcccgtccggggtcctgaccccgtattcctcgtcgctaccatcgtcncggcacctcacgccctccctacgacctatcgacggtcgggtcccgtccgggtccgagggngttacggacggtcttaggtatttacgttacgtgttacgcgaccggtggatacgactactccgtagtacgtcgggtcggtgggtacgggcgggaagggaccgtacggtcgtacggaccgtaacgtaacgaccgtacggaccgaacggtccgtcccgtcccccgg

SEQ ID NO: 411916 - DNA, 637 bp, Homo sapiens
  misc_feature: GZ8MTXP02HDLUT.17.28.C06.1.454.CMB.2.raw
  modified_base (392)..(392): a, c, t, g, unknown or other
  modified_base (401)..(401): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgaggtccgggggagcctggtccagccgtgggggtccctgagactctcctgtgcagccctccggtacttccccttcagttagttattggatgtacttgggtcccgcagactccgaggggaaggggctgggaggtggggtcgaccaaacaataaagcaaagagtggaactgaccccgtagtttacgngactcgtgnggaggtccgtttcacctatctccagacacaacgaccaaagacttcaacttgtaactctaacactagaacacgtcctaggagtagtcgacaacgaaccgaccgggtccgttagttaacttcgtagtcggagtacgtagttagggtaaaggtaaaaagttacgtaggtcttaaggtttaggtttaaggttacgggggaccgtaaaggggtccgtcccgttacgggtaccctaccccgg

SEQ ID NO: 411917 - DNA, 638 bp, Homo sapiens
  misc_feature: GZ8MTXP02GEX4C.17.28.C06.1.454.CMB.2.raw
  modified_base (249)..(249): a, c, t, g, unknown or other
  modified_base (266)..(266): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtctcggggacccccggcagagggtcaccatatcttgttctaggaaacagcctccggnatctacaaactaaactnttttgctaggtaccagacctaattcccaggacctcccggccccccgtactcctcactctaataagaaatgatcacgtccggccccgtccggggtccctcgaccccgtacttctcgtcggcctaccatcgtctcggcctacctcacgccctcctacgacctatccgaggtcgggcccgttacccggggccgagggacgttcggacgcttagtactttacgttacgttgacgtaccgaccggtggatacggacctacttccgtagtaacggttcggttccggggttcggtccggggacggtaacggggaccacgggtccgttccggaccgtaacccgtagtcccgacggacccgaggtcccgtaccgtcccccg

SEQ ID NO: 411918 - DNA, 635 bp, Homo sapiens
  misc_feature: GZ8MTXP02HCSO1.17.28.C06.1.454.CMB.2.raw
  modified_base (304)..(304): a, c, t, g, unknown or other
  modified_base (376)..(376): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaaggtgtcagtgtgagtcagttggtgaggtccggggagcctgtccagccgtgggggtcctgagactctcctgtgcacgcctccggacttcccctcagtagttattggatgtacgttcggtccncagactccgtggaaggggctggagtgggtgacaacataaaagcaaagatgaactgaccccgtagttttacgngtactgtgacggtacggtccttacactatccacaagacaacaacgactaaagtactactatatactactaacaactagaacagtaccgtaggacgagtccgacgaacgaaccgaccggtaccgttagttaacttacgtgtacgaacgtaaggtaagttaagggtaaaaagtaaaaacggttaggtcggtaactttaggttaggtttaagggtcggggaaccggtacggggtacccgtacccgttaggtaccccgtcccg

SEQ ID NO: 411919 - DNA, 632 bp, Homo sapiens
  misc_feature: GZ8MTXP02I8QEE.17.28.C06.1.454.CMB.2.raw
  modified_base (333)..(333): a, c, t, g, unknown or other
  modified_base (412)..(412): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggaccccccgggcaggagggtccaccatatcttgttctaggaaacagctccggcatctcaactaaactatttttgctggtaccagctaattcccaggactccggccccccgactccctcatctataagaaatgatcacnccggtccccgtccggggtcctacggtacctaccgttctctcggtcctcctatcgtcgtcggccactccacgtcctcccngacccatcgaggtcggccgttccgaccgaggactggacggtctagtaatttattacgttcggtacgtccgaccgggtgggtactagactagtaccgtaggtacggtcgggtccgggttaggtccgggggacgggtaccggggacgacgggtccgtaacggtacccggtactaaacggtcctacggacccgacggtccgtccccggtccccgttacccggg

SEQ ID NO: 411920 - DNA, 694 bp, Homo sapiens
  misc_feature: GZ8MTXP02FZ6VN.17.28.C06.1.454.CMB.2.raw
  modified_base (627)..(627): a, c, t, g, unknown or other
tcagcgtagactagcacgaccggtgctcgatttagagctcacgtattgggtttggggaggtctcagagaggaggcttagccctggactccaagggcctttccacttggtgatcagcactgagcacagaggactcaccatggagttgggctgaacttgggttttccttgttgctgtttagaaggtgtcagtgtgagtcagttgtgagtcgggagctgtcagccgtggggtcctgagacctctcgtgtgcgcgtccgtcgtccttccctgtagttagttgtagtgtcgtcggtcggaccacgtacgtccgtagggacggggaggtcggtaggtgggttcggaccgaacgaacgtaaaacgtaacgaacgtaagtacggtacgtacgtcgtaccggtttaaggtttaccgtacggtacttggtacggtaacgggtacgggttccttacaaccgttcctaccgacgaagaccgaaaccgacctaaacgtaaattacgtactaagttattacctacgtaaaccacgtacgaacgtacccgtgaacggacggttcgacgacggacctacggcggttacgtagttaacctgtaggtacgtagaagttacgtaaaggaaaaaggttaagttacgnggtttactaggtttagggttaaacgggcggaaacggtacgtaccgttccggtaacgtcccttaaccg

SEQ ID NO: 411921 - DNA, 799 bp, Homo sapiens
  misc_feature: GZ8MTXP02HQUSF.17.28.C06.1.454.CMB.2.raw
  modified_base (252)..(252): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaaggtgtccagtgtgaggtcaggttggttgaggtcggggagctggtccagccgtgggggtcctgagactcncctgtgcacgtcctccggtacttcccctcagttagtagttgatgtacgttcggtccgccagaccgtaccggaggggaacggggtctagggaggtggggtacggaacccaaagtaagtaaaaggacgaaaggtagtacggtaacgttacggtaccccggttaacgtttttaaccgggtggtaaccgtttcggtttacgggttaacgggtaacccgggggtttcccgtttttaacaaacccgttaccttacccgtaccgaaaaggaaccgaaacccgaaaccggaaacctaaacggtaacttaccgtaacttacggttaaacttaaactaaaacgttacgaactagaccgttagaacgtacgtacgacgaacggtaccgaccggtaccgttagttaacttaacggtggttacgacggtaaagtacggtaaaacggttaaagggtaaaaaagttacggttaacggttacgtttcgggtttaacggtttaggggtaacggggtacggaacgggtccggtacccggttccggtacccgtaccggtttccccg

SEQ ID NO: 411922 - DNA, 598 bp, Homo sapiens
  misc_feature: GZ8MTXP02JZN9E.17.28.C06.1.454.CMB.2.raw
  modified_base (278)..(278): a, c, t, g, unknown or other
  modified_base (284)..(284): a, c, t, g, unknown or other
  modified_base (299)..(299): a, c, t, g, unknown or other
  modified_base (334)..(334): a, c, t, g, unknown or other
  modified_base (370)..(370): a, c, t, g, unknown or other
  modified_base (462)..(462): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagccgtggggggtccctgagactctcctgtgcagcctcggattcccctnagtatntggatgactggtccncagactccgagggaggggctggagtgggtgccaanataaagcaaagatggaactgccccgtagttttacgngggtactcgtggtggacgggtccgtttacacctatcctccgagacgaacaacgcccaaagtaacttacactagtactctaacaactagaacncgcctgagtacgcgacagacgacgggccttagtacttaccgtgtagcgtagtataggtaaacggtaaaaatacgtaggcttaggttacgtttaaggttcgggggaccgtaggggccgtccgtcggtacgtccccgg

SEQ ID NO: 411923 - DNA, 773 bp, Homo sapiens
  misc_feature: GZ8MTXP02G0HEG.17.28.C06.1.454.CMB.2.raw
  modified_base (215)..(215): a, c, t, g, unknown or other
  modified_base (249)..(249): a, c, t, g, unknown or other
  modified_base (256)..(256): a, c, t, g, unknown or other
  modified_base (286)..(286): a, c, t, g, unknown or other
  modified_base (327)..(327): a, c, t, g, unknown or other
  modified_base (334)..(334): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctccaccctcctcactcactgtgcgagggtcctgggcccagtctgtgctgactcacgcccaccctcagtcgtccgtccggggaccccggngaggacggtcacctattatcttgtcgtaggaacncgctcgntatctactaactaacttattgctcgtacanactactccgaggctccccggcccctactcctcattcgtaanagtaaancgatctaccgtcccggtaccccggtccgggtaccctacgtaccccgtattccgtcgtacgtcctcgtagtcgttccgcggtaccctaccgctaccgtccctacccgtactacctcgtacggtcggtcggtcccggttaccggaccggaaggtacggcgggtacgtaccgtttaaaggttactttaaccggttaacggtttcgaccggggtaccggtaaccgggtacggggtttaaccacggtaaacctttccgggtaacgtttaccgggttaaagggggttacccgggggtttccggggtttaacgggggaccggggttaaaccgggggaacggggtaacccggtcgggtaccgttaacccggtaaaccggtaacgtaaacccggggtacccgaacgggtaccccgtacccggggtcccggtacccctaccccccgggg

SEQ ID NO: 411924 - DNA, 751 bp, Homo sapiens
  misc_feature: GZ8MTXP02F2LPP.17.28.C06.1.454.CMB.2.raw
  modified_base (246)..(246): a, c, t, g, unknown or other
  modified_base (259)..(259): a, c, t, g, unknown or other
  modified_base (282)..(282): a, c, t, g, unknown or other
  modified_base (308)..(308): a, c, t, g, unknown or other
  modified_base (349)..(349): a, c, t, g, unknown or other
  modified_base (404)..(404): a, c, t, g, unknown or other
tcagcgtagactagcacgaccggtgctcgatttagagctcacgtattggggtttggggaggtctcagagaggaggcttagccctggactccaaggcctttccacttggtgatcagcaccgagcacagaggactcaccatggagttggggctgaacttgggttttccttgttgcttgttttagaaggtgtccagtgtgaggtcaggttggtgaggtccggggagcctggtccagccgtgggggtccngagactctctgtncagcctccggtacttccccttanagttagttatggatgacgttcggccncagacctcgaggggaaggcgtgggagtggggtcgaccaaanaagtaaagacaaaggtagtacggtaacgtcggtaccggttaacggtttttacggnggtaacctgtagggtacgaacgggttcccgtttaccacctactaccctacgacgaacgtaacaaccgtaaccaaagtacttacattatactaccgtaaacaacgtacgaaactacgtaccgtagaggtaccgtacgacgtaaaccggaccgtaacccgggtcctttaggttaattttaccgagggttacgccgggggaaaattacggttaaaagggttaaaaccgggaaaaaaggtttacgttcgggttacggtttagggttttaggttttaaccgggggtaacgggggaccggtaaacggggtccggtaacccccggttgggtttacccccaccggggtttacccc

SEQ ID NO: 411925 - DNA, 576 bp, Homo sapiens
  misc_feature: GZ8MTXP02H4Y0Z.17.28.C06.1.454.CMB.2.raw
  modified_base (377)..(377): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagcctgggggtccctgagactctcctgtgcagcctccggattccccttcagtagttattggatgacttgggtccgccagactccgagggaaggggctggagtgggtggccaacataaagcaaagatggaactgcccgtagtttacgnggactctgtgagggtccgtttcaccatctcagagacaagccaaagattcactgtactactacgaactagaacagcctagagagtcgcagacgacggccgtgtacttactgtgcgtagataggtaggaaaaagtagtagggacttggttagtttaacggttgggggaccgtaggggacgtccccgtgggtacctacccgg

SEQ ID NO: 411926 - DNA, 606 bp, Homo sapiens
  misc_feature: GZ8MTXP02HTFZG.17.28.C06.1.454.CMB.2.raw
  modified_base (274)..(274): a, c, t, g, unknown or other
  modified_base (338)..(338): a, c, t, g, unknown or other
  modified_base (378)..(378): a, c, t, g, unknown or other
  modified_base (452)..(452): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgagtcagttggttgagtcggggagctggttcagccgtgggggtcctgagactctcctgtgcagcctccggacttccccttnagtagttattggatgacttgggtccgccagacctcgagggaggggctggagtgggtgaccaaanaataaagcaaaggatagggaaatgacccgtagttttacgngtactgtagagtacgggtccttacactatcacgagacacaacacaaagtaatacatgtaactactaacaactanaacacgcgtagagtacgtacgacgaacgacgtacggtcgtagtacttagtgtagagtagtaagttaggtaaaaggtaaaaagtagtacggtacgttaggttaggtttaaggtacggggtaacggtaacgggtacgtccgtacggtaccgtaccg

SEQ ID NO: 411927 - DNA, 707 bp, Homo sapiens
  misc_feature: GZ8MTXP02IE5X4.17.28.C06.1.454.CMB.2.raw
  modified_base (389)..(389): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtcagtgtgaggtcagttggttgagtcggggagctggtcagccgtgggggtcctgagactctcctgtgcagcctccggtacgttccccttcagtagttattggatgacttgggtccgccagacctcgaggggaaggggctgggaggtggggtcggaccaaacaagtaaaagcaaagagtaggaactgaccccgtaggttttacgnggtactcgtggtaggacgggtccgtttacacctatcctacgagacgaaccaaacgaccaaagtaacttcacttagtaactactaaacaacgtagaaaccagtaccctaggaacggtacgtacgacgaacggaccgaaccgggtacgttacggttaacgttaaccgtgggtacgacggtaaggtaagtttagggtaaaacggtaaaaaaaggttaaggttacgggtacgtttagggtttaagggttttaacggggtttcgggggaaccggttacgggggacccgttaccccggtttacgggttacccgttaacccccgg

SEQ ID NO: 411928 - DNA, 623 bp, Homo sapiens
  misc_feature: GZ8MTXP02HOOBE.17.28.C06.1.454.CMB.2.raw
  modified_base (220)..(220): a, c, t, g, unknown or other
  modified_base (282)..(282): a, c, t, g, unknown or other
  modified_base (398)..(398): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagagtactcaccatggagttggggctgaactgggttttccttgttgcttgttttagaaggtgtccagtgtgaggtccagttggttgaggtcggggngctggtccaggccgtgggggtcctgagactctcctgtgcacgccgtccggtactttcccctnagttagttattggatgtacgttcgggtcccacgagacctccggaggggaacggggctaggaggtgggtcgaccaacaataaagcaaagagtaggaactgaccccgttagtttacgngtacttcgtggtagacggggttcctttacacctagtcctacgagtacaacgaacaccaaagactcgatagtactactaactacagaacacgtaccgtagagtacgtcgacgagaccgccggtacgttagtacgttacgtgtagcggtagtagttaggaaagtaaaaacgtgtacgtgttaggtttgttaacggtcggacgtacgggcgtccgtcgtacgttcccg

SEQ ID NO: 411929 - DNA, 701 bp, Homo sapiens
  misc_feature: GZ8MTXP02I26IH.17.28.C06.1.454.CMB.2.raw
  modified_base (223)..(223): a, c, t, g, unknown or other
  modified_base (395)..(395): a, c, t, g, unknown or other
  modified_base (520)..(520): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgagtcagttggtgaggtcggggagctgtcngccgtgggggtcctgagactctcctgtgcagccctccggacttcccctcagttagttattggatgtacgttcgggtccccgaccagaccgtccggaggggaaggggcgtgggaggtcggggtggaccaacaagtaaagcaaagagtaggaactggacccgtagttttacggngtacttcgtggtacgggagggtccgtttacacctacgttcctacgagacgaccgaacgacccaaagtaacttcaacgttgtactactaacaactacgaaacacgtccgtaaggacgtagtccganaaccggaccgaccggggtaccgttaggttaaacgttaccgtggtccggacgtaaaggtatttaaaggggtaaaagggtaaaaaacgttaaggtcgggttacgtttaggtttaggttttaaagggtccgggggtaaccgtaacgggggtaccggtaccccgtggggttacccgttaaccccg

SEQ ID NO: 411930 - DNA, 605 bp, Homo sapiens
  misc_feature: GZ8MTXP02JY6D0.17.28.C06.1.454.CMB.2.raw
  modified_base (302)..(302): a, c, t, g, unknown or other
  modified_base (340)..(340): a, c, t, g, unknown or other
  modified_base (374)..(374): a, c, t, g, unknown or other
  modified_base (379)..(379): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggtgagtccgggggagctggtccagcctgggggtccctgagactctcctgtgcagcctccggacttccccttcagtagttattggatgacttgggtccnccagactccgaggggaggggctggagtgggtggccaanataaagcaaagatggaactgcccgtagtttacgngactntgtggacgggtccttcaccatcctcagacgaccaacgccaaagtattcatgtactctaacaactgaacagcctggaagacgtcgacaggacaccggggtccgtgttaattacgtgtcggacgagtagttgggaaaggttaaaaaggtacgttacgggacttagggtttaggtttaacggttcgggggaccgggtaggggaccgtccccgttcggtaccctacccgg

SEQ ID NO: 411931 - DNA, 659 bp, Homo sapiens
  misc_feature: GZ8MTXP02FET9R.17.28.C06.1.454.CMB.2.raw
  modified_base (240)..(240): a, c, t, g, unknown or other
  modified_base (254)..(254): a, c, t, g, unknown or other
  modified_base (276)..(276): a, c, t, g, unknown or other
  modified_base (331)..(331): a, c, t, g, unknown or other
  modified_base (338)..(338): a, c, t, g, unknown or other
  modified_base (352)..(352): a, c, t, g, unknown or other
  modified_base (377)..(377): a, c, t, g, unknown or other
  modified_base (418)..(418): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgtgctgtttagaaggtgtccagtgtgaggtccagttggtgagtccggggagctggtccagccgtgggggtcccngagactctcctgtncagccctccggacttccccttnagtagttatggatggacttgggtccgccagactccgagggagggctggagtgggngccaaanataaaagcaaaganggaactgaccccgtagttttacggngtactcgtgaggacgggtccttacactactctacgaagaanaaccaaaccgaaccaaagtaaacttacaacgttagtaactactaaacgtaactacgaaacacgccgtaggacgtagtaccgacgaacgaccgtaccgggtaccgttagttacttacgtggtacgaggtaagtaggttaaggttaaaaggaaaaacgttagtacggttacgttaggtttaggtttaacgggtacgggggaccggtacgggggtacccgtacccggtacggtacccgtacccg

SEQ ID NO: 411932 - DNA, 676 bp, Homo sapiens
  misc_feature: GZ8MTXP02J0JYS.17.28.C06.1.454.CMB.2.raw
  modified_base (272)..(272): a, c, t, g, unknown or other
  modified_base (300)..(300): a, c, t, g, unknown or other
  modified_base (445)..(445): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgagtcagttggtgagtcggggagctggtcagcgtgggggtcctgagactctcctgtgcagcctccggtacttccccttnagttagttattggatgtacttgggtccnccgtagactccgaggggaaggggcgtgggaggtggggtcggaccaaacagtaaacgacaaaggattagggaaactcggacccccggttaaggttttacgacgggtaacttcgtgggttacggacgggggtcccttttacaccgtntaccctcaaggacgaaccaaaccggaacccaaaggtaacttcaacctgtaacttacctaacaaactagaaacacgtacctggagacgtccgacgaacggaaccgaccgggtaccgttaggttaaacttcgtggtacgacgtaagtagtaggtaaacggaaaaagttagtacggacttaggttagtttaaggttcgggggacgtacggggtcgtcccgtggtaccgtacccg

SEQ ID NO: 411933 - DNA, 597 bp, Homo sapiens
  misc_feature: GZ8MTXP02JAQYK.17.28.C06.1.454.CMB.2.raw
  modified_base (382)..(382): a, c, t, g, unknown or other
  modified_base (387)..(387): a, c, t, g, unknown or other
  modified_base (413)..(413): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagccgtgggggtccctggagactctcctgtgcagcctccggattccccttcagtagttattggatgacttgggtcccgccagacctccgaggggaaggggctgggagtgggtcggccaacataaagcaagatggaactgcccgtagtttacgngactntgtagaggtccgttcacatctcaganacaacgccaagaatcactgatctaacaactagaacagcctaggagtacgtacgacgacgaccgacgggccgttagttacttacgtaggtcgacgaaggagttagggaaacggtaaaaagttacgtaggtcgttaggtttgtttaagtgggggaccgacggggcgtaccgtcgggtcctacccgg

SEQ ID NO: 411934 - DNA, 743 bp, Homo sapiens
  misc_feature: GZ8MTXP02FGQDF.17.28.C06.1.454.CMB.2.raw
  modified_base (210)..(210): a, c, t, g, unknown or other
  modified_base (259)..(259): a, c, t, g, unknown or other
  modified_base (292)..(292): a, c, t, g, unknown or other
  modified_base (422)..(422): a, c, t, g, unknown or other
  modified_base (427)..(427): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggccagtctgtgctgactcacgccacctgagtgtccgtcggggaccccccggnaaggacgggttaccaccgtattacttcgttagttaccgtaggaaaaccncggctcccggcaactcctaacaaacttaaactntttttacgctaggtacccagacaacgtttccccgaggtactcccggaccccccgattccctcactcctaatacggaaaacttgactcagttcccgggtccccgtcgggggtcccctagaacccccggttnttccncggtcggacttaccagttcgtccgacggcctaccccgtcgtaaccggcccccttaccgttacggaacctacgtaaccgggtacggtcgggggttacccgtcccggggttacggaggtactaggacgggtcctagtacttactagttcgtcgaccgtaaccggtcggtaactcggtaactacgtaccgtacggtaaacgttcggggttacccgggttacggttccggggaacggggaccggggaccgtaacgggtccctacggtaccccgtaaccgtagtaccgaccggacccgtaacgcccgtacccgtcccccgg

SEQ ID NO: 411935 - DNA, 611 bp, Homo sapiens
  misc_feature: GZ8MTXP02H1FS4.17.28.C06.1.454.CMB.2.raw
  modified_base (300)..(300): a, c, t, g, unknown or other
  modified_base (327)..(327): a, c, t, g, unknown or other
  modified_base (358)..(358): a, c, t, g, unknown or other
  modified_base (384)..(384): a, c, t, g, unknown or other
  modified_base (480)..(480): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgagtccagttggttgagtccggggaggcctggtccagccgtgggggtccctgagactctcctgtgcagccctccggacttccccttcagttagttatggatgacttggccnccagactccgaggggaagggcgtgggnggtggggtcgaccaacgaataaaagcaaagntagggaactgtaccgtagttttacgnggtactcgtgtagaacgggtccgtttacactactcctccagacacaaccgacaaagatcatgtatactaacaatcgaacagcctagagagtaccgnacgacgacggccgtagttacgtcgtaggtgcggaagtgtaagggtaaaggtaaaaagttagtacggtacgttggttagtttagggttcgggggcgtaggggtaccgtcccgtcggttccgacccggtttcc

SEQ ID NO: 411936 - DNA, 618 bp, Homo sapiens
  misc_feature: GZ8MTXP02I1RZ2.17.28.C06.1.454.CMB.2.raw
  modified_base (385)..(385): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggtgaggtccggggagcctggtccagccgtgggggtccctgagactctcctgtgcagcctccggacttcccctcagtagttattggatgacttggtccgcagacctccgagggaaggggtctggaggtgggtggaccaaagataaagcaaagacgtggaaactcggacccgtagttttacgngtactcgtggtacgaggggtcctttacactactctcagacgacaacgacaagtaagttacacttagtactactaacaatacgaacacgtcctagagtacgtccgacgagaccgacggcgttacgtaaagttccgtgtgacgtagattagggtaaagtaaaaagtagtacggtatttagttaggtttaaggttcggggaacgtacggggacgtccggttacgtacgttaacccg

SEQ ID NO: 411937 - DNA, 612 bp, Homo sapiens
  misc_feature: GZ8MTXP02FK8F5.17.28.C06.1.454.CMB.2.raw
  modified_base (278)..(278): a, c, t, g, unknown or other
  modified_base (388)..(388): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggctggtccagccgtggggggtccctgagactctcctgtgcagcctcggattcccctnagtagttatggatgacttgggtccgccagactccgaaggggaaggggctgggaggtagggtggcccaaacaataaaagcaaagataggaactgccccgtagtttttacgngactctgtggagggtccgtttcacatctccgagacgacaacgaccaaagtaaacttcaacttgtaactacctaaacaactagaaacagccctaagagagtcgacagacccgacggcccgttagtaacttacgtgtagacgaagagtggtaaaggtaaaaaagtagtacgtacgtgttagtttaaggtcgggaccgtaggggacgtcccggtcggacctacccgg

SEQ ID NO: 411938 - DNA, 620 bp, Homo sapiens
  misc_feature: GZ8MTXP02JL0HY.17.28.C06.1.454.CMB.2.raw
  modified_base (494)..(494): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtgggggtccctgagactctcctgtgcacgcctccggtacttccccttcacgtagttattggatgtacgttcgggtccgccagacctccgaggggaaggggcgtgggaggtggggtggaccaaacgaataaaagacaaaggagtaggaaactgaccccgtagtttacgtggtactcgtgtagacgggtccgttcacctatctaccagacacaacgaccaaagaattcactgtactctaacaactgaacagcctagaagngtacgacagaccgacggccgtgtacttacgcgtgcgagtagtggtaaaggtaaaaagtagtagcgttaggttacgtttaagggtacgggaccgtaaggggccgtcccggtaggtacccgtaccccg

SEQ ID NO: 411939 - DNA, 626 bp, Homo sapiens
  misc_feature: GZ8MTXP02GOACU.17.28.C06.1.454.CMB.2.raw
  modified_base (266)..(266): a, c, t, g, unknown or other
  modified_base (292)..(292): a, c, t, g, unknown or other
  modified_base (310)..(310): a, c, t, g, unknown or other
  modified_base (363)..(363): a, c, t, g, unknown or other
  modified_base (526)..(526): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaacttgggttttccttgttgctgttttagaaggtgtcagtgtgaggtcagttggtgagtcggggagctgtcagccgtgggggtcctgagctctctgtgcagcctccggacttccccttnagttagttattggatgacttggtccncagactcgaggggagggntggagtggggtgacaacataaaagcaagataggactgtaccgtagttttacgngtactcgtgtcggaacgggtccctttacacctatccctaccagaacgaaccaaaccgacctaaagtaacttactacgtagttactacctaacaactacgaaacacgaccgtagagagtacgacgacggaccgaccggtaccgttacgttacttaacgtcgtancggggggtaatacgtaggtaaaggtaaaagtaagtaggtacgttagttagtttaggtcggggacggtacgggacgtcccgtacggtccgtaccgttcccg

SEQ ID NO: 411940 - DNA, 725 bp, Homo sapiens
  misc_feature: GZ8MTXP02J1GNP.17.28.C06.1.454.CMB.2.raw
  modified_base (403)..(403): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggtgagtcggggagcctggtccagccgtgggggtccctgagctctcctgtgcagcctccggacttcccctcagttagttattggatgtacgttcggggtcccgccgagaccgtccggaaggggaaggggctggggaggtggggtcggaccgtaacgaataaagcaaaggagtaggaaactgaccccgttaggttttacgnggtacttcgtggttaggacggggtcccgtttacacccgtattcccgtaccgaagaaccgaaacccgaaacccggaaccctaaaacggtaaactttacccgtaacgttacggttaaccttaaccttaaaccaaaccgttacgaaaacgtaccgtacccgttaggaacggtaacgttccggaaccgaacggaccgtaccgggtaccggttacggttactttacgtggtcgagtaagagtaggtaaagggtaaaaacgtggtaggtcgtttggttacggtttaaggttcggggacgtaggggccgtccggtcggtaccgtacccg

SEQ ID NO: 411941 - DNA, 637 bp, Homo sapiens
  misc_feature: GZ8MTXP02IGGZP.17.28.C06.1.454.CMB.2.raw
  modified_base (398)..(398): a, c, t, g, unknown or other
  modified_base (501)..(501): a, c, t, g, unknown or other
tcagcgtagactagcacgaccggtgctcgatttagagctcacgtattgggtttggggaggtctcagagaggaggcttagccctggactccaaggccttttccacttggtgatcagcactgagcacagaggactcaccatggagttggggctgaactgggttttccttgttgctgttttagaaggtgtccagtgtgaggtccagttggttgagtcggggagctggtccagccgtgggggtccctgagctctcctgtgcagcctccggacttccccttcagttagttattggatggacgttcgggtcccgccagacctccgaggggacggggctgggaggtggggtcggcccaaacgaagtaaacgacaaaggatggaaactgaccccgtagttttacgnggtactcgtggtggaggggtccctttcaccatctacagacacaacgaccaaagtaattacacttagtactactaacaactagaacacgcctaggagagtccgnaacgacgaccggtcgtgtaacttacgtgtagcgaagtatggtaaacggtaaaaaggttacgtggacgttaggtttaggtttaaggttcgggggtaaccgaacgggggtccgtaccggttcggtacccgttaccccg

SEQ ID NO: 411942 - DNA, 635 bp, Homo sapiens
  misc_feature: GZ8MTXP02IL2OY.17.28.C06.1.454.CMB.2.raw
  modified_base (377)..(377): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtccagtgtgaggtccagttggttgaggtccgggggagctggtccagccgtgggggtccctgagactctcctgtgcagcctccggacttccccttcagttagttattggatgacttgggtccgccagactccgagggaggggctggaggtgggtgccaacataaagcaagataggaactgcccgtagtttacgngactctgtgacggggtccttcaccgtatcctcgagacgaccaacgaccaaagaacttcacttagtactactaacaactagaacagaccctagagtacgtcgacgaacgaccgaccgggtaccgttaggttaactttaacgttggtaccgaggaagtaggttaggtaaaggtaaaaaagttagtacggtacgttggtttaggtttaacggttcgggggaccgtaggggtaccgtcccggttacgggtaccttaccccgg

SEQ ID NO: 411943 - DNA, 636 bp, Homo sapiens
  misc_feature: GZ8MTXP02FRSH9.17.28.C06.1.454.CMB.2.raw
  modified_base (211)..(211): a, c, t, g, unknown or other
  modified_base (243)..(243): a, c, t, g, unknown or other
  modified_base (252)..(252): a, c, t, g, unknown or other
  modified_base (269)..(269): a, c, t, g, unknown or other
  modified_base (498)..(498): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcacgcccacctcagtcgtcgtccgggacccccggnaggacggtcaccatactcttgtctaggaaacngtctccganactcactaactaacttntttgctcgtacagtactaacttcccaggacctccccggccccctactcctactactactaagtaaagtaaacttgtaactcgtaaccgtccccggggtaccccgttaccggggtccctacgaccccgttacttcgtcgtccgtcctacgtagtcgtcgtaacggcctacctctaccgtccctcgtacaactcgtcgcggtcggtccgtccgggagtaggtgtgacgttnttagttacttagtcgagtcgtaacggtcgtagactacgtacgtacgtcggtagtcggttcggttacgggcgggtacggacggtacggcgtacgtcgtacgtaccgtaacgacgaacgaccgcgacgtccctccgtccg

SEQ ID NO: 411944 - DNA, 626 bp, Homo sapiens
  misc_feature: GZ8MTXP02IR1YZ.17.28.C06.1.454.CMB.2.raw
  modified_base (237)..(237): a, c, t, g, unknown or other
  modified_base (377)..(377): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtctcgggacccccggcagaggtcaccatatcttgttctggaaacngctcggcatctacaactaactattttgctggtaccagctaacttccccaggactcccggccccccgactcctcatctatagaaatgatcactccggcccgtccggggtaccctgaccccgtcttctcgtcggccttaccntgtctcggacctaccctcacggtcccctcccgtacgaccctactcacgggtcgggtcccgtccgggtcccgagggacttcggacgggtcttacggtaatttaacgttaccgttgttcggacgtacccggtggggatcggactacgtccgtagtacgttcgggtccggttgggttccgggcggggtaaacgggcctcggcgtcggacccgtcgtaacgtcgaaccgcccgaacggcccttccggcccccg

SEQ ID NO: 411945 - DNA, 622 bp, Homo sapiens
  misc_feature: GZ8MTXP02G62ZY.17.28.C06.1.454.CMB.2.raw
  modified_base (389)..(389): a, c, t, g, unknown or other
  modified_base (421)..(421): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtcagttggtgagtccggggagcctggtccagccgtgggggtccctgagactctcctgtgcagcctccggacttcccccttcagttagttattggatgtacttgggtccgccagacctccgaaggggaaggagctgggaggtggggtggccaaacaataaagcaaagataggaactggaccgtagttttacgnggtactcgtgtggaagggtcctttacgacctntctaccgagagaaccaaccgacaaagtaattcactacgttatactaacgaactagaaacagccctagagagtcgacgacgaccgacggccgtagtattacgtgtacgacgagagtaggtaaaggtaaaaaggttacgtaggtacgttaggttggtttaacggttcgggggtaccgaggggaccgtccggtacggtaccccg

SEQ ID NO: 411946 - DNA, 663 bp, Homo sapiens
  misc_feature: GZ8MTXP02I9TI1.17.28.C06.1.454.CMB.2.raw
  modified_base (240)..(240): a, c, t, g, unknown or other
  modified_base (357)..(357): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggcaggagggtcaccatatcttgttctaggaaacngctccggcatctcaactaaactattttgctggtaccagctaacttccagactccgcccccgactcctcatctaatagaaatgatcactccggcccgtccgggtccctcgaccccgtnttcgtctcggtcctcctatcgtcgtacggaccctacctcctaccgtccctccctacgacctactcgacggtcgggcctcccgggtccgaggtagtcggacggtcgtacgttaatttacttacgtcgtacgtccgtaccggtaggtaacgtacgtacgacttccgtagtaacggttcgggttccgggttacgggttccggggacgggggacggtacccggtacggggtaccgtaccggtacccggtaaccgtaacggtaccggaaccggtaccccggtaacgggtcccgttccccggtaccccccgg

SEQ ID NO: 411947 - DNA, 611 bp, Homo sapiens
  misc_feature: GZ8MTXP02HN896.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggaggcctggtccagccgtgggggtccctgagctctcctgtgcagccctccggacttccccttcagtagttattggatgtacgttcggggtcccgccacgactccgaggggaagggggctggaggtggtggaccaacataaaagcaaagatggaaactgacccgtagtttacgtggactcgtggtgacggggtcctttcaccatcctcagacgaacaacgccaaagaacttcactgtatctaacaactagaacacgcctagagagtcgacagacacggcgtatatctggtcgacgagtagttaggtaaagggaaaaaagttagtacggtcgtttaggttagttttaacggcgggggtacccgagggggtaccgcccgttgggttaccctcccg

SEQ ID NO: 411948 - DNA, 647 bp, Homo sapiens
  misc_feature: GZ8MTXP02F7PWE.17.28.C06.1.454.CMB.2.raw
  modified_base (348)..(348): a, c, t, g, unknown or other
  modified_base (389)..(389): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagctggtccagccgtgggggtccctgagctctcctgtgcacgccctccggacttcccccttcagtagttattggatgacttgggtccgccagacctccgaaggggaggggctggagtggggtggaccaanagtaaagcgaaagataggaaactgacccgtagtttttacgnggtactcgtgagacggggtcctttacacctatcctacagaacgaacaacgaccaaagaacttacgaacttagtacttacctaacaactagaacagaccgtagaagagtcgacaacgaaccgaccggcccgttagttacttacgtgtacgcgaaggtataggtaaaggtaaaaaagttagtacggtacgttaggttaggttttaaggttcgggggtaccgtaacggggaccgtcccggtacgggtaccctttaccccgg

SEQ ID NO: 411949 - DNA, 630 bp, Homo sapiens
  misc_feature: GZ8MTXP02JTMCP.17.28.C06.1.454.CMB.2.raw
  modified_base (298)..(298): a, c, t, g, unknown or other
  modified_base (371)..(371): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttcctgttgctgttttagaaggtgtccagtgtgaggtccagttggtgagtccggggagcctggtccagccgtgggggtccctgagactctcctgtgcagccctccggacttccccttcagtagttatggatgacgttggccncagactccgaggggagggctgggagtgggtggccaaacataaaagcaagatggaactggccgtagttttacgngtactcgtggtgaagggtccgtttcactatctccagacgacaacgccaaagaattcactgtactctaacaactgaacacgacctagacgagtcgactacgaacgaccggtaccgtagttaacttaccgtggtagacgaagtacgtaggtaaagggtaaaaaacgttagtagggtaccgttaggtttaggttttacgggtaacgggggtacccgtaagggggtaccgtcccggttacggggtaccctaccggtttccccg

SEQ ID NO: 411950 - DNA, 572 bp, Homo sapiens
  misc_feature: GZ8MTXP02JSSS7.17.28.C06.1.454.CMB.2.raw
  modified_base (373)..(373): a, c, t, g, unknown or other
  modified_base (502)..(502): a, c, t, g, unknown or other
  modified_base (558)..(558): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccggggaggcctggtccagccgtgggggtccctgagctctcctgtgcagcctccggattccccttcagtagttattggatgacttgggtccgccagactccagggagggctggagtggtgccaacataaagcaaagatgaactgccccgtagttttacgnggtactctggtgacggggcctttcaccgtatcgtacccgagacggacaaacgcccaaagtaattcactgtactctaacaactgaaccagtccagagagtcacgagtaccacggccgtgtattacctgtncgtagatggtacgaaaaagtatggtctgttagttaagtcggggtccagggggtacnccgtggtctacccg

SEQ ID NO: 411951 - DNA, 645 bp, Homo sapiens
  misc_feature: GZ8MTXP02JZZX9.17.28.C06.1.454.CMB.2.raw
  modified_base (258)..(258): a, c, t, g, unknown or other
  modified_base (278)..(278): a, c, t, g, unknown or other
  modified_base (383)..(383): a, c, t, g, unknown or other
tcagcgtagactagcacgaccggtgctcgatttagagctcacgtattggggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagcctggtccagccgtgggggtccctgagactctcctgtncagcctccggattccccttnagtagttatgatgactggtccgccagactccgagggaaggggctgggagtggggtgaccaacgataaaggcaaaggataggaactggccccggtagttttacggnggactgtgtggacggggtccgtttacaccatctacccgaagtacgacaaacgaccaaagtaacttacactagtactactaacaaactacaacgacgtacctaggagtacgtacgacgaagaccgtaccgggaccggttagttaacgttaaccgttggtacgacggaacggtagtagggtaaagggtaaaaaggtagtaggacgttaggtttaggtttaacggttcggggtaccgacggggtacgccgtcggtacctacccgg

SEQ ID NO: 411952 - DNA, 599 bp, Homo sapiens
  misc_feature: GZ8MTXP02I6H1P.17.28.C06.1.454.CMB.2.raw
  modified_base (274)..(274): a, c, t, g, unknown or other
  modified_base (300)..(300): a, c, t, g, unknown or other
  modified_base (373)..(373): a, c, t, g, unknown or other
  modified_base (471)..(471): a, c, t, g, unknown or other
tcagcgtagactagcacgaccggtgctcgatttagagctcacgtattggggtttggggaggtctcagagaggaggcttagccctggactccaaggcctttccacttggtgatcagcactgagcacagaggactcaccatggagttggggctgaactgggttttccttgttgctgttttagaaggtgtcagtgtgaggtcagttggtgaggtcggggagctggtccagccgtgggggtcctgagactctcctgtgcagcctccggattccccttnagtagttattggatgacttgggtccnccagactccgagggaaggggctggagtggggtggccaacataaagcaaagatggaactgcccgtagtttacgngactctgtgaggggtcctttcacatctccagacgacaaacgccaaagtaacttcaactagtatactaacaatacgaactagcctagacgtagtccganagaccacggccgtaggtacttactgtgacggagtagtacggtaaggaaaaaagttacgtcgggtacttaggttaggtttaacggtcggggtaccgaggggtactccccggtgggtacccttaacccgg

SEQ ID NO: 411953 - DNA, 605 bp, Homo sapiens
  misc_feature: GZ8MTXP02FK4LA.17.28.C06.1.454.CMB.2.raw
  modified_base (271)..(271): a, c, t, g, unknown or other
  modified_base (281)..(281): a, c, t, g, unknown or other
  modified_base (293)..(293): a, c, t, g, unknown or other
  modified_base (349)..(349): a, c, t, g, unknown or other
  modified_base (391)..(391): a, c, t, g, unknown or other
  modified_base (468)..(468): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgtttagaggtgtcagtgtgaggtcagttggttgaggtcgggggagctggtccagccgtgggggtcctggagctctctgtgcacgcctcggattcccctnagtgttatgntgacgtcggccncagacctcggagggaggggctggaggtgggtacgccaaacgaataaagacgaaagngtaggaactggaccccgttagttttacgaggtcttacgtggnggtacggtccgttacactactctaccgaagacacgaacgaccaaagaacttacaccgttatactacaaactaactanacagctagagagtacacgagtaccgacggtacgtagttactagtgagcggtaagtatagggtaaagtaaaacgtagtacgtcgttaggttgttaagggtccggggaacggtaggggacctccggtcggacctcccgg

SEQ ID NO: 411954 - DNA, 581 bp, Homo sapiens
  misc_feature: GZ8MTXP02I356U.17.28.C06.1.454.CMB.2.raw
  modified_base (279)..(279): a, c, t, g, unknown or other
  modified_base (302)..(302): a, c, t, g, unknown or other
  modified_base (333)..(333): a, c, t, g, unknown or other
  modified_base (375)..(375): a, c, t, g, unknown or other
  modified_base (387)..(387): a, c, t, g, unknown or other
  modified_base (517)..(517): a, c, t, g, unknown or other
tcagcgtagactagcacgaccggtgctcgatttagagctcacgtattgggtttggggaggtctcagagaggaggcttagccctgggactccaagggcctttccacttggtgatcagcactgagcacagaggactcaccatggagttggggctgaactgggttttccttgttgctgttttagaaggtgtccagtgtgaggtccagttggttgagtccgggggagcctggtccagcctgggggtccctgagactctcctgtgcagcctccggattcccctnagtagtattggatgacttggccncagactcagggagggctggagtggtgccaanataaagcaagatggaactgaccccgtagtttacggactctgngaggggcctttnaccatctcagagaacaacgaccaaagaattcaactgtaactctaacaactagaaactagcctagagacgtcgacagacacgggccgtgtaacttaccgtgtgccgaagataggtaaggaaaaagttacgngggtacttggtagtttaagtcgggggtacccaaggggtacgaccccgtaggtacctaaccccgg

SEQ ID NO: 411955 - DNA, 653 bp, Homo sapiens
  misc_feature: GZ8MTXP02FHSK4.17.28.C06.1.454.CMB.2.raw
  modified_base (191)..(191): a, c, t, g, unknown or other
  modified_base (255)..(255): a, c, t, g, unknown or other
  modified_base (418)..(418): a, c, t, g, unknown or other
  modified_base (502)..(502): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatgggagttggggctgaactgggttttcctgttgctgtttagaaggtgtccagtntgaggtccagttgtgagtcggggagctggtccagccgtgggggtccctgacgactctcctgtcncagccctccggattcccctcagtagttatggatgacgttgggtcccgccgagaccgtccgaggggaaacggggcgtaggggaggtggggtacggacccaaaacgaacgtaaagcgaaacggtagtacgggtaaacctcggtacccccgtagggtttttaccgngggtaccttcggtagtcgggtacggtcccgtttacaccctatcctaccgagtaacgaaccaaacggcccaaagtaacttcactntactactacactagaccagcctagacgacgtcgacgagaccgcggtacgtgtactacgtggtcgacgtagagtacggtaaagtaaaacgtgtacgtctggtttggttaaggtcggggaccgagggtcccgtccgttaacggcctaccccgg

SEQ ID NO: 411956 - DNA, 730 bp, Homo sapiens
  misc_feature: GZ8MTXP02I8MXN.17.28.C06.1.454.CMB.2.raw
  modified_base (188)..(188): a, c, t, g, unknown or other
  modified_base (209)..(209): a, c, t, g, unknown or other
  modified_base (241)..(241): a, c, t, g, unknown or other
  modified_base (264)..(264): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctnagtgtcgtcgggacccccggnaggaggtcaccatatcttgttcctaggaaacngctccgcatctacaaactaactnttttcgctgtaccagctaacttcccgaggtacctccccggccccctacttccctacacttactaataacgaacttgaacttaccgtaccgttccccgggtcccccgttaccccggggttcccctacggtacccccgttaccgttccgttcgtacgggtccttacccgtagtttcggttccgtacgggtccctaaccctttccgaccgtcccccgttacccgttacgaccctaacgttcgaacgggttccgggtcccgtttaccgggacccggtaggtaccgtgggtacgccgttaggttaactttacggttaccgtgttcggacgtaccgggttagggattcggaacttcgtccgtaggtacggtccggttacgggtcggttaccggggcggaacggacggcggttaccgtacggacccgttaacgtacgacgaccggaccgtaacggcccgttacccgtcccccg

SEQ ID NO: 411957 - DNA, 643 bp, Homo sapiens
  misc_feature: GZ8MTXP02FXLDB.17.28.C06.1.454.CMB.2.raw
  modified_base (274)..(274): a, c, t, g, unknown or other
  modified_base (286)..(286): a, c, t, g, unknown or other
  modified_base (298)..(298): a, c, t, g, unknown or other
  modified_base (371)..(371): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagctgtcagccgtgggggtccctgagactctcctatgcagcctccggacttccccttnagtagttatggntgacttggtccncagactccgagggagggctggagtgggtgccaacaagtaaagcaaagatggaactcgacccgtagttttacgnggtactcgtgtaggtacggggtccttacacctactctaccaagacgaaccaacgacccaaagtaacttaccaacgttagtacttactaaccaaacttacgaaaccgacgtacccgtagaacggtagttccgaccgaaacggacccgaccggggtaccgtagtttaaacgttctaggtcgacggtaagtagtaggtaaaggaaaaagtagtacggtagtggtttacgttaaggtcggggtacgaacggggcgtcccgtacggtcgtaaccccg

SEQ ID NO: 411958 - DNA, 645 bp, Homo sapiens
  misc_feature: GZ8MTXP02FZ9V4.17.28.C06.1.454.CMB.2.raw
  modified_base (212)..(212): a, c, t, g, unknown or other
  modified_base (274)..(274): a, c, t, g, unknown or other
  modified_base (633)..(633): a, c, t, g, unknown or other
tcagcgtagactagcacgaccggtgctcgatttagagctcacgtattgggtttggggagcttcagctgtggtagagaagacaggattcaggacaatctacagcatggccggcttccctctcctcctcaccctcctcactcactgtgcagggtcctgggcccagtctgtgctgactcacgccaccctcagtcgtccgtcggggacccccgggnaggacgggtccaccattattcttgttctaggaaacagcctccggcatctacaaactaacttnttttgctgacagactaactccgagactcccggcccccactcctcatctaataagaatgactcacgtccggtccccgtccgggtcctacgtaccgtacttcctcgtcgtcctcctattcggtcgtcggcctaccgtccgaccgtccctaccctcgaaccctagtccgacgggttccgggcccgttcccggggtaccgaggtacgtacgggaggtactaggttaatttacgttacgtcggtcggaccgttaaccgggtgggtactacgtactacgtcgaggtacgtcggggttaccggttcgggtcggacgggacggacgcggcgtaccggcctacgaacgtcgaacgaccgacggtcccncccgtaccgtcg

SEQ ID NO: 411959 - DNA, 584 bp, Homo sapiens
  misc_feature: GZ8MTXP02G2JHO.17.28.C06.1.454.CMB.2.raw
  modified_base (276)..(276): a, c, t, g, unknown or other
  modified_base (300)..(300): a, c, t, g, unknown or other
  modified_base (374)..(374): a, c, t, g, unknown or other
  modified_base (435)..(435): a, c, t, g, unknown or other
  modified_base (472)..(472): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaggtgtccagtgtgaggtccagttggttgagtccggggagcctggtccagcctgggggtccctgagactctcctgtgcagcctccggattccccttnagtagttattggatgacttggccnccagactcagggaaggggctggagtgggtggccaaacataaaagcaaagatggaaactgccccgtagtttacgnggactctgtgaggggcctttcacccatctaccaagagacaaacgccctaaagaattcactntactactaacaaactagaaacagcctagagagccganagacgacggactagtattagtgtagacgaagagtaggtaaaggaaaaagtagtacgtacttggttagtttaacggtcggggacgagggaccgtcccggtacggtacctaccg

SEQ ID NO: 411960 - DNA, 655 bp, Homo sapiens
  misc_feature: GZ8MTXP02F58KJ.17.28.C06.1.454.CMB.2.raw
  modified_base (307)..(307): a, c, t, g, unknown or other
  modified_base (352)..(352): a, c, t, g, unknown or other
  modified_base (591)..(591): a, c, t, g, unknown or other
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgcttgttttagaaggtgtccagtgtgaggtcaggttggtgaggtccggggagcctggtccagccgtgggggtccctgagactctctgtgcagccctccggacttccccttcagttagttatggatgacgttggcccncagactccgaggggaaggggcgtgggaggtggggtggacccaaanaagtaaaagcgaaagtagtaggaaactcgcccgtagttttacgcggtactcgtgtagacgggtcctttcacctatctaccagacgacaaacgtaccaagaacttacactagtacttactaactaacgttacgaacacgtacccgtagaacgtacggtacgacgacgaaccgtccggtaccgttgttaacgttacgtgtgacggtataaggttaggtaaaggaaaaagttagtacgggtnttaggttagtttaaggttacgggggccgtacggggtacgtcccggttcgggtacccttacccgg

SEQ ID NO: 411961 - DNA, 668 bp, Homo sapiens
  misc_feature: GZ8MTXP02FLOXD.17.28.C06.1.454.CMB.2.raw
  modified_base (275)..(275): a, c, t, g, unknown or other
  modified_base (299)..(299): a, c, t, g, unknown or other
  modified_base (325)..(325): a, c, t, g, unknown or other
  modified_base (332)..(332): a, c, t, g, unknown or other
  modified_base (365)..(365): a, c, t, g, unknown or other
  modified_base (464)..(464): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggtgagtcggggagcctggtccagcctgggggtcctgagactctcctgtgcagccctccggattccccttnagtagttatggatgacttggtccnccagctcgagggagggctggagtggngcaacanaaagcaagatggaactgccccgtagttttacgnggactctggtggacggggtccgtttacaccgtactcctaccagacgacaacgaccaagtaacttcactagtactactaacaactacgaaacagtacccnggaacgagtaccgaccgaaggaccgtaaccggggccgttaggtttaacttaaccgtggttggaaccgtaaggtaacgttagggtaaacggggaaaaaaagtttaccggttacggggtacttaggttttagggttttaacggtttacgggggggtaacccctaagggggaaccgtacccccggttgggttacccccgtaacccgg

SEQ ID NO: 411962 - DNA, 662 bp, Homo sapiens
  misc_feature: GZ8MTXP02JWRS8.17.28.C06.1.454.CMB.2.raw
  modified_base (273)..(273): a, c, t, g, unknown or other
  modified_base (297)..(297): a, c, t, g, unknown or other
  modified_base (329)..(329): a, c, t, g, unknown or other
  modified_base (360)..(360): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgtttagaaggtgtccagtgtgaggtcagttggtgaggtcggggagctggtccagccgtgggggtcctgagactctctgtgcacgccccgtattccccttnagttagttatggatgacttggccncagactcgagggaggctggagtcggtgccaanataagcaagagtagactgtacgtagtttcgngtactcgtggtacggaacgggtcctttaccactactcctaccgagaacgaacaaaccgaccaaagtacttcaactgtactaccgtaactaactacgaaactacgtacccgtagaacggtacgtacgacgacgggaacccgaccgggtcccggttagtttaacgttacgttcggtacgtacgaagtacggtagtaaaggggtaaaaaattaggtcggttaacgttaggtttaggtttaagggttaaccgggggacgtaaccggggtacgtacccgttacgggtccgttaaccccggtttcccg

SEQ ID NO: 411963 - DNA, 576 bp, Homo sapiens
  misc_feature: GZ8MTXP02FF2CY.17.28.C06.1.454.CMB.2.raw
  modified_base (211)..(211): a, c, t, g, unknown or other
  modified_base (362)..(362): a, c, t, g, unknown or other
  modified_base (366)..(366): a, c, t, g, unknown or other
  modified_base (439)..(439): a, c, t, g, unknown or other
  modified_base (448)..(448): a, c, t, g, unknown or other
  modified_base (476)..(476): a, c, t, g, unknown or other
tcagcgtagactagcacgaccggtgctcgatttagagctcacgtattgggtttgggggcagcttcagctgtggtagagaagacaggattcaggacaatctccagcatggccggcttccctctcctcctcaccctcctcactcactgtgcagggtcctgggcccagtctgtgctgactcagccaccctcagtgtcgtcggggacccccgggnaggacgggtcaccatattctgttctaggaaacagctccggcatcacaactaatattttcgctggtaccagacaacttccaggtactcccggaccccccgactcctcatctataagaatgactcacgtccgcccgtcgggtccctgaccctnttcnctcgctcatcgcgtcgccacctcacgccctcctacgacctactcgacggtcggcccgtaccgggccggtaggngttgacgtntacgtattacgtactggatccggtacgnggactacgactcgtctaggtacgtcggggttacgcgggttacgggcgggtacgacggacgcgtacgaccgtaacgagtccacggcgacgctccgtacccg

SEQ ID NO: 411964 - DNA, 654 bp, Homo sapiens
  misc_feature: GZ8MTXP02GN3C7.17.28.C06.1.454.CMB.2.raw
  modified_base (210)..(210): a, c, t, g, unknown or other
  modified_base (241)..(241): a, c, t, g, unknown or other
  modified_base (249)..(249): a, c, t, g, unknown or other
tcagcgtagactagcacgaccggtgctcgatttagagctcacgtattggggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtcgtcgggacccccggnaggagggtcaccatatcttgtctaggaaacngctccggnatctacaactaactattttgctaggtaccagactaacttccccgaggacctccccggccccccgactcctacactctaataagaaatgaactcacgtcccggaccccgtccggggtccctcgaccccgtacttctcgtcgcctcctattcgtcgtcggcctaccctcacgtcccctaccctagaccctaatccgtaggtcgggacccgttacccgggtaccggaaggtactgggacgtctaggtaactttagtacgtgtacgacgtaccggtaggtactacgactacgtccgtagtacgttcggggttacggttcggttacgggacgggtacgggtaccgacggtaccgtcgtaaccgtaacgtaacgtccgaccgacccgtacggtcccgtacccgtcccccgg

SEQ ID NO: 411965 - DNA, 653 bp, Homo sapiens
  misc_feature: GZ8MTXP02JGV68.17.28.C06.1.454.CMB.2.raw
  modified_base (214)..(214): a, c, t, g, unknown or other
  modified_base (253)..(253): a, c, t, g, unknown or other
  modified_base (443)..(443): a, c, t, g, unknown or other
  modified_base (466)..(466): a, c, t, g, unknown or other
  modified_base (525)..(525): a, c, t, g, unknown or other
tcagcgtagactagcacgaccggtgctcgatttagagctcacgtattgggtttggggcagcttcagctgtggtagagaagacaggattcaggacaatctccagcatggccgcttccctctcctcctcaccctcctcactcactgtgcgagggtcctgggcccagtctgtgctgactcacgcccaccctcagtcgtccgtccggggacccccggnaggacggtccacctattacttctttgttcgtaggaaacngtcccgtccggctacttcctaactaaaacgttaaactttgttttcgcgttacggtaccagacctaacttaccccgaggaccctccccggacccccctatcctacgactactaataagaacttgaactccgtacgtccccggacccggttccccggggcctagtaccccgtcttccgtcgtcgtccttccngttcgtactcggacctcccgtcncgtccccttccacgcctaacgtcgtcgggtcgggtccgtacgacgaggtacgtgacgtnttagtacttatgacgtcgaccgtaagcgaatcacgtctacgtagtacgtggttccgtgggaccgggacggagtacccgagccgtacggtacctaacgtacgcgaccgacgttacgcctaccccgtccg

SEQ ID NO: 411966 - DNA, 663 bp, Homo sapiens
  misc_feature: GZ8MTXP02HKKED.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgttttagaaggtgtccagtgtgaggtccagttggttgaggtcggggagctggtccagccgtgggggtccctgagctctcctgtgcagccctccggtacttccccttcagtagttattggatgtacgttgggcccgcacgacctccggaaggggaacggggtcgtgggaggtggggtcggacccaaacgaaataaaggacaaagagtaggaaacgtgaccccgttagtttacgtgtacttcgtgtacggtacgggtcctttacgacctactccgtaccagacgaaccaaccgaccaaagtaactctaactagttactactaacaacctagaaacacgtccgtaggagttcgaccgacgaagaccaccgggtccgttagtacgttacgtggtacgtagaaggtagtaggtaaaaggtaaaagttacgtggtacgttaggttagtttaacgggtcggggaccgtaggggaccgtccgtcggttaccgtccccg

SEQ ID NO: 411967 - DNA, 602 bp, Homo sapiens
  misc_feature: GZ8MTXP02HA8E7.17.28.C06.1.454.CMB.2.raw
  modified_base (236)..(236): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccggcagagggtcaccatatcttgttctggaaacngctccggcatctcaactaaacattttgtggtaccagcaattcccaggactccggccccccgatccctcatctatagaaatgactcatccggccctccggggtcccctgaccgtattcctctcggccttccattcgtctcggcacctcacgccctccctgaccatccagtgggctccgggtcccgaggatgagctcgattattactgttcgacaccggtgggaactcgactgtcccgtgtaacgtcgggtacccggttcgggttaccgggcggggtaacgggaccgtacgggtccgtacggacccggttccgtaaacggttcgaccggacccgtaacggcccgtttaccggaccccccgtttccggg

SEQ ID NO: 411968 - DNA, 623 bp, Homo sapiens
  misc_feature: GZ8MTXP02FXO6Z.17.28.C06.1.454.CMB.2.raw
  modified_base (391)..(391): a, c, t, g, unknown or other
  modified_base (479)..(479): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaacttgggttttccttgttgcttgttttagaaggtgtccagtgtgaggtccagttggttgaggtccggggaggcctggtccagccgtggggggtccctgagactctcctgtgcagccctccggtacttccccttcagttagttattggatgacgttgggtccgccagactccgaggggaaggggctgggaggtggggtcggaccaacaataaaagcaagatggaactgaccgtagtttttacgnggactcgtggtcgaagggtccttcacctatcctccagacgaccaaacgaccaaagtaattacactgtactacctaacaaactgaaacngacctagagacgtcgacacgacgaccggccgttagtattacgtgtgacgagtagtaggtaaaggtaaaaacgtagtaggtcgttaggttagtttacggtggggaccgtaggggacgtcccgttacggtcccgtaccgtttcccg

SEQ ID NO: 411969 - DNA, 597 bp, Homo sapiens
  misc_feature: GZ8MTXP02JB2HO.17.28.C06.1.454.CMB.2.raw
  modified_base (384)..(384): a, c, t, g, unknown or other
  modified_base (392)..(392): a, c, t, g, unknown or other
  modified_base (403)..(403): a, c, t, g, unknown or other
  modified_base (409)..(409): a, c, t, g, unknown or other
  modified_base (412)..(412): a, c, t, g, unknown or other
  modified_base (433)..(433): a, c, t, g, unknown or other
  modified_base (450)..(450): a, c, t, g, unknown or other
  modified_base (460)..(460): a, c, t, g, unknown or other
  modified_base (559)..(559): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggagcctggtccagccgtgggggtccctgagactctcctgtgcagccctccggattccccttcagttagttattggatgacttggggtccgcctagacctccgagggaggggctggagtgggtcggcaaacataaagcaagatggaactgccccgtagttttacgngactctgngagggtccttnacatcncanagacacgccaaagatcacgtntatactaacgaaactanaacggggacncccgtagacgtagtaccgacaagaccacggcgttacggttattacgtgtgcgaagtagtaggtaaggaaaaagtagtacggtcttggttgtttaacggngggggtaccgaggggacgcccggttaggaccgtacccg

SEQ ID NO: 411970 - DNA, 686 bp, Homo sapiens
  misc_feature: GZ8MTXP02FLG6V.17.28.C06.1.454.CMB.2.raw
  modified_base (209)..(209): a, c, t, g, unknown or other
  modified_base (241)..(241): a, c, t, g, unknown or other
  modified_base (249)..(249): a, c, t, g, unknown or other
  modified_base (265)..(265): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcacgccaccctcagtgtcgtcggggacccccggnaggagggtccacatatcttgttctaggaaacngctccggnatctacaactaaactnttttgctggtaccagcaattcccaggactccggcccccgactcctcatactaatagaaatgatcactccgggcccgttcccggggtcctcgaccgtacttccgtctcggctcattcgtctcggctaccctcgaccgtcctccctacgaccatcgacggtcgggccgttcccggggtaccgaggtagtacggacggtctagtaagtttacgttacgtcggtcgtacccggtacgggtacgggtaactacggtaactacgttacccgtaggtaacggttcggggttacccgggttggggttaccgggggacgggggtaacgggtaacccgacggggtccgtaacccgggtacccgttaccggtaaacggttacccggaaccggaccccgaacggggtcccctacccgggccccccgtttacgg

SEQ ID NO: 411971 - DNA, 628 bp, Homo sapiens
  misc_feature: GZ8MTXP02FRSFO.17.28.C06.1.454.CMB.2.raw
  modified_base (307)..(307): a, c, t, g, unknown or other
  modified_base (350)..(350): a, c, t, g, unknown or other
  modified_base (396)..(396): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactggttttccttgttgcttgtttagagtgtcagtgtgagtccagttggtgaggtccggggagctggtccagccgtgggggtccctgacgactctcctgtgcacgccctccggactttccccttcgtagttagttattggatgtacgttcggtccncctacgactccggagggaagggctggaggtggtcggaccaaanaataaacgacaaagggggaataggaactcgacccgttagtttacgngactcgtaggtcggtacggtccttacgaccatctaccagacgacaacgacaagtaactacgactagtactactaacaacgtacgaacgacgtctagacgagtcgaacgacgtaccgacggtaccgttagttacttacgtagtgacgtagtagtaggtaaaggaaaacgttaggagtacgttagtttagttaacggtacgggtacgacggggtccgacgtcggtaccctaccg

SEQ ID NO: 411972 - DNA, 748 bp, Homo sapiens
  misc_feature: GZ8MTXP02HKY4E.17.28.C06.1.454.CMB.2.raw
  modified_base (186)..(186): a, c, t, g, unknown or other
  modified_base (207)..(207): a, c, t, g, unknown or other
  modified_base (245)..(245): a, c, t, g, unknown or other
  modified_base (349)..(349): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctnagtgtctcggggacccccggnagagggtcaccatatcttgttctggaaacagctccggnatctacaaactaaactattttgctggtaccagctaattcccaaggctcccggccccccgtatccctcatctaataagaaatgatcagtccgccctccgggtccngaccacttctcgtcgcctcagttcgtcgtcgcctaccctcaccgtccctacccgttcgaaccctacgtaccgaacgggttcgggacccgttcccggggtacccgaagggtacgttacggaagggtccttaggttaaactttacgttaaccgttggttacgaccggtaacccggggttagggaacgttacggtaacctacgttacccgtaggttaaaccggttcggggttaccccggggtttggtttacccgggggtacggggtaacccggggaaacccggtaaccgggtacccggttaccggtaaccccggtttaacccggttaaaccggtacccggtaaaccgggtacccccgaaaacggggtcccctcccccgggtaccccccggtttaaccccggg

SEQ ID NO: 411973 - DNA, 674 bp, Homo sapiens
  misc_feature: GZ8MTXP02ICG7A.17.28.C06.1.454.CMB.2.raw
  modified_base (282)..(282): a, c, t, g, unknown or other
  modified_base (314)..(314): a, c, t, g, unknown or other
  modified_base (403)..(403): a, c, t, g, unknown or other
  modified_base (432)..(432): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttctgttgctgttttagaaggtgtccagtgtgaggtccaggttggttgaggtccgggggagcctggtccagccgtgggggtccctgacgactctcctgtgcacgcctccggtacttccccttnagtagttagttggactggtacttcggggtccnccgagcctcgaggggaaggggcgtggaggtggggtgaacgaacaagtaaagagaaagagtaggtaacctggaccccgtagttttacggngtactgtggtaggtacgggtcccgttttnaacctactcctaccgaagacgaaccctaaacgacccgaaagaactttacgactagttaatactaacaactagaacagccttaggacgtagtccgacaacggacgacggtccgtagttatacgttgcgacgtaagtaggttagtaaagggtaaaaacgttagtacggtacgtttggtttacggttttaagggttcggggaacccggaggggaaccgtacccccgttgggtaccccgtacccgg

SEQ ID NO: 411974 - DNA, 826 bp, Homo sapiens
  misc_feature: GZ8MTXP02F0J9B.17.28.C06.1.454.CMB.2.raw
  modified_base (211)..(211): a, c, t, g, unknown or other
  modified_base (243)..(243): a, c, t, g, unknown or other
  modified_base (536)..(536): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcacgcccacctcagtgtccgtcggggacccccggnaggacggtcaccatatcttgttctaggaaacngtcctcggctatcactaaacgttaacttattttcgcgtacggtaccagtacctaacgttcccgaaggtccgtaccccggccccctacctccgtactactactaacgtaagaaacgtcgtactaccgaccggttccccggccccggttaccggggtaccctcggtaacccccttacgtttcccgtacgttccggtactaccgtagttccggtccggtaccggtacctacccgtcccgacctccccgtacctaccgacctacgtcgacggttccggtacgtacccgggtaccggngggtacgtacggtacggtcgttagttactttacgttcgtaggttaccggacccgttaaggggtacggtacgtacgtaaccgttaccgttaccggtaaacggttacggggtttcggggtttaccggggttccgggggtttacccgggggaaacgggggaccgggtaaaacccggggtcgggttaaccccgggtcccggtttaacccggtttaaaccggaacccgggttaccggaaccccgggtacccccggtaaacgggggttcccccctaacccggttttaccccccggg

SEQ ID NO: 411975 - DNA, 608 bp, Homo sapiens
  misc_feature: GZ8MTXP02G5YED.17.28.C06.1.454.CMB.2.raw
  modified_base (188)..(188): a, c, t, g, unknown or other
  modified_base (207)..(207): a, c, t, g, unknown or other
  modified_base (235)..(235): a, c, t, g, unknown or other
  modified_base (242)..(242): a, c, t, g, unknown or other
  modified_base (463)..(463): a, c, t, g, unknown or other
  modified_base (481)..(481): a, c, t, g, unknown or other
tcagcgtagactagcacgaccggtgctcgatttagagctcacgtattggggtttggggcagcttcagctgtggtagagaagacaggattcaggacaatctccagcatggccggcttccctctcctcctcaccctcctcactcactgtgcagggtcctgggcccagtctgtgctgactcagccaccctnagtgtctcgggaccccggnagaggtcacatatcttgtctaggaaacngctcggnatctacaaactaaactattttgctaggtaccagcaacttcccaggacgtcccggaccccccgactcctcacttactaataagaaaatgaatcaactccggcccgtccggggtcctgacccgtattctctcgctccatcgctggcaccgtcacgccctccctgacccatcgacggtggccgtccggtacccgaggacgtggagcttagtatttattacgtgngtaccgaacgtgggtaancgactacttcgtagtacgttcgggttacggtcgggttacgggacgggaacgggtaaccgacggaccgtacgtaacccgtaaccgtaacggtaccgaccgacccgtacggtaccgtcccgtacccccg

SEQ ID NO: 411976 - DNA, 585 bp, Homo sapiens
  misc_feature: GZ8MTXP02INEHI.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggagcctggtccagcctgggggtccctgagactctcctgtgcagccctccggattcccccttcagtagttattggatgacttgggtccgcagactccgagggaggggctggagtggggtggaccaacataaagcaaagatggaaactgcccgtagtttacgtggactcgtgtgaggggtcctttcacctatcctcagagacaacgccaagaatcactagtatctacaactagaacagcctagagagtcgcagacacggcgtgtattacgtgtgtcgagataggtaaggtaaaaagtagtaggtacttggtttacggtttaaggttgggggtacccgtagggggacgtcccggttgggtccgtacccgg

SEQ ID NO: 411977 - DNA, 626 bp, Homo sapiens
  misc_feature: GZ8MTXP02G20FZ.17.28.C06.1.454.CMB.2.raw
  modified_base (209)..(209): a, c, t, g, unknown or other
  modified_base (267)..(267): a, c, t, g, unknown or other
  modified_base (384)..(384): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtcgtcgggacccccggnaggaggtccaccatatcttgttctaggaaacagcctccggcatctacaaactaaactnttttgctaggtaccagctaaacttccccgaggacctccccggccccccgtactcctactatactaataagtaaatgactcacgtcccggccccgttcccggggtcctcgaccccgtnttctctcggtcctcctatcggtctacggcctaccgtcgacgtccctccctacgacctacgttcgacgggtcggtcccgtccgggtccgaaggtgtggacgtctagtatttacgtgtgtacgcggtaccgtggacttcgactcgtcgtagacgtcgggttccggtcggtcggggacggacggaacgcggtacgtccggaacgtccgttaaacgccgacggaccgacgtccctacccgtccccg

SEQ ID NO: 411978 - DNA, 720 bp, Homo sapiens
  misc_feature: GZ8MTXP02IREXO.17.28.C06.1.454.CMB.2.raw
  modified_base (214)..(214): a, c, t, g, unknown or other
  modified_base (248)..(248): a, c, t, g, unknown or other
tcagcgtagactagcacgaccggtgctcgatttagagctcacgtattgggtttggggagcttcagctgtggtagagaagacaggattcaggacaatctccagcatggccggcttcccctctccctcctcaccctcctcactcactgtgcagggtcctgggcccagtctgtgctgactcacgcccaccctcagtcgtccgtcggggacccccggnaggacgggtcaccatattcttgttctaggaaacngcctccggcactctacaaactaaactattttgctgtacagtcaactcccgagtcgtcccgcccccgtactcctactactactaataagaatgactacgtacgtccggcccgtcccgggtcctcgaccgtacttcctcgtcgtcctctagttcgtcgtcggtcccaccgtcctaccgtcccttcccgtacgaccctagtcgtacggtccggggtcccgttacccggtacggacggtacgtacgggacgtcgtaagttacttacgtttacgtacggttccgaccggttacgggtaaggtcgtacgtactacgttccgtaaggttaacgggttcgggttcccgggtttacgggtaccggggaccgggggtaaccgggtaccggtacggtcccgttaccggtaaccccgttaaccgtaaacggtccgaacccggtaccccgtaacggtaccccgtccccggtacccccgtttccgg

SEQ ID NO: 411979 - DNA, 629 bp, Homo sapiens
  misc_feature: GZ8MTXP02F2AO7.17.28.C06.1.454.CMB.2.raw
  modified_base (274)..(274): a, c, t, g, unknown or other
  modified_base (297)..(297): a, c, t, g, unknown or other
  modified_base (334)..(334): a, c, t, g, unknown or other
  modified_base (371)..(371): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgtttagaaggtgtccagtgtgaggtccagttggtgagtccggggagcctggtccagccgtgggggtccctgagactctcctgtgcagcctcggattcccctnagtagtatggatgacttggtccncagactccgagggagggctggagtgggtggaccaaanataaaagcaaagatggaaatgacccgtagttttacgngtactgtgagacgggtccttacactactctacgagacgacaacgacaagtaactacactagtactactaacaactacgaacacgacgtagaacgtacgtacgacgaacgaaccgaccgggtacgttagttaacgttagtacggtacggacggtaaggtagttaaggtaaaaggtaaaaagttagtacggtacgttaggtttaggtttaaggtacgggggaccggtacggggtaccgtcccggtacggtacccgtaccg

SEQ ID NO: 411980 - DNA, 756 bp, Homo sapiens
  misc_feature: GZ8MTXP02JQ3MY.17.28.C06.1.454.CMB.2.raw
  modified_base (254)..(254): a, c, t, g, unknown or other
  modified_base (307)..(307): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgttttagaaggtgtccagtgtgaggtccagttggtgaggtcggggagctgtcagccgtgggggtcctgagactctcctgtncacgcctccggtacttcccctgagttagttattggatgtacgttcgggtcccnccgagaccgtccggaggggaaggggtcgtgggaggtggggtacggacccaaaacgtaagtaaaacggcgaaaaggacgttacgggaaacgttcgaccccccgggtttaaggtttttaccggtacgggtaaccttcggttagggtacggtaacgggggttccctttaccgaaccctattccctaccgaagaacgaccgaaaccgaccgaaagtaaattcgacttagtactacctaaacaactacgaaactacggacctaggaacgtacgtaccgacgaaccggaaccgtaccgggtcccgttaaggtttaacgttaaccgttggtacgtaaccggtaaggtacgttaaaggggtaaacggtaaaaaaggttagtaccgggtacgtttaggtttagtttaagggtcggggtaccgtaacggggtccgtacccggtcggtaaccgttccccg

SEQ ID NO: 411981 - DNA, 742 bp, Homo sapiens
  misc_feature: GZ8MTXP02H6P7J.17.28.C06.1.454.CMB.2.raw
  modified_base (209)..(209): a, c, t, g, unknown or other
  modified_base (241)..(241): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtcgtcggggacccccgggnaggaggtcaccagtactcttgttctggaaacngctccggcatctacaaactaactattttgctgtacagcaattccaggctcccggccccccgactcctcactctaagtacgaaaatgatccacgtcccggccccgtaccggggtccctacgaccgttacctttccgtcgtcggtccttacgtacgttcgtcgtcgggaccctaacccttccgacccgtccccgtccccgtacgtaaccctaagtcccgtaacgggttcggggcccgttccccgggtacgaacgggtacgtagggacggtccttaggttaactttaacttaccgtcggttaacgcccgtaccggggtaggtactacgtaaccgtgttacccgtaggttaacggttccggggttacccgggttcgggttaccggggccgggaaacgggggtacccgtacggggtaccgtaacccggtacccggtttaaaccgaacggttacccggaaaccgtacccccgtaagggtccccttacccggccccccggtttaccgg

SEQ ID NO: 411982 - DNA, 620 bp, Homo sapiens
  misc_feature: GZ8MTXP02IN1A7.17.28.C06.1.454.CMB.2.raw
  modified_base (216)..(216): a, c, t, g, unknown or other
  modified_base (229)..(229): a, c, t, g, unknown or other
  modified_base (241)..(241): a, c, t, g, unknown or other
  modified_base (268)..(268): a, c, t, g, unknown or other
  modified_base (368)..(368): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgtttagagtgtcagtgtgagtcagttggtgagtcggggagctgcngcgtgggggtccngagactctctgncagcctccggacttccctcagtagttntggatgtacttggccgaccacgacgtccgaggggaaggggcgtggaggtgggtcggaccaaacaagtaaagcaagaagtggaactggccgtagtttacgngtactcgtgtgacggggttccttacgacctctacctcgaagacgaacaaccgacgaaagtacttactaacctagtactacctaactaaccagtaacagacctaggacgtagacgacgagaaccgaccgggtacgtacggttacttaaccgttggtagcgtaacgtagtggtaaaaggtaaaaagttagtacgggtcttaggttaggtttaacggtcggggtacgacgggtacgacccgtggttccgtacccg

SEQ ID NO: 411983 - DNA, 794 bp, Homo sapiens
  misc_feature: GZ8MTXP02H16XD.17.28.C06.1.454.CMB.2.raw
  modified_base (214)..(214): a, c, t, g, unknown or other
  modified_base (251)..(251): a, c, t, g, unknown or other
  modified_base (280)..(280): a, c, t, g, unknown or other
  modified_base (468)..(468): a, c, t, g, unknown or other
  modified_base (479)..(479): a, c, t, g, unknown or other
  modified_base (607)..(607): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgacctcacgccaccctcagtcgtccggtccggggaccccggnaggacgggtccaccatacttcttgttcgtaggaaacngctccggctagtcctactaactaaacttnttttcgcgtacggtaccagactaacttcccgacggcgtacccccggacccccgactcctacataccttaagaacgtaatgactccgtacggtcccggaccccggttaccggggtccctacggtaccccttacttccgtcgttcgcccgttacctgttcgttacgtcggtaccctaccgtaccgtcccncccgttacccncgtaaaccctcggtaccgggtacggttcccggggcccgttaccggggtaacgggaccgttaggaacgggtcgttcgttaaactttacgtttacgttcgggtttcgaacccggtagggttaacccgggngttaacgtaaccgttactacggtttcccgggtaaaggtacgggtttcccgggttaccggggtaacgggggttcccgggggaacgggacgggtaccccggtggtaccgttaccccggtaccggttaaaaccgtcgtaaaacccggcccgggggtaaaactcccggggtccccgtttaccccggccccg

SEQ ID NO: 411984 - DNA, 698 bp, Homo sapiens
  misc_feature: GZ8MTXP02GYS48.17.28.C06.1.454.CMB.2.raw
  modified_base (188)..(188): a, c, t, g, unknown or other
  modified_base (209)..(209): a, c, t, g, unknown or other
  modified_base (239)..(239): a, c, t, g, unknown or other
  modified_base (245)..(245): a, c, t, g, unknown or other
  modified_base (258)..(258): a, c, t, g, unknown or other
  modified_base (271)..(271): a, c, t, g, unknown or other
  modified_base (283)..(283): a, c, t, g, unknown or other
  modified_base (363)..(363): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctnagtgtcgtcgggacccccggnagaggtcacctatatcttgttctggaaacngctcgnatcacaactaatntttgctgtaccanctaatccgagcnccggcccccatcctcatctaatagaaatgacttcagtcccggccctccggggtccctgaccccgtattctctcgctaccnttcggtctacggccctaccgtctaccgtccctacccgtcacctactcgagggtcggtcccgtcccggtacggaggtacagggacgtcttagtaatttagttaaccgttgcgttaccgtaacgggtaggtacttccgaacgtacgtttaccgtaacggttaacggttcccgggggtttaacgggtttcgggttaaccgggggtaccgggggtaacccggggaaaccgttcgggggtaccggttaccggttaaaacccgggttcccggtaaaaggtttcccgaaaaccggggacccccggtaacggtcccccggtaaccccggtttacccccccggg

SEQ ID NO: 411985 - DNA, 559 bp, Homo sapiens
  misc_feature: GZ8MTXP02IFUT4.17.28.C06.1.454.CMB.2.raw
  modified_base (307)..(307): a, c, t, g, unknown or other
  modified_base (379)..(379): a, c, t, g, unknown or other
  modified_base (411)..(411): a, c, t, g, unknown or other
  modified_base (454)..(454): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtgggggtccctgagactctcctgtgcagccctccggattccccttcagtagttattggatgacttgggtccnccagactccagggaggggctggagtgggtggaccaacataaagcaaagatggaactgcccgtagttttacgnggactctgtgagggtccttcaccatctcaganacaacgccaagaatcactgtatctacaactgaacagcctgagngtcgcagaccaggccgtgtacttctgtgcgagatgaaggtaaaaagtagtggacttggttagtttaagtcgggggacctaggggacgtccgtaggtccgtacccg

SEQ ID NO: 411986 - DNA, 782 bp, Homo sapiens
  misc_feature: GZ8MTXP02JURIQ.17.28.C06.1.454.CMB.2.raw
  modified_base (239)..(239): a, c, t, g, unknown or other
  modified_base (252)..(252): a, c, t, g, unknown or other
  modified_base (275)..(275): a, c, t, g, unknown or other
  modified_base (676)..(676): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactggttttccttgttgcttgttttagaggtgtccagtgtgagtcagttggtgaggtcggggagcctgtccgagccgtgggggtccngagactctcctgngcacgcctccgtacttccccttnagttagttatggatgtacgttcgggcccgacgagaccgtccggaaggggaacggggcgtagggtaggtggggtacggacccgaaaacgtaaagtaaaacggacgtaaaggaagttaacggggaaaccgttacggtaacccccgggtttacggtttttaacgggtacggtaaccgtttcggttagggttacggggttaaccgggggtttcccccttttaaccgaacccccgttacttacccgttaaccggaaacgggtaaaccgaaacccgaaaacccgtaacccgtaaaagttaaaccttccgtaaacgttcgtaaactacccgtaaactaaaactcgaaaaccgacgtccgtaagacgtacgtacgacgaacgaccgtacggtcgttagttaacttcggngtacgagtacgtaggtaaggtaaaaggtaaacgttgtcggttacgttaggtttaggttaacgggacgggtacggtacgggtccgtaccggttcgtacccgtacccg

SEQ ID NO: 411987 - DNA, 683 bp, Homo sapiens
  misc_feature: GZ8MTXP02G00JF.17.28.C06.1.454.CMB.2.raw
  modified_base (243)..(243): a, c, t, g, unknown or other
  modified_base (279)..(279): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaggtgtccagtgtgaggtcagttggttgaggtccgggggagccgtggtccagccgtgggggtccngagactctcctgtgcacgcctccggtacttcccctnagtagttatggatgacgttcggtccgacagaccgtccggaaggggaggggcgtggagggtcggtcggaccaaacgtaaataaaggcaaaggtactaggaaaccgtcgtaccccggttaggttttacgtcgtaccgtcggtagttacggtacgggggtccctttacacctagtccctaccgaagaccgtaaccaaccgtaccgtaaaagtacttaccagttagtaactactaaccgtaactacgaacgtagccgtaagaggtacgcgacaacgacaccggtcgttataacgtcgagtcgacgtaaagtcggtaggttaaaacggaaaaaggttagtcgggttaacttgggtttaagtttcggggtacgggacggtaacggtcgtacccggttggtaccctcccgg

SEQ ID NO: 411988 - DNA, 654 bp, Homo sapiens
  misc_feature: GZ8MTXP02IWK1J.17.28.C06.1.454.CMB.2.raw
  modified_base (243)..(243): a, c, t, g, unknown or other
  modified_base (252)..(252): a, c, t, g, unknown or other
  modified_base (267)..(267): a, c, t, g, unknown or other
  modified_base (282)..(282): a, c, t, g, unknown or other
tcagcgtagactagcacgaccggtgctcgatttagagctcacgtattgggtttggggcagcttcagctgtggtagagaagacaggattcaggacaatctccggcatggccggcttccctctcctcctcaccctcctcactcactgtgcagggtcctgggcccagtctgtgctgactcacgccaccctcagtcgtcgtcggggacccccggaggacgggtcaccatatcttgttctaggaaacngcctccggnatctacaactaactnttttcgctggtaccngcaacttcccaggacctcccggaccccccgtactccctacatctaataacgaaatgacttcgacgtccggaccccgttcccggggtcctacggaccctactttccgtcgtcggcctctacgttcgtccgtcggccctaccctccgtaccgccctccctacgaccctagtccgacgggtcggtcctcccgggacgaggtactaggacgtctagttacttacgttacgtcggtgaccgtacggggtggatcgaccttgtaccgtaggtacgtcggttacccggttgggtaccgggcgggtacggacgtacggtccgtacgtaccgtaccgtaacgccgtaacgacccgtacggtccctccggtacccccttcgg

SEQ ID NO: 411989 - DNA, 608 bp, Homo sapiens
  misc_feature: GZ8MTXP02HOIKP.17.28.C06.1.454.CMB.2.raw
  modified_base (273)..(273): a, c, t, g, unknown or other
  modified_base (304)..(304): a, c, t, g, unknown or other
  modified_base (348)..(348): a, c, t, g, unknown or other
  modified_base (392)..(392): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgcttgttttagaaggtgtccagtgtgaggtccagttgtgaggtccggggagcctggtccagcgtggggggtccctgagactctcctgtgcagcctccggacttccctnagttagttattgggatgacgttggggtcccnccagactccgaagggggaggggctgggagtgggtcggaccaaanaataaaagcaaaggatagggaaactggaccgtaagtttttacgngtactctggttaggaacgggtccgtttcactctacctacagactaccaaaccgccaaataattcacttgtactacaactaaactgaaacacgactaggagtacgtcgacaggaccacggccgtagtattacgtgtacgcgagtagtagtaaaggaaaacgtagtaggtcgtagttacgttaggtcggtcggaagggtcaccgtggtaccacgtccc

SEQ ID NO: 411990 - DNA, 763 bp, Homo sapiens
  misc_feature: GZ8MTXP02HUL0Y.17.28.C06.1.454.CMB.2.raw
  modified_base (220)..(220): a, c, t, g, unknown or other
  modified_base (229)..(229): a, c, t, g, unknown or other
  modified_base (277)..(277): a, c, t, g, unknown or other
  modified_base (333)..(333): a, c, t, g, unknown or other
  modified_base (417)..(417): a, c, t, g, unknown or other
tcagcgtagactagcacgaccggtgctcgatttagagctcacgtattggggtttggggagggtctcagagaggaggcttagccctggactccaaggcctttccacttggtgatcagcactgagcacagaggactcaccatggagttggggctgaacttgggttttccttgttgctgttttagaaggtgtccagtgtgaggtcagttggtgaggtcggggngcctggtcngccgtgggggtcctgagtactctctgtgcagccctcggtcttcccctnagtgttatggatgtacgttgggtccgaccagtacctcggaaggggaagggggtcgnggggaggtggggtcggacccaaacgaagtaaacggcgaaaaggagttaaggaaccgtcggtaccccggtagttttttaccgggnggtacctttcggtaggttacggggtacgggggttcccgtttacgaaccctacgtttacccgacccgtaaaggaccgaaacccgaaaccgaaccctaaagttaacttaccacgtttacgtaattaccctaaactaaaccgttgaaaacgtcgtaccgtacggagtaggtcccgacgacgaccggccggtacgttacgttatttaccgtgtcggaacgtacgaaggtttaggtaaaagggtaaaacggttaaggtcgggttacgtttagggttaggtttttaacgggtcgggggtaaccccgtagggggttacccgggtccccgtttacggggttaacccctccccgg

SEQ ID NO: 411991 - DNA, 596 bp, Homo sapiens
  misc_feature: GZ8MTXP02IF28N.17.28.C06.1.454.CMB.2.raw
  modified_base (252)..(252): a, c, t, g, unknown or other
  modified_base (299)..(299): a, c, t, g, unknown or other
  modified_base (378)..(378): a, c, t, g, unknown or other
  modified_base (483)..(483): a, c, t, g, unknown or other
  modified_base (563)..(563): a, c, t, g, unknown or other
tcagcgtagactagcacgaccggtgctcgatttagagctcacgtattggggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccaggttggtgaggtcggggagctgtccagcgtgggggtcctgagctctcctgncagcctccggattccccttgagtagttattggatggacttcggtccncagacctcgaggggagggtctggaggtgggtggacccaagaataaagcaaagactaggaactgcccgtagtttttaggngtaccgtatggagtacggggtccctttacaccctatcctccgaagactaacgacacctaaagattcgaatagtactacaacgaactgaatacgctagagagtcanacgcgtaacgcgtgtaacttgagtccgagtagtagtggtaaagtaaaagtagtccggatttgtaggttttaacccggggnggaacgtacggtaccgtccgtacgtccgtaacg

SEQ ID NO: 411992 - DNA, 604 bp, Homo sapiens
  misc_feature: GZ8MTXP02F23EU.17.28.C06.1.454.CMB.2.raw
  modified_base (277)..(277): a, c, t, g, unknown or other
  modified_base (302)..(302): a, c, t, g, unknown or other
  modified_base (366)..(366): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtcggggagcctggtccagccgtgggggtccctgagctctcctgtgcagcctccggacttccccttnagtagttatggatgacttgggtccncagactcgagggagggctggagtggtgccaacataaagcaagatggactgcccgtagtttacgnggactcgtgtgaggggtcctttcgacctatctaccagacgaacaacgccaaagaattcaacttgtactctaacaactacgaaacacgacctagaagagttaccgacgaagaacccgacgggtccgttagttacttacgtgtcgacgtagtagttggtaaaggtaaaaagttagtcggtacgttggtttagtttaaggttcgggggaccaagggggtactcccgtggtaccctacccgg

SEQ ID NO: 411993 - DNA, 715 bp, Homo sapiens
  misc_feature: GZ8MTXP02G0TGU.17.28.C06.1.454.CMB.2.raw
  modified_base (211)..(211): a, c, t, g, unknown or other
  modified_base (244)..(244): a, c, t, g, unknown or other
  modified_base (253)..(253): a, c, t, g, unknown or other
  modified_base (271)..(271): a, c, t, g, unknown or other
  modified_base (523)..(523): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctcgggcccagtctgtgctgactcagcccaccctcagtgtcgtccggggacccccggnagacgggtcaccatatcttgttcgtaggaaacncgcctccgnactctacaactaaaactnttttgcttacggtaccagtactaaacttcccgaacggtaccgtccccggacccccccgacttcccctactacttaacctaagtaaaacgtaaacttcgaacttcccgtaaccggtccccggggttccccccggtccccggggtacccttaccggtaacccgtcctttccgtccgtcgggaccctttacccgagttcgttccgtccggaccctaccctccgacccgtccccttacccgcgaacctctaccggngtccgggtccgtacccgggtcgaacggtgtagtccggtatagttaatttcgttacgtcgtcggtccggacggtagtacgtcgactcgtaccgtgtaagtcgggtcggttacggtacggggcggacggtacggcggtctacggtccgttacgaaccgtcgaaccgtccgacggtccctccgggtaccctccgg

SEQ ID NO: 411994 - DNA, 638 bp, Homo sapiens
  misc_feature: GZ8MTXP02FOZNL.17.28.C06.1.454.CMB.2.raw
  modified_base (277)..(277): a, c, t, g, unknown or other
  modified_base (393)..(393): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgttttagaaggtgtccagtgtgaggtcagttggtgagtcggggagctggtccagccgtgggggtccctgagactctcctgtgcagccctccggacttccccttnagtagttatggatgacgttgggtccgccagactccggaggggaggggctgggaggtggggtcggaccaaagaagtaaagcaaaggataggaactggaccccgttagtttttacggnggtacttcgtggtagggacggggtcctttacacctatcctacagacaacaacgaccaaagtacttacaacttagtactactaactaactacgaacagtccgagagacgtcgacagaccgacggtcgtagttactacgtagtcgagtagtagtaggtaaaggtaaaaacgtagtaggtacgttaggtttaggtttaacgggttcgggggacggtacggggtaccgtccggtacggtaccgtacccg

SEQ ID NO: 411995 - DNA, 606 bp, Homo sapiens
  misc_feature: GZ8MTXP02JUXLY.17.28.C06.1.454.CMB.2.raw
  modified_base (273)..(273): a, c, t, g, unknown or other
  modified_base (297)..(297): a, c, t, g, unknown or other
  modified_base (369)..(369): a, c, t, g, unknown or other
  modified_base (409)..(409): a, c, t, g, unknown or other
  modified_base (503)..(503): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggagcctggtccagcctggggggtccctgagactctcctgtgcagcctccggattcccctnagtagttatggatgacttggtccncagactccgagggaagggctggagtgggtagcaacataagcaagactaggaactggaccgtacgttttacgngacctgtgtagaacgggtccgtttcacgtacgtctaccgngaacgaccacgaccaaagacttacacctgtatctaacactagacacggtaccagacggtacgcgacgagacgaaccgtccggtagtaaacttcnggtcgagatagtagtaggtaaaaacgtgtaggtaccttggttagtttaacggttcgggggacgtaacgggggtacgtacccggttacggcgtacccggttccg

SEQ ID NO: 411996 - DNA, 705 bp, Homo sapiens
  misc_feature: GZ8MTXP02IT5QK.17.28.C06.1.454.CMB.2.raw
  modified_base (262)..(262): a, c, t, g, unknown or other
  modified_base (280)..(280): a, c, t, g, unknown or other
  modified_base (288)..(288): a, c, t, g, unknown or other
  modified_base (292)..(292): a, c, t, g, unknown or other
  modified_base (397)..(397): a, c, t, g, unknown or other
  modified_base (478)..(478): a, c, t, g, unknown or other
tcagcgtagactagcacgaccggtgctcgatttagagctcacgtattgggtttgggggaggtctcagagaggaggcttagccctggactccaaggcctttccacttggtgatcagcactgagcacagaggactcaccatggagttggggctgaactgggttttccttgttgctgttttagaaggtgtccagtgtgaggtccagttggttgaggtccgggggagcctggtccagccgtgggggtccctgagactctctgtgcngcctccggacttcccctnagtagttntggntgacgttggtcccgcacgacctccggaaggggaggggcgtgggaggtggggtagaccaacaagtaaagcaaagacgtaggaaactgacccgttaaggttttacgnggtacttctggtacggtacggggtcccgtttcaacctactcctacgagaacgaacaacgacccaaagtaacttcaacgttntactactaacaactagaacacgtccgtaggacgtagtcgacgaacggacccgtaccggtaccgttgttaaacgtttccgtggtacggacggtaagtaagttagggtaaaacgggtaaaaaaggttaagttaccggggtatttggggtttaaggttttaaggggttaccgggggaaccgtaacggggggtacccgtcccgggtttacggggtaccctttaaccccggg

SEQ ID NO: 411997 - DNA, 675 bp, Homo sapiens
  misc_feature: GZ8MTXP02IFV01.17.28.C06.1.454.CMB.2.raw
  modified_base (208)..(208): a, c, t, g, unknown or other
  modified_base (619)..(619): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagcccaccctcagtgtcgtcgggaccccggnagaggtcaccatatcttgtctaggaaacagctcggcatctacaaactaaacttattttcgcttggtaaccagacctaaacgttcccaaggtactccccggaccccccctactcccctacacttacctaataacgtaaaatgactacacgtcccggcccccgtcccggggtccctcgtaccccgtactttcctcgtcggtcttacccatcgtcgtggccctaccttcgacgcccttcccgtagaccctatacgtacggtgtccgtccggttcccgggtccgaaggtcgtaggtacggacttaggtaacttttacgtttacgtcggtcgtacccgtacggggtaggtacttacgctaaccgttcgtaaggtaacggttcggggtacggttgggtaccggcggggaacggaccncggtcctaccggaaccgttctaaacggcccaacgtacccggagtcccgtcccccgg

SEQ ID NO: 411998 - DNA, 759 bp, Homo sapiens
  misc_feature: GZ8MTXP02JUC1L.17.28.C06.1.454.CMB.2.raw
  modified_base (258)..(258): a, c, t, g, unknown or other
  modified_base (336)..(336): a, c, t, g, unknown or other
  modified_base (391)..(391): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactggttttccttgttgctgttttagaaggtgtccagtgtgaggtcagttggttgaggtccggggagcctggtccagccgtgggggtcctgagactctcctgtgcncgcctccggtactccccttcagttacgttattggtatgtacgttcggccgtcgacgactccgaggggacgggctaggngtgggtcgacgaacataaagctaaggataggaacgtgaccccggtagtttaccgnggtactcgtaggtaggtaccgggtccgtttcaaccgtactaccgttacccagggtaagaacccgtaaaccgaccgtaaacggtaaactttacccgaaacgttacggttaaactttacctaaaccgtttaaaaccgtacggtaaaacccgacggtacccgttaaggggaacggtaacggtcccgtacggaaacgttacccggaaccgggtacccggttaggttaaacgttaaccggttgtacggtaccggtacgtaaggttagggtaaacgggtaaaaaaggttaacggtggtaacgtgggtttagttttaacggggacggggtaccgtacgggtaaccggtcccgtttacggggaccttaaccccggg

SEQ ID NO: 411999 - DNA, 654 bp, Homo sapiens
  misc_feature: GZ8MTXP02IYIBQ.17.28.C06.1.454.CMB.2.raw
  modified_base (214)..(214): a, c, t, g, unknown or other
  modified_base (273)..(273): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttgggctgaactgggttttcctgttgctgttttagaaggtgtccagtgtgaggtcagttggtgagtcggggngctgcagccgtggggtcctgagactctctgtgcagccctcggacttcccctcagtattntggatgacgttgggtcccgccgagacctccgaaggggaagggggcgtaggggaggttggggtacggaccaaaacaagtttttaaaacggacgtaaaggaagtacggaaacgtacgtaccccggtaaggtttttacggtggacttcgtggtaggacggggtccgtttacaccgactcgtccgaagacgaccaacgacctaagaacttacactacgtactactacaactagacacgaccgtagaagacgtcgacaagaccgacggtcgtagtacgttacgtgtcgagagtagtaggaaaggtaaaagtacgtaggtacttggttaggtttaacgttcggggaccgtacgggggtacgtcccggttacgggtacccgttacccg

SEQ ID NO: 412000 - DNA, 813 bp, Homo sapiens
  misc_feature: GZ8MTXP02JRTKR.17.28.C06.1.454.CMB.2.raw
  modified_base (209)..(209): a, c, t, g, unknown or other
  modified_base (246)..(246): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctaaccctcctcactcactgtgcagggtcctgggcccagtctgtgctgactcagccaccctcagtgtcgtcgggaccccccgggnaggacgggtccaaccattatctttgttctaggaaacngcctccggcatctacaaactaaactattttgctggtaccagctaacttcccgaggtactccccggccccccgtactccctcactctaataagtaaatgatctacgtcccggtccccgtccggggtccctacgaccgtattccccgtcgtcgacctcctattcgtcgtcgggcctacccgtcgaccgtccccttcccgtacacccgtaactcccgtaggtttccggggccccgttacccgggtcccgggaaaggtcgtacgggtaccgggttaccttaggttaaaccttttaaagtttacccggttgggtacccgtaccggttaacccgggggttgggggtaaacctcggggtaaccttaaccggttccgttaagggtaaccgggtttccgggggtttaacccggggtacgggttttccgggggaccgggggaaaaccgggggccccgtaaacggggtcggttacccgggtaaccccggttacgttaaaccgggtaacccggaacccggtaccccggtaacgggtccccgtttacccccggtccccccgggttacggtttaacccccg

SEQ ID NO: 412001 - DNA, 803 bp, Homo sapiens
  misc_feature: GZ8MTXP02F3CU9.17.28.C06.1.454.CMB.2.raw
  modified_base (212)..(212): a, c, t, g, unknown or other
  modified_base (245)..(245): a, c, t, g, unknown or other
  modified_base (253)..(253): a, c, t, g, unknown or other
  modified_base (272)..(272): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcacgccaccctcagtcgtcgtccggggacccccgggnaggagggtcaccattatcttgttctaggaaacngctccggnatctactaaactaaacttnttttcgctaggtaccagctaacttcccgaaggacctccccggaccccccgtactcccctactacttaccgttaaagtaagtaaaagttcgaaacgtccaaacggttccccgggtccccccgggtttcccgggggtcccctaggtaaccccggtttaccttccgttccgtcggtcccttacgtcgttcggtccgtcggaccctaccgtaccaccgtccctccgtacaaccctctccgtacgggtcgggtcccgttcccggggtaccggagggtacgtacgggtaccgtgtacgtttaaacgtttaaccgtttaacgttccgggttacgtacccggttaaccggggtttaggggaacctttaacggtaaccgtacgtttacccggtaggttaaccggtttccgggggttaaccggttttcgggggaacggggtcgggggtaaacgggaaccggtcggtaccgttaacggtacccggttaccgtaaacggtcgaaccgtacccggaacggccccgttaccgccccgtttaaccg

SEQ ID NO: 412002 - DNA, 642 bp, Homo sapiens
  misc_feature: GZ8MTXP02JMS37.17.28.C06.1.454.CMB.2.raw
  modified_base (276)..(276): a, c, t, g, unknown or other
  modified_base (304)..(304): a, c, t, g, unknown or other
  modified_base (393)..(393): a, c, t, g, unknown or other
  modified_base (464)..(464): a, c, t, g, unknown or other
  modified_base (550)..(550): a, c, t, g, unknown or other
tcagcgtagactagcacgaccggtgctcgatttagagctcacgtattggggtttggggaggtctcagagaggaggcttagccctggactccaaggcctttccacttggtgatcagcactgagcacagagtactcaccatggagttgggctgactgggtttcctgtgctgttttagaggtgtccagtgtgaggtccagttggttgaggtcgggggagcctggtccagccgtggggggtccctgagactctcctgtgcagccctccggtattcccctnagtagttattggatgtacgttgggcccncgagacctacggaggggaaggggcctggggaggtggggtacgaccaacgaagtaaagcaaagagtagactggaccccgtagtttacggngtactcgtaggtacgagggtccgtttacacgtactcgtaccgagaccggaacacgtacccaaagtacgttnacgttagtaacttacaaactaagtacgaaacgtacgtccgtagacggtacgtacggacacgacgaccggtacgtaggtacttacgngtcgacgtagagtggtaaaagaaagtacgttacggcttagggttagttaacggtaggggacccggtagggacgtccggttgaccccgtacgg

SEQ ID NO: 412003 - DNA, 681 bp, Homo sapiens
  misc_feature: GZ8MTXP02JX9H2.17.28.C06.1.454.CMB.2.raw
  modified_base (212)..(212): a, c, t, g, unknown or other
  modified_base (247)..(247): a, c, t, g, unknown or other
  modified_base (435)..(435): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcacgccaccctcagtcgtcgtccggggacccccggngacggagggtaccactatatcttgtcgtagaaacngtactcgctatctacaaactaaatgttttgctacggaccaggtacctaacgttacccgaggtaccgtaccccggacccccgtacttaccctactacttactaacgaaagtaaaacgtggtaactcgtacctcccgggtccccgtccggggtacccctagacccccgttattccgtcgtccgcttaccnttcgtcctacggccctaccgtctacgtcccctacctcaccgtaacgtcggtaaccggttcggtaccgtccggtacgtacggtagttcgcgtattaccggtatttacgtacgtagtacggtcggtaacgtgggtacctagtaccgtatacggttcgtaacggtcgttacggggtcgggtacggaccgagggcctaggtcgtaccgtcgtaacgtacggtcaccggtaccgcggtcccgccgtccccg

SEQ ID NO: 412004 - DNA, 669 bp, Homo sapiens
  misc_feature: GZ8MTXP02HJZ14.17.28.C06.1.454.CMB.2.raw
  modified_base (211)..(211): a, c, t, g, unknown or other
  modified_base (250)..(250): a, c, t, g, unknown or other
  modified_base (328)..(328): a, c, t, g, unknown or other
  modified_base (419)..(419): a, c, t, g, unknown or other
  modified_base (530)..(530): a, c, t, g, unknown or other
tcagcgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcacgcccaccctcagtcgtcgtcgggacccccggnagaggtcaccattatcttgttcgtaggaaacagctccgnatctacaactaaactatttgctagtaccagacctaattccccaggtctaccccggccccccatccctcataccgtaanaagtaaaatgaatcctacgtcccgtccccgtccggggtccctagtacccccgatttccgtctcgtctacccagtctctggacccaccgtcncgtacccctccacgactacgtcaggtccggacgttccggtacccgaggtaacgtggacgtcttaggtaatttaaatttccgtaggtccgtacgaaccgggtgggtaacccnggttaacctacgttccgtaaggttaacgtccggggtttccgggttacggttaccgggggacggaaccggggtaacccagggtccgttacggaccctttaacgaaagtccgaacgacccgacgtccgaccccgtccccgg

SEQ ID NO: 412005 - DNA, 759 bp, Homo sapiens
  misc_feature: GZ8MTXP02IUE9C.17.28.C06.1.454.CMB.2.raw
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgcttgttttagaggtgtccagtgtgaggtccagttggtgaggtccgggggagccgtggtccaggccgtgggggtccctgagactctctgtgcagcctccggtacttccccttcagttagttattggatgtacgttcgggtccgacgacgaccgccggaagggggaggggcgtaggggaggttcggggtacggaccaaacgaagtaaaggacgtaaaggagtacgggaaacgtcggtacccggtttaacggttttaccggtacgggttaccttcgttacgggtagggtaccgggggttccctttaccgaccgtacctccgtaacgaggtaaacgaaccgaaccgaacctaaacgtaaacttacctaacgttactaaacgtacctaaacgaactacgaacgaacgtaccgtaggacggtacggtccgaccgaagaccgtacggtaccgttacgtttaagttccgtggtacgaggtaacgtaggttaggaaaacggtaaaaggttaggttaccgggttacgttaggttttaggttttaacggggtacggggtaccgggtacggggtacggtacccgttacgggtccttaccccg

SEQ ID NO: 412006 - DNA, 625 bp, Homo sapiens
  misc_feature: GZ8MTXP02G3JIK.17.28.C06.1.454.CMB.2.raw
  modified_base (365)..(365): a, c, t, g, unknown or other
  modified_base (390)..(390): a, c, t, g, unknown or other
  modified_base (418)..(418): a, c, t, g, unknown or other
  modified_base (473)..(473): a, c, t, g, unknown or other
  modified_base (494)..(494): a, c, t, g, unknown or other
tcagcgtagactagcacgaccggtgctcgatttagagctcacgtattgggtttggggctcagagaggaggcttagccctggactccaaggcctttccacttggtgatcagcactgagcacagaggactcaccatggagttggggctgaactgggttttccttgttgctgttttagaaggtgtccagtgtgaggtccagttggttgagtccggggaggcctggtccagccgtgggggtccctgagctctcctgtgcagcctccggacttccccttcagtagttagttggatggacgttgggtcccgccgagacctccgaggggaacggggcgtgggaggtggggtagaccaacgaataaagcaagngtaggaactggacgtagttttacgngtactcgtggtgagggtccgtttcactntctccagacacaaacgccaaagaacttcactagtactacctaacaactacgaacngtacctggaagacggtccganacggacgacggccgtgttaactacgtgtgacgagaagtaggtaaaggtaaaaactggtaggtcttaggttggttttaacggcggggtaccgaacggggtacgtcccggtggtaacccgtcggtttaacccg

SEQ ID NO: 412007 - DNA, 650 bp, Homo sapiens
  misc_feature: GZ8MTXP02FFS9A.17.28.C06.1.454.CMB.2.raw
  modified_base (279)..(279): a, c, t, g, unknown or other
  modified_base (471)..(471): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaacttgggttttccttgttgcttgttttagaaggtgtccagtgtgaggtccagttggttgagtcggggagctggtccagccgtgggggtccctgagactctcctgtgcagccctcggacttccccttnagttagttatggatgacgttcgggtccgccagacctccgaaggggaggggctggggaggtggggtgaccaaacgataaaagcaaagagtaggaaactggacccgtagttttacgaggtactcgtgtaggtacggggtccctttcactactcctacagaagaaccaacgaccaaaagtaacttacaacgttanaacttactaaacaactaagaaacacgacctagacggtacgtacgacgaagacccgaacgggtcccgttagttacttaaccgtggtacgacgaagtagtaaggtaaaaggaaaaagttgtaggtacttggtttagttaagggtcggggtacgacgggacgtacccggtggtcctaccccg

SEQ ID NO: 412008 - DNA, 544 bp, Homo sapiens
  misc_feature: GZ8MTXP02FM5DI.17.28.C06.1.454.CMB.2.raw
  modified_base (248)..(248): a, c, t, g, unknown or other
  modified_base (258)..(258): a, c, t, g, unknown or other
  modified_base (260)..(260): a, c, t, g, unknown or other
  modified_base (277)..(277): a, c, t, g, unknown or other
  modified_base (304)..(304): a, c, t, g, unknown or other
  modified_base (345)..(345): a, c, t, g, unknown or other
  modified_base (347)..(347): a, c, t, g, unknown or other
  modified_base (352)..(352): a, c, t, g, unknown or other
  modified_base (356)..(356): a, c, t, g, unknown or other
  modified_base (375)..(375): a, c, t, g, unknown or other
  modified_base (401)..(401): a, c, t, g, unknown or other
  modified_base (430)..(430): a, c, t, g, unknown or other
  modified_base (441)..(441): a, c, t, g, unknown or other
  modified_base (446)..(446): a, c, t, g, unknown or other
  modified_base (468)..(468): a, c, t, g, unknown or other
  modified_base (480)..(480): a, c, t, g, unknown or other
  modified_base (482)..(482): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttccttgttgcttgttttagaaggtgtccagtgtgaggtcagttggtgaggtccgggggagcctggtccaggccgtgggggtccctgngctctctgtncngccctcggattcccctnagtagttatggatgacgttcgggtccnccagacctccgaggggagggctggagtgggtgaccctaaananaacgnaagntagactgtccgtagttcgngtctgtgtacggtcggtccttacacntcacgagacaacacgaccaatactctatnactcaacgtanagacngctgacgtcgcagacgcgtcgnttagtatcgtgngngtagagtaggaaagaatgtcgtgttgttcgttaaggcggagacgggtctcgtcgtcctaccg

SEQ ID NO: 412009 - DNA, 627 bp, Homo sapiens
  misc_feature: GZ8MTXP02JGRRV.17.28.C06.1.454.CMB.2.raw
  modified_base (244)..(244): a, c, t, g, unknown or other
  modified_base (279)..(279): a, c, t, g, unknown or other
  modified_base (357)..(357): a, c, t, g, unknown or other
  modified_base (381)..(381): a, c, t, g, unknown or other
  modified_base (410)..(410): a, c, t, g, unknown or other
tcagcgtagactagcacgaccggtgctcgatttagagctcacgtattggggtttggggaggtctcagagaggaggcttagccctggactccaaggcctttccacttggtgatcagcactgagcacagaggactcaccatggagttggggctgaactgggttttccttgttgcttgttttagaaggtgtccagtgtgaggtcagttggtgaggtccggggagcctggtccagccgtgggggtccngagactctcctgtgcacgcctccggacttcccctnagtattatgatgacgttggtccgcagactccggagggaaggggctggaggtggtggaccaaacgataaacggcaaagntagaactcgacccgtagtttacgngtactctagtagacggggtccttcacctntcgaccagacgaacaacgaccaagtaacttcactatactactaacaactacgaacacgacgtcgaagtacgtccgacgaacgacgaccggtacgttagtacttacgtagttgacggtagtagtagggtaaaggtaaaaagttacgtaggtacgttaggtttaaggttaaggttcggggacggtacggggtacgtaccccggttcggtaccgtacccg

SEQ ID NO: 412010 - DNA, 843 bp, Homo sapiens
  misc_feature: GZ8MTXP02FXM8I.17.28.C06.1.454.CMB.2.raw
  modified_base (211)..(211): a, c, t, g, unknown or other
  modified_base (243)..(243): a, c, t, g, unknown or other
  modified_base (267)..(267): a, c, t, g, unknown or other
  modified_base (282)..(282): a, c, t, g, unknown or other
  modified_base (311)..(311): a, c, t, g, unknown or other
tcagcgtagactagcacgaccggtgctcgatttagagctcacgtattgggtttggggagcttcagctgtggtagagaagacaggattcaggacaatctccagcatggccggcttccctctcctcctcaccctcctcactcactgtgcgagggtcctcgggcccagtctgtgctgactcacgccaccctcagtcgtcgtcggggaccccggnaggaggtccactatattcttgtctaggaaacngctccgcatctacaaactaacttnttttcgctaggtacnactaactccaggacgtccccggacccccncttcctctaacttactaagtaagaaaatcgtaataccgtaccgttcccggggtacccccggttccggggttaccctacggtaccgttacgtttcccttaccggtcggtccttaacgtcgtttacgtccgttccggaacctacccgtacccgtacccggtcccctttaccccggtacgtaacccgtacgttacccggtaacgggggttccccggtcccgggtttcccccgggggtaacggtacgggttaggtacccgggtaggttacttaacgggtttaaacttttaccgggttaaaccgttcgggttaccggacccggttaaacccggggtgggttaaaacgttccgaacccggttacgtttaccggtagggtaaaccggggtttccgggggtaccgggttacggggtacccggggacgggggtacccgggtaaaccgtccgggtcccgtttaaacccgggttaccgtaacccggtaacggtcccgaaccgtacccgggaccgtttcccgaccccggtccccgtttaaccgg

SEQ ID NO: 412011 - DNA, 816 bp, Homo sapiens
  misc_feature: GZ8MTXP02JBPX1.17.28.C06.1.454.CMB.2.raw
  modified_base (271)..(271): a, c, t, g, unknown or other
  modified_base (292)..(292): a, c, t, g, unknown or other
  modified_base (331)..(331): a, c, t, g, unknown or other
tcagcgtagactagcacgaccggtgctcgatttagagctcacgtattgggtttggggaggtctcagagaggaggcttagccctggactccaaggcctttccacttggtgatcagcactgagcacagaggactcaccatggagttggggctgaactgggttttcctgttgctgttttagaaggtgtccagtgtgaggtccagttggtgagtccggggagcctggtcagcctgggggtccctgagactctctgtgcagctccggattcccctnatagtatggatgactggtccncagacctcgagggagggctcggaggtggtaggcctaaanaagtaaacgcgaaaggtatacgggaaactcggaccccggtagtttttacggtacgggtaccttcgttagggtaacgggaaccgggggttcccgttttacgaacccgtacgttaccgtacccgaacgaacgaaacccgttaaacgaccccgtaaaagggtaaaccttcgtaaaccgtttaggtaaaccttaccttaaaacccgaaacgttaacgaaaaccgtaggtacccccgttaaaggtcgggaaaggttcccggaacaaaccgggttaaaccgaccgggggtaaccgtttacgggtaactttaccgtagggtacgtacggttaacggaaggtttaacgggtaaaacggggtaaaaaaagttaacgggttccgggttaaacgttaggtttttaaagggggtttaacggtttaccgggggggaaacccttaacgggggtaaccgggtcccccggtttttacgggggaaaccctttaaccccccgg

SEQ ID NO: 412012 - DNA, 590 bp, Homo sapiens
  misc_feature: GZ8MTXP01APHIL.52.41.D08.1.454.CMB.2.raw
  modified_base (194)..(194): a, c, t, g, unknown or other
tcagcgcagtacgaccacgaccggtgctcgatttagtcacgcgagaaagggaaaggggggtagagaagacaggactcaggacaatctccagcatggccagcttccctctcctcctcaccctcctcactcactgtgcagggtcctgggcccagtctgtgctgactcagccaccctcagcgtctgggacccccgtnagaggtcaccatctcttgttctggaggcgctccaacatcggagggaatactgtgaactggtaccagcaactcccgaggaccggcccccagactcctcatctttagtcataatcagccggccctcgacggggtccctgacccgattctctcggctccaagtcctggcacctcagtccctccttggcccatcagtgggctccagtctgacgatgaggctgtattacttctgtgactaacgttggggattgacagtccctagaagttcgggtccggttaggttccgggacgggacgggtaaccaaggtccttaccggttcgtcgggttccgacggtcccgaagggttccttccggccccctcgggtcccacgttccttacgttcccccaacccgttccc

SEQ ID NO: 412013 - DNA, 534 bp, Homo sapiens
  misc_feature: GZ8MTXP01ES2NR.52.41.D08.1.454.CMB.2.raw
  modified_base (516)..(516): a, c, t, g, unknown or other
  modified_base (529)..(529): a, c, t, g, unknown or other
tcagcgcagtacgaccacgaccggtgctcgatttagtcacgcgagaaagggaaaggggggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaggcggctccaaacatcggagggaatactgtgaactggtaccagcaactcccagggacgcccccagactcctcatctttagtcataatcagcggccctcacggggtccctgacccgattctctggctccaagtcctggcacctcacgccctcttggccatcagtgggctcagtctgacgatgaggctagatttacttctgtcgctaacgttgggatggacagccgtagaagtggtcggtgtcggcggaggacaagtcttacgttcgtgggttcacgccaggcttcgcccctcgtcnctcttcgttcccncctcc

SEQ ID NO: 412014 - DNA, 558 bp, Homo sapiens
  misc_feature: GZ8MTXP01B83Y0.52.41.D08.1.454.CMB.2.raw
tcagcgcagtacgaccacgaccggtgctcgatttagtcacgcgagaaagggaaagggggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggagcgctccaacatcggaggaatactgtgaactggtaccagcaactcccaggacgcccccagactcctcatcttagtcataatcagcgccctcgagggtccctgacccgattctctggctccaagtcctggcacctcagccctctggccatcagtgggctccagtctgacgatgagctgattacttctgtgctaacgttggggattgacgtagccgtgaacgtggtccggtggttcggcgggtagggaccgaaagtcgttaaccgttcgtcgggttcgtacgcccgaaggttccttcggccccctgggtccaccttccgttcgttccccaacccgttccc

SEQ ID NO: 412015 - DNA, 590 bp, Homo sapiens
  misc_feature: GZ8MTXP01EJHU0.52.41.D08.1.454.CMB.2.raw
  modified_base (196)..(196): a, c, t, g, unknown or other
  modified_base (323)..(323): a, c, t, g, unknown or other
tcagcgcagtacgaccacgaccggtgctcgatttagtcacgcgagaaagggaaaggggggtagagaagacaggactcaggacaatctccagcatggccagcttccctctcctcctcaccctcctcactcactgtgcagggtcctgggcccagtctgtgctgactcagccaccctcagcgtctggggacccccggtnaggagggtcaccatctcttgttctggaggcggctccaaacatcggagggaatactgtgaactggtaccagcaactcccgagggaccggcccccagactcctcatctttagcataatcagcggccctnacgggggtccctgacccgtattcctctggctccaagtcctggcactcacgtccctccttggccctatccgagtcgggctcagtctgacgatgaggctgtactttactctgcgctaaacgttgggattcgaacacgtcctaggaagttcgggtccggttaggttcgggcgggtagggacccaaggtccgtttaaccgttgtcgggttcacggcccaagggcttccggcccctggtcctacgtccgttcgttcccccttaaccgttccc

SEQ ID NO: 412016 - DNA, 685 bp, Homo sapiens
  misc_feature: GZ8MTXP01ELE6N.52.41.D08.1.454.CMB.2.raw
tcagcgcagtacgaccacgaccggtgctcgatttagtcacgcgagaaagggaaaggggggtagagaagacaggactcaggacaatctccagcatggccagcttccctctcctcctcaccctcctcactcactgtgcagggtcctgggcccagtctgtgctgactcagccaccctcagcgtctcgggacccccgtcagagggtcaccatctcttgttctggaggcggctccaacatcgggaggaatactgtgaactggtaccagcaactcccgagggaccgccccagactcctcatcttagtcataatcagccgccctcgacggggtccctgacccgtatttctctcggcctccaagtcctcggacaccctcacgcccttccttggcccatcgaggtcgggctccgagtctgacgtagtgagtctagtactttacttctgttcgacgtaaacgttgggaagttcgaacgtacgtaccgtaggtaaacggttcgggttccgggtttcgggttccggggtaccggggaacggggtaaccccgtaaagggtaacccgttttaacccgggtttccggttacggggttccgaaaccgggtaccccgaaacggggttcccttcccgggtcccccccgtcgggtaaccctacccgttccgttacccggtttcccccttaaccccgtttccccg

SEQ ID NO: 412017 - DNA, 676 bp, Homo sapiens
  misc_feature: GZ8MTXP01A7TPV.52.41.D08.1.454.CMB.2.raw
  modified_base (196)..(196): a, c, t, g, unknown or other
tcagcgcagtacgaccacgaccggtgctcgatttagtcacgcgagaaagggaaaggggggtagagaagacaggactcaggacaatctccagcatggccagcttccctctcctcctcaccctcctcactcactgtgcagggtcctgggcccagtctgtgctgactcagccaccctcagcgtctcggggacccccgtnaggaggtcaccatctcttgttctggaggcgctccaacagtcggagggaatactgtgaactggtaccagcaactcccaggaccgccccagactcctcatcttagcataatcagcgccctgacggggtccctgaccgtattctcgtcggctccgaacgtccctggcacctcacgcccttcccttggaccctatccgaggtcgggcctaccagtcctgaccgtagtggaacggtccgtagtaactttacttccgtagttcgaccttaacgtttggggattcggaactacggcccttaggaacgttcggggttccggtacggggtttccgggaccgggggtaacgggtaccctaaacgggtccgttttaacccggttcggttacgggggttaccaacgggtaccccgaacgggttcccgttacccggccccccgttcgggtcctaccgtcccgttcccgtttcccccggcccctttaaccccgg

SEQ ID NO: 412018 - DNA, 564 bp, Homo sapiens
  misc_feature: GZ8MTXP01CVO89.52.41.D08.1.454.CMB.2.raw
  modified_base (196)..(196): a, c, t, g, unknown or other
  modified_base (235)..(235): a, c, t, g, unknown or other
tcagcgcagtacgaccacgaccggtgctcgatttagtcacgcgagaaagggaaaggggggtagagaagacaggactcaggacaatctccagcatggccagcttccctctcctcctcaccctcctcactcactgtgcagggtcctgggcccagtctgtgctgactcagccaccctcagcgtctcggggacccccgtnagaggtcaccatctcttgttctggaggcggctccaaacntcgggagggaatacgtgtgaactggtaccagcaactcccgaggaccgccccagactcctcatcttagcataatcagccgcctcgacggggtcccctgacgattccgtctggctccaagtccgtggctaccctcacgcccttccgttcgccatcgagtcgggctccagtctagacgatggagtctagtattacttcgtgttgactaacgttgggatgacgtagccgtagaagtcggtccggttaggtcggcggaggaccaagtccttacgttcgtggttcgacgccaggccttccgccccgtgtccacgtccttccgttccccgccttcc

SEQ ID NO: 412019 - DNA, 669 bp, Homo sapiens
  misc_feature: GZ8MTXP01DUT61.52.41.D08.1.454.CMB.2.raw
tcagcgcagtacgaccacgaccggtgctcgatttagtcacgcgagaaagggaaagggggggtagagaagacaggactcaggacaatctccagcatggccagcttccctctcctcctcaccctcctcactcactgtgcagggtcctgggcccagtctgtgctgactcagccaccctcagcgtctcgggacccccggtcagagggtcaccatctcttgttctggaggcggctccaacatcggaggaatactgtgaactggtaccagcaactcccgaggaccgccccagactcctcatcttagcataatcagcgccctcgacggggtccctgacccgtattctcgtcggctccaagtccctggcacctcacgcccttctcggcctagtcagtcgggctcagtctgacgagtgagtctagtacttacttcgtgtcgtactaaacgtttgggaagttcggaaccgtacgtaccgtaggtaaacgtcggggttaccggttgggttccggggaccgggtaacggggtaacctaacgggtcccgttttaaccgggttcggttacggggttaccgaaaccgggtaccccgttaaacgggttcccgttcccggtccccccgtttgggtaaccctacccgttccccgttcccggttcccccccgttcccgtttaaccccg

SEQ ID NO: 412020 - DNA, 627 bp, Homo sapiens
  misc_feature: GZ8MTXP01D0EBE.52.41.D08.1.454.CMB.2.raw
  modified_base (235)..(235): a, c, t, g, unknown or other
  modified_base (432)..(432): a, c, t, g, unknown or other
tcagcgcagtacgaccacgaccggtgctcgatttagtcacgcgagaaagggaaagggggggtagagaagacaggactcaggacaatctccagcatggccagcttccctctcctcctcaccctcctcactcactgtgcagggtcctgggcccagtctgtgctgactcagccaccctcagcgtctcgggacccccggtcagagggtcaccatctcttgttctggaggcggctccaanagtcggagggaatactgtgaactggtaccagcaactcccaggcggccccagactcctcatctttagcataatcagcgccctcgacggggtccctgacccgtattcctctggctccgaagttccctggcacctcagtccctcttggccagtccagtcggggctccgagtctgacgatggagtcttagactttacttcngttcgactaacgttgggatcgaactagcctagtaagtcggtccggttgtcgggcggtacggggaccctaaggtcctttaaccgggtttcgtacgggggttcacgggtaccccgttaaggggttcccttcccggccccccggttcgggtccctacccgtttccgttcccggtttccccccggccccgttttccccg

SEQ ID NO: 412021 - DNA, 618 bp, Homo sapiens
  misc_feature: GZ8MTXP01AC4TV.52.41.D08.1.454.CMB.2.raw
  modified_base (195)..(195): a, c, t, g, unknown or other
tcagcgcagtacgaccacgaccggtgctcgatttagtcacgcgagaaagggaaaggggggtagagaagacaggactcaggacaatctccagcatggccagcttccctctcctcctcaccctcctcactcactgtgcagggtcctgggcccagtctgtgctgactcagccaccctcagcgtctgggacccccggtnagaggtcaccatctcttgttctggaggcggctccaacagtcggagggaatactgtgaactggtaccagcaactcccgaggaccgccccagactcctcatcttagcataatcagccggccctcgacgggggtcccctgaccgtattcctctggctcaagtcctcggcacctcacgtcccttccttggccagtcaggtcgggctccgagtctagacgatggaggtctagtattacttcgtgtgactaacgttgggactaggactacgccgtagaacgttcgggtcccgggttggttccggggcgggtaacgggtaacccgaaggtccgtttaccgggttcgtcggggttacgtaccggacccgttaacggccttccggtccccccgtggtccctacgttccttccgttccccaacccgtttcccg

SEQ ID NO: 412022 - DNA, 620 bp, Homo sapiens
  misc_feature: GZ8MTXP01CSXAH.52.41.D08.1.454.CMB.2.raw
  modified_base (259)..(259): a, c, t, g, unknown or other
  modified_base (599)..(599): a, c, t, g, unknown or other
tcagcgcagtacgacacgaccggtgctcgatttagtcacgcgagaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctctgcacgtggaaaccgaatgactagttggtagttaataattntgtctctgtaccaacaccaccagacaaacgccccaaatctattattatggtgtcggtcgacccggtcctaggtacgggggtttacaatcctacttctcgtcggtcctacccgacgtccgacaaccgccggtccctccgtcgacctcgtctcgtcggcctaccgaggccgaggacgaggtctagtattattcgcgccgactagaataactaaaccaaaacgaaaccgtaagtaagttcggggtacgtaccgggaggacggaaccagtctacgaccgtcgtaaggaccacggtacccaggtccctcccgaccccgttgttacctaacttccttccgtccccnccttacctaacgttcgtaacg

SEQ ID NO: 412023 - DNA, 616 bp, Homo sapiens
  misc_feature: GZ8MTXP01BEKRT.52.41.D08.1.454.CMB.2.raw
  modified_base (198)..(198): a, c, t, g, unknown or other
  modified_base (343)..(343): a, c, t, g, unknown or other
  modified_base (416)..(416): a, c, t, g, unknown or other
  modified_base (587)..(587): a, c, t, g, unknown or other
tcagcgcagtacgaccacgaccggtgctcgatttagtcacgcgagaaagggaaagggggggtaggagaagacaggactcaggacaatctccagcatggccagcttccctctcctcctcaccctcctcactcactgtgcagggtcctgggcccagtctggtgctgactcagccaccctcagcgtctcgggacccccgtnagaggtcaccatctcttgttctggaggcgctccaacatcggaggaatactgtgaactggtaccagcaactcccgagggaccgcccccagacctcctcattccttagcaataatcagccgccctgacggggtccctgaccgattcncgtggctcgaagtccctggcacctcgacgtccctccgttgaccagtccgagtcgggcctacgagtctagacgngtgaggctagtaactttctcgtagtcgacctaagttgggattgaacgacgtcctaggaacgttcgggtaccggttggttccgggacgggtacggtacctaaggtccgtttaacgttcggtcgggttaccgacggtcccgaacggccgttcccggtcccccgtggtaacccncgtccgttccgtcccccgaaccgttcccg

SEQ ID NO: 412024 - DNA, 746 bp, Homo sapiens
  misc_feature: GZ8MTXP01CDINA.52.41.D08.1.454.CMB.2.raw
  modified_base (196)..(196): a, c, t, g, unknown or other
  modified_base (233)..(233): a, c, t, g, unknown or other
tcagcgcagtacgaccacgaccggtgctcgatttagtcacgcgagaaagggaaagggggggtagagaagacaggactcaggacaatctccagcatggccagcttccctctcctcctcaccctcctcactcactgtgcagggtcctgggcccagtctgtgctgactcagccaccctcagcgtctcgggacccccgtnagaggtcaccatctcttgtcgtggaggcgctccaacngtcggaggatactgtagaactggtaccagccaaccgtcccgagggacccgcccccagacctcctcattctttagcaatatcacgccggccctcgacgggggtccctcggaccgtacttcgtcgtcggtcctccgaagtccccgtacgggcctacccgtcaccgcccttaccgttcggccctagtccgaggtcgggcctacgagttctagacgtagtggacggtcttacgtactttacgttcgttaggtacgtaccgttaacgggtttcgggggtaactcgggtaaccgtaccggtacccggttaggtaaccgggttcgggggttaccggggtttcggggtcccggggtacgggggtaaccgggtaccggtaaccggtttcccggtttaaccgggtttcgggtacgggttaccgtaccgggtcccggttaaccgggttcccggttccccggtaacccccgttcggtaacccgttcccgttcccggttccccgttcccccgttcccgtttccccg

SEQ ID NO: 412025 - DNA, 556 bp, Homo sapiens
  misc_feature: GZ8MTXP01DD600.52.41.D08.1.454.CMB.2.raw
  modified_base (196)..(196): a, c, t, g, unknown or other
  modified_base (291)..(291): a, c, t, g, unknown or other
  modified_base (336)..(336): a, c, t, g, unknown or other
  modified_base (396)..(396): a, c, t, g, unknown or other
  modified_base (401)..(401): a, c, t, g, unknown or other
  modified_base (416)..(416): a, c, t, g, unknown or other
  modified_base (419)..(419): a, c, t, g, unknown or other
  modified_base (437)..(437): a, c, t, g, unknown or other
  modified_base (458)..(458): a, c, t, g, unknown or other
  modified_base (501)..(501): a, c, t, g, unknown or other
tcagcgcagtacgaccacgaccggtgctcgatttagtcacgcgagaaagggaaagggggggtagagaagacaggactcaggacaatctccagcatggccagcttccctctcctcctcaccctcctcactcactgtgcagggtcctgggcccagtctgtgctgactcagccaccctcagcgtctcgggacccccgtnagagggtcaccatctcttgtctggaggcgctccaacagtcggagggaatactgtgaactggtaccagcaacgtcccgggacgccccagactcctnatcttagcatatcagccgccctcgacgggtccctgacctatttcncgtggcctccagtctcggcactcacgccctaccttggccatcgagtcgggcctcgagtcngacgntgagctagattactntgngacaagttgggatggacngtctgagtcggtcgtgtcggnggtacgacagtcgttaacgtgcgggtcacgtcccgaggttccncccggttccccgttggtacctccgttcctccgttcccctaacccgttccttaacg

SEQ ID NO: 412026 - DNA, 517 bp, Homo sapiens
  misc_feature: GZ8MTXP02J1DWF.52.41.D08.1.454.CMB.2.raw
  modified_base (195)..(195): a, c, t, g, unknown or other
  modified_base (474)..(474): a, c, t, g, unknown or other
  modified_base (481)..(481): a, c, t, g, unknown or other
  modified_base (502)..(502): a, c, t, g, unknown or other
tcagcgcagtacgaccacgaccggtgctcgatttagtcacgcgagaaagggaaagggggtagagaagacaggactcaggacaatctccagcatggccagcttccctctcctcctcaccctcctcactcactgtgcagggtcctgggcccagtctgtgctgactcagccaccctcagcgtctgggaccccccggtnagagggtcaccatctcttgttctggaggcggctccaacatcggagggaatactgtgaactggtaccagcaactcccaggacggcccccagactcctcatctttagtcataatcagcggccctcaggggtccctgaccgattctctggctccaagtcctggcactcagcctctgccatcagtggctccagtctgacgatgaggctgattacttctgtgcaacgttgggatggacagcctgaatggtccggtgtcggcggtagggaccaagtcttacgtcncgggtcncgccaggctcgccccgtggcnctctcgtcccgctcc

SEQ ID NO: 412027 - DNA, 644 bp, Homo sapiens
  misc_feature: GZ8MTXP02GO3MN.52.41.D08.1.454.CMB.2.raw
tcagcgcagtacgaccacgaccggtgctcgatttagtcacgcgagaaagggaaagggggtagagaagacaggactcaggacaatctccagcatggccagcttccctctcctcctcaccctcctcactcactgtgcagggtcctgggcccagtctgtgctgactcagccaccctcagcgtctgggaccccgtcagagggtcaccatctcttgttctggaggcggctccaacatcggagggatactgtgaactggtaccagcaactcccaggaccgccccagactcctcatcttagcataatcagcggcctcaggggtccctgaccgattctctggctccaagtcctgccacctcagcctcttgccatcagtcggctccagtctgacgatgaggctagatttacttctgtgctaaacgttgggaattgaacgagtcctagaaacgttcggggttacccgggttggtttccgggacggggaacggggtaacccgtaaacggtaccgttttaaacccgggtttcgttacgggggttaccaacgggtccccgaaaacggggtcccgttacccgggtcccccccgttaccggggttccgtaaccctttcccgtttacccggtttccccccctaacccccgttttcccccg

SEQ ID NO: 412028 - DNA, 573 bp, Homo sapiens
  misc_feature: GZ8MTXP02JUF33.52.41.D08.1.454.CMB.2.raw
  modified_base (193)..(193): a, c, t, g, unknown or other
  modified_base (330)..(330): a, c, t, g, unknown or other
tcagcgcagtacgaccacgaccggtgctcgatttagtcacgcgagaaagggaaagggggtagagaagacaggactcaggacaatctccagcatggccagcttccctctcctcctcaccctcctcactcactgtgcagggtcctgggcccagtctgtgctgactcagccaccctcagcgtctgggacccccgtnagagggtcaccatctcttgttctggaggcggctccaacagtcggaagggaatactgtgaactggtaccagcaactcccgaggaccggcccccagactcctcatcttagcataatcagcggccctcgacggggtcccngaccgtattctcgtggcctccaagtcctggccacctcacgcccttcttggccatccgagtcgggcctccagtctgacgatggagtctgtacttacttctgtcgtactaacgttgggatgacagccgtagagtcgggtccggttgtcgggcggacggacaagtccgttaccgtgtcgggtcacggcccgaacggtcctccggtcccccgtcggtccaccgttccgtccgttccccacccttccc

SEQ ID NO: 412029 - DNA, 684 bp, Homo sapiens
  misc_feature: GZ8MTXP02ICM72.52.41.D08.1.454.CMB.2.raw
  modified_base (175)..(175): a, c, t, g, unknown or other
  modified_base (194)..(194): a, c, t, g, unknown or other
  modified_base (335)..(335): a, c, t, g, unknown or other
tcagcgcagtacgaccacgaccggtgctcgatttagtcacgcgagaaagggaaaggggggtagagaagacaggactcaggacaatctccagcatggccagcttccctctcctcctcaccctcctcactcactgtgcagggtcctgggcccagtctgtgctgactcagccaccctnagcgtctgggacccccgtnagagggtcaccatctcttgttctggaggcggctccaacatcggagggatactgtgaactggtaccagcaactccagggaccgccccagactcctcatcttagtcataactcagcggccctgagggtccctgaccgtattcnctggcctccgaagtcctggccacctcgacgtccttccttggcccatccgagtcgggctcagtctgacgtagtgacgctgtactttactcgtgtgacgtaaacgtttggggacttaggaacgtacgtccgttaggtaaacgttcggggtttaccgggttacgggtttccggggacggggtaacggggtacccgtaaacggttacccggtttaacccgggttttcggtacggggtttaccgtaccgggaccccgtaaaacgggtcccgtttacccggccccccggttcggttaacccgttacccgttccccggtttcccggtttacccccggttcccccttttaaccccgg

SEQ ID NO: 412030 - DNA, 762 bp, Homo sapiens
  misc_feature: GZ8MTXP02H2VPB.52.41.D08.1.454.CMB.2.raw
  modified_base (175)..(175): a, c, t, g, unknown or other
  modified_base (195)..(195): a, c, t, g, unknown or other
tcagcgcagtacgaccacgaccggtgctcgatttagtcacgcgagaaagggaaaggggggtagagaagacaggactcaggacaatctccagcatggccagcttccctctcctcctcaccctcctcactcactgtgcagggtcctgggcccagtctgtgctgactcagccaccctnagcgtctgggaccccccgtnagagggtcaccatcttctgttctggaggcggctccaacagtcgggagggaatactgtgaactggtaccagcaactcccgaggaccggccccagacctcctcattcttagtccataactcacgccgccctcgacggggtccctgaccgtattccgtcgtcggtcctaccgaagtcccgtcgggaccctacccgtcacggtccccttcccgtttcgggaccctaacgtccgtacgggttcggggcccttacccgtaacgtcccgttaggaaccggtagttggaaacgggtccttaggttaactttaaccgttcgtcgttacgtaaccttaaacggtttggggattacggactacggtacccgttaagggtaagttccggggttccgggttcgggttaccggggtaccggggaacggggtaacccgtaaaacgggttccgtttaaacccgggtttcgtaacggggtccgaaaccggtaccccgaacggggtccctaccccggtccccccgttcggggttaaccctacccgttcccgttcccggtttaccccccggttcccgtttcccccg

SEQ ID NO: 412031 - DNA, 639 bp, Homo sapiens
  misc_feature: GZ8MTXP02HQSHS.52.41.D08.1.454.CMB.2.raw
  modified_base (194)..(194): a, c, t, g, unknown or other
tcagcgcagtacgaccacgaccggtgctcgatttagtcacgcgagaaagggaaaggggggtagagaagacaggactcaggacaatctccagcatggccagcttccctctcctcctcaccctcctcactcactgtgcagggtcctgggcccagtctgtgctgactcagccaccctcagcgtctgggacccccgtnagagggtcaccatctcttgttctggaggcgctccaacatcggagggaatactgtgaactggtaccagcaactcccaggacgccccagactcctcatcttagtcataatcagccggccctgacggggtccctgaccgtattctctggcctccgaagtccctggccacctcagcccttcttcggcatcagtggcctcagtctgacgatgagtctgtattacttcgtgtcgacgtaacgtttgggattacggacgtacgtcccgtaaggtaacggttcggggttacccgggttcggggtttaccgggggaccggggtaacggggtaacccgtaaaccgggttcccgtttaaccgggtttccggtcgggttacgaccgtcccgaaacggtcccgtaccgcccccgttccggtctacccgtccgttcccggtccccgtccctttaccccg

SEQ ID NO: 412032 - DNA, 691 bp, Homo sapiens
  misc_feature: GZ8MTXP02GOBHV.52.41.D08.1.454.CMB.2.raw
  modified_base (195)..(195): a, c, t, g, unknown or other
  modified_base (423)..(423): a, c, t, g, unknown or other
tcagcgcagtacgaccacgaccggtgctcgatttagtcacgcgagaaagggaaaggggggtagagaagacaggactcaggacaatctccagcatggccagcttccctctcctcctcaccctcctcactcactgtgcagggtcctgggcccagcctgtgctgactcagccaccctcagcgtctcgggacccccgtnagaggtcaccatctcttgttctggaggcggctccaaacatcgggaagggaatactgtagaactggtaccagacaactcccgaggaccgccccagacctcctcatcttagcaataatcagccgcctcgacgggtccctagaccgtattctctcggcctacgaagtcccgtggcctacctcacgccccttcgttcggccctaatcgaggtcgggcctcgacgtctgacgngtgaggctagtactttacttcgtgtcgaccgtaaagttgggacttagacgtacgtaccgtaggtaaacgttcggggttcccgggttaggttaccggggacggggacggggtaaaccgtaaacgggttcccgtttaacccgggtttcggtaccggggttaaccgtaccggaacccccgtaaacgggtcccgttaccccggtccccccgttacgggttccctaacccgtttcccgttcccggtttacccccctaccccggtttaaccccg

SEQ ID NO: 412033 - DNA, 610 bp, Homo sapiens
  misc_feature: GZ8MTXP02JDYTH.52.41.D08.1.454.CMB.2.raw
  modified_base (231)..(231): a, c, t, g, unknown or other
tcagcgcagtacgaccacgaccggtgctcgatttagtcacgcgagaaagggaaaggggggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggagcgctccaanatcggaggaatactgtgaactggtaccagcaactcccgaggccgccccagacctcctcatctttagcataatcagcgcctcgaggggtccctgacccgtattcctctggctccgagtcctgccacctcacgccctcttcggccatcagtcgggctccagtctgacgagtgagtctagacgttacttcgtgtgcctaacgttgggattcgactaggtccctagtaacgttcggggttccgggtggttccggggcggtaacggggtaccgaaggttcccgtttaccgggttcgtcgggttaccgacggtacccgaacgggtccttccggcccccgttcggttaccctacgttcccgtcccgttacccctcccgtttacccc

SEQ ID NO: 412034 - DNA, 757 bp, Homo sapiens
  misc_feature: GZ8MTXP02IRTLP.52.41.D08.1.454.CMB.2.raw
  modified_base (231)..(231): a, c, t, g, unknown or other
tcagcgcagtacgaccacgaccggtgctcgatttagtcacgcgagaaagggaaaggggggtagagaagacaggactcaggacaatctccagcatggccagcttccctctcctcctcaccctcctcactcactgtgcagggtcctgggcccagtctgtgctgactcagccacctcagcgtctcgggaccccgtcagagggtcaccatctcttgttctggaggcgctccaacntcggaggaatactgtgaactggtaccagcaactccagggaccgcccccagacctcctcacttctttacgtcaataactcacgccggtccctaccgacggggtcccctggaacccgtattcctcgtcggtctaccaacgttccctcggcctacctcgacgtccccttaccgttcgggaccctaagtccgtagggttccggggaccttcccgtacggttacccgttggaacccggtaacgttgggaacggttcccgttagttaaacgttttaacctttcgttaacggtcgtaccgttaaaaccgggtttcggggtaattacgggtaaccgtacgtacccggttagtaaacgttcgggggtccggtttaggggttccgggtacggggacgggtaaccgtaaaacggttccgtttaccgggtttcgtacggggttaccaacggtacccgtaacgggtcccgttacccggcccccgttcgggtaccctaccgttcccgttacccggtttaccccccttccctttacccccg

SEQ ID NO: 412035 - DNA, 681 bp, Homo sapiens
  misc_feature: GZ8MTXP02J1DAT.52.41.D08.1.454.CMB.2.raw
  modified_base (195)..(195): a, c, t, g, unknown or other
  modified_base (230)..(230): a, c, t, g, unknown or other
tcagcgcagtacgaccacgaccggtgctcgatttagtcacgcgagaaagggaaaggggggtagagaagacaggactcaggacaatctccagcatggccagcttccctctcctcctcaccctcctcactcactgtgcagggtcctgggcccagtctgtgctgactcagccaccctcagcgtctcgggacccccgtnagagggtcaccatctcttgtctggagcgctccaangtcggaggatctgtgaactggtacagcaactccgaggaccgccccagactcctacgattacttagtcataactcacgccggccctcggtacggggtccctcggacccgtatttcctcgttacggccctaccgtaagtcccgttacggccacccgtcgacgtccccttctcgggacctacgtcgacggttcgggccttaccgaggtccgtagaccggtagttacggaacggtcctaggtacttacgttacgtgttacgtacctagggtttgggactacggtcacggtcctaggtaacgtcgggggttacgtcggggttcgggacggtaacgggtaaccgtagttacccggttaacggtcggtacgggtaccacgggaccccgtaacgtcccgttacccggccccgtacggttcctacccgttcccgtcccggttacccgtccccgttaaccg

SEQ ID NO: 412036 - DNA, 564 bp, Homo sapiens
  misc_feature: GZ8MTXP01EPYFB.17.26.C04.1.454.CMB.2.raw
  modified_base (344)..(344): a, c, t, g, unknown or other
  modified_base (393)..(393): a, c, t, g, unknown or other
tcagcgtagactagcacgaccggtgctcgatttagtctagcgactttgggtttggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattagcagctatttaaattggatcagcaagaaaccagggaaagcccctaagctcctgatctttgctgcatccagtttgcaaaggtcggggtccttcgaaggttcagtggcaagtgntcgtgggacagtatttcactctcacatcagcagtctgcaactgaaagtntttagactaaactttactacttagtacaaactagtaacgtttaacaaacttacccctcggccttcgtaaccgtttcgggcgggttacggggaaccgttaaggggtacgaaggaacttccgaaaaaccggtaactgggttaacgcgttacggcctaacccgttaagttcccg

SEQ ID NO: 412037 - DNA, 525 bp, Homo sapiens
  misc_feature: GZ8MTXP01EAPWL.17.26.C04.1.454.CMB.2.raw
  modified_base (271)..(271): a, c, t, g, unknown or other
  modified_base (432)..(432): a, c, t, g, unknown or other
  modified_base (438)..(438): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacttgccgggcaagtcagagcattagcagctatttaaatgtatcagcagaaaccaggaaancccctaagctcctgatctttgctgctatcctagtttgacgtaaaggtcggggtacccccttacgaaaggttcaggttggacaaggtgggatcgtggggacagtatttcactctacaccatcagcagtctgacaactgaagtatttgactaacttactactntacaanagtaattacactaccctgtcctctaacgtttcggacggtaggaccgaagggtggaagcacaaacgactgtcggcttgtccaacgtaa

SEQ ID NO: 412038 - DNA, 672 bp, Homo sapiens
  misc_feature: GZ8MTXP01EPDF5.17.26.C04.1.454.CMB.2.raw
  modified_base (197)..(197): a, c, t, g, unknown or other
  modified_base (221)..(221): a, c, t, g, unknown or other
  modified_base (271)..(271): a, c, t, g, unknown or other
  modified_base (283)..(283): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcattgccgggnaagtcagagcattagcagctattaaatggtatcagcagaaacaggaaacncccctaagctcngatctttgctgctatccgtagtttgacgtaaaaggttcgggggttacccccctttacgtaaagggtttccaaggttcgggaactaagggttggggtaacttcgggtagggggaacctaaggttacttttaccaacttccttacaaccctaataccaaggctaagttccttacgacctaaacccgtaggtaaacgttaattttacggaacgttaaacttttaacttaacttacggttaaccaaacctaggtaacgtttaaacaaaccgttacccctacggtctaccgtaacggttttccgggacgggtaacggggaaccgaaagggttacgggaacggattaaccgaaacggtaaccgtggttacggcggttacgaaccgttaacgtaac

SEQ ID NO: 412039 - DNA, 500 bp, Homo sapiens
  misc_feature: GZ8MTXP01CO3YA.17.26.C04.1.454.CMB.2.raw
  modified_base (340)..(340): a, c, t, g, unknown or other
  modified_base (494)..(494): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggatcagcagaaaccagggaaagcccctaagctcctgatctttgctgcatccagtttgcaaagtggggtccttcaaggttcagtgcaagtggntctgggacagatttcactctcaccatcagcagtctgcaacctgaagtattttgactaactttactactgtacaacagacgttacaactacccctcggctcactttcgggcggttagggaccaagggtggagagttcaaacgaactgtggctgcnccaatc

SEQ ID NO: 412040 - DNA, 495 bp, Homo sapiens
  misc_feature: GZ8MTXP01AOXM3.17.26.C04.1.454.CMB.2.raw
  modified_base (271)..(271): a, c, t, g, unknown or other
  modified_base (325)..(325): a, c, t, g, unknown or other
  modified_base (467)..(467): a, c, t, g, unknown or other
tcagcgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccaggaaancccctaagctcctgatctttgctgcatccagtttgcaaagtggggtcccccttnaaggttcagtggcagtggatcgtgggacagatttcactctcaccatcagcagtctgcaactgaagattttgctaacttactactgtacaacagattacaactaccctgctcaacgtttcggcggagggaccaaagggtgagnttacaaacgactgtggcttgcaacctaa

SEQ ID NO: 412041 - DNA, 510 bp, Homo sapiens
  misc_feature: GZ8MTXP01DYW1N.17.26.C04.1.454.CMB.2.raw
  modified_base (272)..(272): a, c, t, g, unknown or other
  modified_base (477)..(477): a, c, t, g, unknown or other
  modified_base (493)..(493): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccaggaaancccctaaagctctgatctttgctgcatccagtttgacaaagtcgggtcccccttgaaggttcagtggcagtggatcgtgggacagatttcactctcaccatcagcagtctgcaactgaagtattttagtaactttactactgtacaaacagtattaacaaactcccctggctcgacgtttcggcggttagggaccaagggtgganagttcaaaacgaatgnggctgactaaccaattc

SEQ ID NO: 412042 - DNA, 523 bp, Homo sapiens
  misc_feature: GZ8MTXP01A7ZGI.17.26.C04.1.454.CMB.2.raw
  modified_base (324)..(324): a, c, t, g, unknown or other
  modified_base (353)..(353): a, c, t, g, unknown or other
  modified_base (370)..(370): a, c, t, g, unknown or other
  modified_base (375)..(375): a, c, t, g, unknown or other
tcagcgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccaggaaacgcccctaaagctctgatcttgctgcatccagtttgcaaagtggggtccccttnaaggttcagtgcagtgatcgtgggacagnttcactctcacatcagnagtcngcaactgaagtattttgactaactttactaactgtacaacagtaagtttaacaacgtacccctcggctcgtaacgtttcggacgggtaacgggacccgaaagggtggaaggacacgaaaaccgatggtcggcttcggtcaaccgtaag

SEQ ID NO: 412043 - DNA, 506 bp, Homo sapiens
  misc_feature: GZ8MTXP01CFZ1K.17.26.C04.1.454.CMB.2.raw
  modified_base (271)..(271): a, c, t, g, unknown or other
  modified_base (323)..(323): a, c, t, g, unknown or other
tcagcgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccaggaaancccctaagctctgatcttgctgcatccagtttgacaaagtcgggtccccttnaaggttcagtggacagtggatcgtgggacagatttcactctcaccatcagcagtctgacaacctgaagtatttgactaacttactactgtacaaactagtattaaccaatacccctggctctaacgtttcgggcggaagggaccgaaagggtgagattcaaagactgtaggcttgcaacgtaa

SEQ ID NO: 412044 - DNA, 583 bp, Homo sapiens
  misc_feature: GZ8MTXP01EMYW0.17.26.C04.1.454.CMB.2.raw
  modified_base (198)..(198): a, c, t, g, unknown or other
  modified_base (222)..(222): a, c, t, g, unknown or other
  modified_base (277)..(277): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacttgccggnaagtcagagcattagcagctaatttaaatggtatcagcaagaaaccagggaaacncccctaaagctcctgatctttgctgcatccagtttgactaaaggtcggggtccccttgaaggttcagtggcagtggatcgtgggacagtactttcactctcaccatcagctagtctgacaactgaagtatttgactaacttactactagtacaaactagtacgttaaccaacttacccctcggtaccttccgtaacgttttccggggacgggtaacgggttaacccgaaaggggttaggaacggttaacttaccgaaaacggtaccgttgggttacgggccttacggaacccgttaaccgttaacg

SEQ ID NO: 412045 - DNA, 505 bp, Homo sapiens
  misc_feature: GZ8MTXP01A48BZ.17.26.C04.1.454.CMB.2.raw
  modified_base (272)..(272): a, c, t, g, unknown or other
  modified_base (329)..(329): a, c, t, g, unknown or other
  modified_base (477)..(477): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcatagcagctattaaatggtatcagcagaaaccaggaaacncccctaaagctcctgatctttgctgcatccagtttgactaaagtggggtcccccttnaaggtcagtgcagtgatctgggacagtatttcactctcaccatcagcagtctgacaactgaatattttgactaacttactatgtacaacagtacttacaactacccctggtcctcgtaacgttcgggcggacggaccgaaggtggagnttacgaaagactgtggcttgcaacctaa

SEQ ID NO: 412046 - DNA, 574 bp, Homo sapiens
  misc_feature: GZ8MTXP01EC84Q.17.26.C04.1.454.CMB.2.raw
  modified_base (274)..(274): a, c, t, g, unknown or other
  modified_base (310)..(310): a, c, t, g, unknown or other
  modified_base (329)..(329): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccagggaaancccctaaagctcctgatctttgctgcatccagtttncaaagtggggtcccccttnaaggttcagtggcagtggatctgggacagatttcactctcaccatcagcagtctgcaacctgaagtattttgactaaactttactaactgtacaaactagaacgtttaacaaacttaccccctacggccttcgaacgttttccgggcgggtaacggggaacccgaaaaggggttggaaaggttaacttaccgaaaaacgtaaccgttaaggttacgggacttcggaacccgttaacccgttaacg

SEQ ID NO: 412047 - DNA, 579 bp, Homo sapiens
  misc_feature: GZ8MTXP01DQYZA.17.26.C04.1.454.CMB.2.raw
  modified_base (197)..(197): a, c, t, g, unknown or other
  modified_base (222)..(222): a, c, t, g, unknown or other
  modified_base (277)..(277): a, c, t, g, unknown or other
  modified_base (291)..(291): a, c, t, g, unknown or other
  modified_base (388)..(388): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcattagcagctatttaaatggtatcagacaagaaaccagggaaacncccctaaagctccngatctttgctgctatccagtttgacgtaaaggtcggggtacccccttcgaaggttcagtggcagtggatcgtgggacagtattcactctcacatcancagtctgacaactgaagttatttcgactaactttactactgtacaactagtacgttaaaccaacgttcccctacggtccttcgtaaccgtttcgggacgggtaaacggggaaccgtaaaggggtacggaacgttacgttaaaccgaaaacggtaaccgtggttacgggcttacgggccttaaccgttaacg

SEQ ID NO: 412048 - DNA, 574 bp, Homo sapiens
  misc_feature: GZ8MTXP01CX4RT.17.26.C04.1.454.CMB.2.raw
  modified_base (220)..(220): a, c, t, g, unknown or other
  modified_base (271)..(271): a, c, t, g, unknown or other
  modified_base (345)..(345): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagctattaaattggatcagcagaaaccaggaaacnccctaagctcctgatctttgctgcatccagtttgacaaaggtcgggtccttcgaaggttcagtggcaaggtggntcgtagggactagatttcactctacacatcagcagtctgactaaccgtgaacgtatttacgactaactttactaacttcgtaacaaactagtaacgtttaaccaaacttaccccgtcggtaccttaccgtaaccgtttcggggacgggacggggtaacccgaaagggttacggaagttaacgttacgaaaacgtaactaggtcggactcgacctaaccgttaagttccg

SEQ ID NO: 412049 - DNA, 509 bp, Homo sapiens
  misc_feature: GZ8MTXP01CEZJP.17.26.C04.1.454.CMB.2.raw
  modified_base (328)..(328): a, c, t, g, unknown or other
tcagcgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccagggaaagcccctaaagctcctgatctttgctgcatccagtttgcaaagtggggtcccccttnaaggttcagtggcagtggatcgtgggacagatttcactctcaccatcagcagtctgcaaccttgaaagtattttgactaaactttactactgtacaaactagaattacaatacccctggcttctaactttcgggcggagggacctaaagggtgagattcaaagactgagcttgcaacctaa

SEQ ID NO: 412050 - DNA, 535 bp, Homo sapiens
  misc_feature: GZ8MTXP01C4LUX.17.26.C04.1.454.CMB.2.raw
  modified_base (272)..(272): a, c, t, g, unknown or other
tcagcgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccagggaaancccctaaagctcctgatctttgctgcatccagtttgcaaagtcggggtcccccttgaaggttcagtggacagtggatcgtgggacagatttcactctcaccatcagcagtctgcacctagaagtatttgactaaacttactactgtacaaacagtacgttaacaactacccctcggccttcaaccgtttcgggacgggacgggaaccgtaaagggtggaacggattacgaaaaccggtaatcgtaggccttagccaacgtaac

SEQ ID NO: 412051 - DNA, 530 bp, Homo sapiens
  misc_feature: GZ8MTXP01B65L5.17.26.C04.1.454.CMB.2.raw
  modified_base (271)..(271): a, c, t, g, unknown or other
  modified_base (495)..(495): a, c, t, g, unknown or other
  modified_base (530)..(530): a, c, t, g, unknown or other
tcagcgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggcaagtcagagcattagcagctattaaatggtatcagcagaaaccagggaaancccctaaagctcctgatctttgctgcatccagtttgacaaagtggggtcccccttgaaggttcagtggacagtggatcgtgggacagattcactctcaccatcagcagtctgacaacctgaagtattttgactaaactttaactactagttcaaacagaattaaccaatacccctcggcctcgaacgtttcggacggtagggaccgaaagggtggaacgttaanaacgaaagtacgtggtacgtcttacgaaccaactn

SEQ ID NO: 412052 - DNA, 563 bp, Homo sapiens
  misc_feature: GZ8MTXP01C1IN2.17.26.C04.1.454.CMB.2.raw
  modified_base (276)..(276): a, c, t, g, unknown or other
  modified_base (409)..(409): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggcaagtcagagcattagcagctaatttaaatggtatcagacaagaaaccagggaaancccctaaagctcctgactctttgctgcatccagtttgacaaagtcggggtcccccttgaaggttcagtggacagtggatcgtagggactagtacttcactctcacatcagcagtctacgcaacttagaaagtnttttcgaactaactttactactagtacaaacgtagtaattaccaactaccccctggtccttcgtaaccgtttcgggacgggtaagggaccgtaaagggcggaaggttacttacgaaaaccgtagtcggtacggcttacggaaccttaacgtaac

SEQ ID NO: 412053 - DNA, 536 bp, Homo sapiens
  misc_feature: GZ8MTXP01DGJOZ.17.26.C04.1.454.CMB.2.raw
  modified_base (222)..(222): a, c, t, g, unknown or other
  modified_base (278)..(278): a, c, t, g, unknown or other
  modified_base (504)..(504): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagctaatttaaatggtatcagacaagaaaccagggaaacncccctaaagctcctgatctttgctgctatcctagtttgactaaaggtcggggtacccccttagaaggtttcaggtggactaaggtggaatcgtaggggaactagtatttcactctcacctatcagcagtctagacaactgtaatatttcgactaacttactactgtacaacagtataacactccctgctctaacgttcggacggtacggacgtaagggtgaagttnttaacgaaacgacgtggtgcttgcaacctaag

SEQ ID NO: 412054 - DNA, 533 bp, Homo sapiens
  misc_feature: GZ8MTXP01EHUXO.17.26.C04.1.454.CMB.2.raw
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattagcagctatttaaatggtatcagacaagaaaccagggaaacgcccctaaagctcctgatcttgctgcatcctagtttgacgaaaggtcggggttacccccttcgtaaaggtttcaggttggacgaagtggatcgtggggacagtattcactctcacatcagcagtctgacaacctgtaagtattttgactaacttactactgtacaacagtagtaacactaccctcgctctaacgttcggcggagggaccaagggtcgagcgttacgaaacgtactggtcgacttgcttaaccgtaa

SEQ ID NO: 412055 - DNA, 591 bp, Homo sapiens
  misc_feature: GZ8MTXP01C5BZF.17.26.C04.1.454.CMB.2.raw
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattagcagcttatttaaatggtatcagacaagaaaccgaggaaacacccctaaagcctcctgacttctttgctgctactcctagtttgacgtaaagttcgggggttccccccttacgtaaggtttcaggtggacagtggatcgtgggacagatttcactctcaccatcagcagtctgaccaacgtagaagtattttcgacttaaacttactactcgtacaaacgagtaacgttaacctaacctaccccgtcggccttcgtaaccggtttccggggacgggtaacggggaaccgtaaagggtcgggaaagttcgttaacgaaaacgtaacgttggtacgggcttacggccgaaccgtaacg

SEQ ID NO: 412056 - DNA, 544 bp, Homo sapiens
  misc_feature: GZ8MTXP01C2W3V.17.26.C04.1.454.CMB.2.raw
  modified_base (272)..(272): a, c, t, g, unknown or other
  modified_base (342)..(342): a, c, t, g, unknown or other
  modified_base (509)..(509): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgctgggcaagtcagagcatagcagctaattaaatgtatcagcaagaaaccaggaaacncccctaaagctcctgattcttgctgcatccagtttgactaaaggtccggggtccttagaagttcagtgcnggtgatcgtagggactagtattcacttcacaccatcagctagtctagacaactggaaattatttaggacttaaacttactaactagtacaaactagtaacttaccaaaccttccccgcgtcttaacgtacgtttcggggacggacgggtaaccaagggttcggaaanacgtaacgaaacgtcgtggcgactaacgcctaacg

SEQ ID NO: 412057 - DNA, 556 bp, Homo sapiens
  misc_feature: GZ8MTXP01BVI8V.17.26.C04.1.454.CMB.2.raw
  modified_base (277)..(277): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattagcagctaatttaaatggtatcagacaagaaaccagggaaacncccctaaagctcctgatcttgctgctatcctagtttgactaaaggtcggggtacccccttgaaaggttcaggtggacaggtggatcgtgggacagtattcactctacaccatcagcagtcctgaccaactagtaagtatttgactaactttactaactgtacaaactagtacgttaaactaactacccctgacctctaacgtttcgggacggtaagggaccgtaaagggtggaacgattaaccgaaagtacgtgtacggcttacgaacttaacccgtaa

SEQ ID NO: 412058 - DNA, 545 bp, Homo sapiens
  misc_feature: GZ8MTXP01A7LZS.17.26.C04.1.454.CMB.2.raw
  modified_base (278)..(278): a, c, t, g, unknown or other
  modified_base (448)..(448): a, c, t, g, unknown or other
  modified_base (545)..(545): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagtctatttaaatggtatcagacaagaaaccagggaaacncccctaagctcctgatctttgctgacatccagtttcacgtaaaggtcggggtcccccttagaaggttcaggtcggaacaggtgactcgtagggactagtactttcactctacaccatcagcagtctagacaactgtaatatttcgacttaacttactactgtaacaaacngtaactaaccaactaccccgtggtccttcgtaaccgttcgggcggtaagggaccgaagggtcgagcttaacgaacgtacgtgtcgcttgccaacgtn

SEQ ID NO: 412059 - DNA, 722 bp, Homo sapiens
  misc_feature: GZ8MTXP01D1MKT.17.26.C04.1.454.CMB.2.raw
  modified_base (197)..(197): a, c, t, g, unknown or other
  modified_base (220)..(220): a, c, t, g, unknown or other
  modified_base (284)..(284): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatcgacccagtctccatcctccctgtctgcatctggtagganacagatcacatcacttggccggnaagtcagagcattagcagtacttaatttaaattggtatcagacaaagaaaccgaagggaaaccncccctaagcctcctgtattctttgctgctactcctagtttgacgtaaaggtcggggttaccttacgaaggttcgaggtcggactaagggtggtaacgtcggtacggggaactaaggtactttaccacttaccctacaaccctatacgaggacctaacggttcctacggaacctaaaccgtaggtaaacgtttacgtttttacgaaccctttaaaccgttttaaccgttaacgtttaacgtaaacctaaaacgtaaacggttaaccgtttaaaaccgtaaaccctttacccccgtcgggttaccttaaccgttaaccgggtttaaccgggggaacgggttaaacggggaacccgttaaaggggttacggaagttaacgttaaccgaaaacggtaacgtacgggtaacgggttacccgacgacctaaccgttcgtttccg

SEQ ID NO: 412060 - DNA, 537 bp, Homo sapiens
  misc_feature: GZ8MTXP01BT9S2.17.26.C04.1.454.CMB.2.raw
  modified_base (222)..(222): a, c, t, g, unknown or other
  modified_base (274)..(274): a, c, t, g, unknown or other
  modified_base (502)..(502): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagctattaaatggtatcagcagaaaccagggaaacncccctaagctcctgatctttgctgctatccagtttgactaaaggtcgggtcccccttgaaggttcagtggacagtgatcgtgggacagtattcactctcaccatcagcagtctgcaactgtaagtatttgactaacttacttaactcgtacaaacacgtaacgttaaccaactaccccgtcggccttcgtaacgtttcgggacgggtagggaccgaaagggtggaagnttaccaaagtaccgtggtaggcttcgcgaactaac

SEQ ID NO: 412061 - DNA, 585 bp, Homo sapiens
  misc_feature: GZ8MTXP01AUY65.17.26.C04.1.454.CMB.2.raw
  modified_base (377)..(377): a, c, t, g, unknown or other
  modified_base (466)..(466): a, c, t, g, unknown or other
  modified_base (482)..(482): a, c, t, g, unknown or other
  modified_base (485)..(485): a, c, t, g, unknown or other
  modified_base (495)..(495): a, c, t, g, unknown or other
  modified_base (502)..(502): a, c, t, g, unknown or other
tcagcgtagactagcacgaccggtgctcgatttagtctagcgactttgggtttggggtacgatttgatgttacctgatgcttagaggcttttcctggaagcagggcatttgttgcttcagcaccgtagtcgcccgtcatcacgcctcagccttgattttccggatttgcctaggaaaaccagcctacacgcttaaaccgggacaaccgtcgcccggcaacatagccttctccgtcccccttcgcagtaacaccaagtacagatattaacctgttcccatcgactacgcctttcggcctcgctagggcactcacctgccccgattaacgtggacaggaacccttggtcttccggcgacggcgggtcttttcgaccgtntttactcgttacttatcgtcagcattcgcacttctgactaccctccagtcatcgcctcacagcacaccttcacaggcttacagaacccncctacccaccaacacncanacgcgtcgcncgccgcncgtcgtcgtcgtcgttacgttcggttccgttcccgttccttccgttcccttccctcctctctcgtacgttacgtcgttcgtcg

SEQ ID NO: 412062 - DNA, 526 bp, Homo sapiens
  misc_feature: GZ8MTXP01CLW5L.17.26.C04.1.454.CMB.2.raw
  modified_base (272)..(272): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaatggtatcagcagaaaccaggaaacncccctaagctcctgatctttgctgctatcctagtttgacgtaaaggtcggggtaccccccttgaaggtttcaggtggactagtggatcgtgggactagtatttcacttctacacatcagcagtctgacaactgaatatttgactaacttatactagtacaacagtatacactaccctcgctctaacgttcggcggtagggaccgtaagggtcgaagcttacgaaacgtacgtaaggtggcttcgcaaccgtaag

SEQ ID NO: 412063 - DNA, 569 bp, Homo sapiens
  misc_feature: GZ8MTXP01C2T6B.17.26.C04.1.454.CMB.2.raw
  modified_base (221)..(221): a, c, t, g, unknown or other
  modified_base (272)..(272): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggnaagtcagagcattagcagctattaaatgtatcagacaagaaaccaggaacncccctaagctctgatctttgctgctatcctagtttgacgtaaaggtcgggtacccccttgaaggttcagtggacagtggatcgtagggactagtacttcactctacacatcagcagtctcgactaaccgtagtaacgttattttacgaacttaacctttaactaactagtaacaaacgaagtaacgttaaaccacttaaccccgtcggtcctacgtaaccggtttcgggacgggtaacggaccgtaaagggtaggagacttaacgaaacgtagttcggacggcttacgccgaacctg

SEQ ID NO: 412064 - DNA, 616 bp, Homo sapiens
  misc_feature: GZ8MTXP01EEYVQ.17.26.C04.1.454.CMB.2.raw
  modified_base (221)..(221): a, c, t, g, unknown or other
  modified_base (283)..(283): a, c, t, g, unknown or other
  modified_base (386)..(386): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccgggnaagtcagagcattagcagacttaatttaaattggtatcagacaaagaaaccgaagggaaacncccctaaagctccgtagtattctttgctgctatacctaggtttagacgtaaaggtcgggggttacccttaccgtaaggttcgaggtcggacgtaagggtaggngtcggtaggggactagtactttcacttctaccactatcgaagcaagtctgactaacgtgaagtatttgaacttaacgttactatcgtacaaacgtagaacgttaacaaacctccccgtggccttactaccgggtttcgggacgggaaacgggtaccgaaaggggtggaacgttaacgttaacgaaaacggaacgttggtaacggctcggacctaaccgttaagtttcccg

SEQ ID NO: 412065 - DNA, 481 bp, Homo sapiens
  misc_feature: GZ8MTXP01AUQBP.17.26.C04.1.454.CMB.2.raw
  modified_base (271)..(271): a, c, t, g, unknown or other
  modified_base (323)..(323): a, c, t, g, unknown or other
  modified_base (459)..(459): a, c, t, g, unknown or other
  modified_base (474)..(474): a, c, t, g, unknown or other
  modified_base (476)..(476): a, c, t, g, unknown or other
  modified_base (478)..(478): a, c, t, g, unknown or other
  modified_base (481)..(481): a, c, t, g, unknown or other
tcagcgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccaggaaancccctaagctcctgatctttgctgcatccagtttgcaaagtgggtccccttnagttcagtgcagtggatcgtgggacagatttcactctcaccatcagcagtctgcaacctgaagattttgactaacttactactgtacaacagattacaatacccctgctcaacttcggcggacggacaaggtgagnttcaacgatgtggcncncnctn

SEQ ID NO: 412066 - DNA, 608 bp, Homo sapiens
  misc_feature: GZ8MTXP01BAL0O.17.26.C04.1.454.CMB.2.raw
  modified_base (426)..(426): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattagcagctatttaaatggtatcagacaagaaaccgagggaaacacccctaaagctcctgattcttgctgcatcctagtttgacgtaaaggtcggggttcccccttacgtaaaggtttcaggtggacgtaagggtggacgtcgtaggggactaggtactttcactctcacccatcagcagtctgacctaacngtaagttattttagaccttaaactttactaacttcgtaacaaacgtacgtaacgttaacaaccgttaccccttcggaccttcgtaacggtttcccgggaggggtaaccgggaaccgtaagggtggggaacacgttaaccgaaaacgtacgttgggtacgggcttacggaaccaacccgttaa

SEQ ID NO: 412067 - DNA, 605 bp, Homo sapiens
  misc_feature: GZ8MTXP01DZ0DL.17.26.C04.1.454.CMB.2.raw
  modified_base (277)..(277): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctaatttaaatggtatcagcaagaaaccagggaaacncccctaaagctcctagactctttgctgctatcctagtttcgacgtaaaggtcggggttccccccttagaaaggtttcgaggttcggaactaggttggggattccggtaggggtacaggttactttcaaccttctacacctatcagctaaggtctagacctaaacgtagtaaagttacttttacgactaaactttaactaacttacgtaacaaacgtagtaacgttaaccaactaccccgtggccttcgaacgtttcgggacgggtacggaaccgtaagggtaggagttacttacgaaaacggactggtacggcttagccaacgtaacg

SEQ ID NO: 412068 - DNA, 608 bp, Homo sapiens
  misc_feature: GZ8MTXP01CAUQB.17.26.C04.1.454.CMB.2.raw
  modified_base (222)..(222): a, c, t, g, unknown or other
  modified_base (278)..(278): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagtctaatttaaatggtatcagcaagaaaccagggaaacncccctaagctctgatctttgctgcatcctagtttcgactaaaggtcggggtccccccttagaaggtttcaggtggactaggtggatcgtagggacagtactttcacttctcaccatcagcagtctgacaactgaagtattttgacgttaactttactactacgtacaaacgtagtaacgtttaaccaacgttaccccgtaggtccttacgtaaccgttttcgggaccggggtaaacgggttacccgtaaaggggttggaaacggttacttaaccgaaaaccggtaaccgttgggttacgggaaccttcggaacccgttaacccgttaacg

SEQ ID NO: 412069 - DNA, 597 bp, Homo sapiens
  misc_feature: GZ8MTXP01BGD6I.17.26.C04.1.454.CMB.2.raw
  modified_base (198)..(198): a, c, t, g, unknown or other
  modified_base (223)..(223): a, c, t, g, unknown or other
  modified_base (283)..(283): a, c, t, g, unknown or other
  modified_base (402)..(402): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacttgccgggnaagtcagagcattagcagtacttaatttaaatggtatcagacaagaaaccgagggaaacncccctaaagctacctgattctttgctgctattcctagtttgacgtaaaggtcgggtacccccttagaagggttcaggtggaactaggtggatcgtagggacagtacttcactctacacntcagctagtctagacctaacgtagtaagttatttacgaccttaaactttactactacgtacaaacgtaagtacgttaaccaacgttacccctcggtccttcgtaacggtttccgggacgggtaacgggaaccgtaaggggtagaacgacgttaaccgaacggtaacgtcggtacggcttacggaaccttccgtaa

SEQ ID NO: 412070 - DNA, 558 bp, Homo sapiens
  misc_feature: GZ8MTXP01BPS11.17.26.C04.1.454.CMB.2.raw
  modified_base (408)..(408): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctaatttaaatggtatcagcaagaaaccagggaacgcccctaagctcctgatctttgctgcatcctagtttgactaaaggtcggggtcccttacgaaggttcaggtggcaaggtggaatcgtaggggacagtatttcactctcaccatcagcagtctgacaactgaagtntttagactaacgttactactgtacaacgtagtacgttaacaacttaccccgtggaccttcgtacgtttcggggacggttacgggaaccgaagggtcggaagttacgttacgaaacggtaatggtaacggctacgctaaccgttaattccg

SEQ ID NO: 412071 - DNA, 604 bp, Homo sapiens
  misc_feature: GZ8MTXP01DHRUQ.17.26.C04.1.454.CMB.2.raw
  modified_base (218)..(218): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccggnaaagtcagagcattagcagctattaaattggatcagcaagaaaccgaggaaacgccctaagctcctgattctttgctgctattccagttttgacgtaaaggttcgggggtacccttacgtaaagggttcaggtcggactaagggtggaattcggtaggggactagtatttcactctacacatcagctagtctgacaaccgtagaaagtatttagaccttaaacgtttactaacttacgtacaaactaggtacttaacaaccttaaccccgtggtacctaccgtaacgtttcgggaccggggttaacgggaaaccttaaggggtaggaacgaacgttacgaaaacggtaacgttaggtcggtacgtacggactaaccgttaattccg

SEQ ID NO: 412072 - DNA, 546 bp, Homo sapiens
  misc_feature: GZ8MTXP01D6VGU.17.26.C04.1.454.CMB.2.raw
  modified_base (197)..(197): a, c, t, g, unknown or other
  modified_base (221)..(221): a, c, t, g, unknown or other
  modified_base (272)..(272): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccggnaagtcagagcatagcagctaattaaatggatcagacagaaaccaggaaacncccctaagctctgattcttgctgctatcctagtttcgacgtaaaggttcggggtaccccttagaaggttcaggtggactaggtggatcgtagggactagtacttcactctacacatcagctagtctagactaaacgtgaaattatttcgacttaaacttactactagtacaaacgtagtaacttaaccaactccccgtgtcctcgtaacgttcgggacggtacggacgaagggtgaagttcaacgaagtacgtggtacggcttacgccaacgtc

SEQ ID NO: 412073 - DNA, 520 bp, Homo sapiens
  misc_feature: GZ8MTXP01BH9U8.17.26.C04.1.454.CMB.2.raw
  modified_base (195)..(195): a, c, t, g, unknown or other
  modified_base (219)..(219): a, c, t, g, unknown or other
  modified_base (269)..(269): a, c, t, g, unknown or other
  modified_base (520)..(520): a, c, t, g, unknown or other
tcagcgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacttgccggnaagtcagagcattagcagctattaaatggtatcagacagaaacaggaaancccctaaagctcctgattctttgctgctatcctagtttcgactaaaggtcggggttcccccttacgaaaggttcaggtggcaggtgatcgtgggacagtattcactctcaccatcagctagtctgactaacctgtaaagtattttagactaaacttactactgtacaatagattacaactacccctgctcaacgttcggcggaggacctaaggtcggagcttacgaaactacgtgtaggcttagcaacctn

SEQ ID NO: 412074 - DNA, 642 bp, Homo sapiens
  misc_feature: GZ8MTXP01EWWIM.17.26.C04.1.454.CMB.2.raw
  modified_base (229)..(229): a, c, t, g, unknown or other
  modified_base (237)..(237): a, c, t, g, unknown or other
  modified_base (291)..(291): a, c, t, g, unknown or other
  modified_base (386)..(386): a, c, t, g, unknown or other
tcagcgtagactagcacgaccggtgctcgatttagtctagcgactttgggtttgggggagtcagtctcagtcaggacacagcatggacatgagggtccccgctcagctccgtggggctcctgctactctggctccgaggtgccagatgtgacatccagatcgacccagtcctccatccctccctgtctgcatctaggaggagacagactcaccatcacgtggccggganaagtcagnctattagctagtacttaatttaagtggatcaagacaacgaaaccgagggaaccncccctaagccttactgtacttcttgactgactactcgtagttacgacgtaaggttcggttacccctaggtagtcaggtgactagggtgactcggnggtactgttacttcactctacacatcgagctacgctacgtacctaacgtagttaagttacttactaacgtaacttacgtaactactaactaaacgtaacgtaaccttaaccaacccgttaccccgtaccgtaccgttaccgggtaaccgggtttcggggaacgggaaccgggttaacggtaaaggggtccccaaaaagggttccttaaaccggtaaacgggccttaaggggccgtacttacgtccccttaaggtcc

SEQ ID NO: 412075 - DNA, 594 bp, Homo sapiens
  misc_feature: GZ8MTXP01APXU0.17.26.C04.1.454.CMB.2.raw
  modified_base (198)..(198): a, c, t, g, unknown or other
  modified_base (222)..(222): a, c, t, g, unknown or other
  modified_base (277)..(277): a, c, t, g, unknown or other
  modified_base (401)..(401): a, c, t, g, unknown or other
  modified_base (589)..(589): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcacatcacttgccgggnaagtcagagcattagcagtctaatttaatggtatcagcaagaaaccagggaaacncccctaaagctacctgtacttctttgctgcactccgtagtttcgacgtaaaggtcgggtaccccccttagaaggttcaggtggaactaggtggatcgtagggactagtacttcactctacaccntcgagtcagttctacgacctaacgttagtaaagttactttacgaactaaactttactactagtacaaacgtacgttaacttaaccaaccgttaccccgtcgacccgttacggttcgggacgggttaacgggaccgaagggtagaacgacttaacgaaacgtaagtggtaacggctcggaccaacgttnttccg

SEQ ID NO: 412076 - DNA, 546 bp, Homo sapiens
  misc_feature: GZ8MTXP01BABWI.17.26.C04.1.454.CMB.2.raw
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgagcaagtcagagcattagcagcttaattaaatgtatcagcaagaaaccaggaaacgcccctaagctcctgatctttgctgcatcctagtttgactaaaggttcggggtcccttgaaggttcagtgcaagtgatcgtgggacagtatttcactctacacatcagcagtctgacaactgaagtattttggactaacttactactgtacaacgtagtaacgttactaacttaccccgtacggctaacgtaacgtttcgggaccggaggggaaccctaagggttacggacgttagtaacccaaagtaaccgtggtcggctcggcctaaccg

SEQ ID NO: 412077 - DNA, 548 bp, Homo sapiens
  misc_feature: GZ8MTXP01C91JR.17.26.C04.1.454.CMB.2.raw
  modified_base (276)..(276): a, c, t, g, unknown or other
  modified_base (516)..(516): a, c, t, g, unknown or other
  modified_base (541)..(541): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggcaagtcagagcattagcagctaatttaaatggtatcagacaagaaaccaggaaacncccctaagctctgactcttgctgctatccgtagtttgacgtaaaggttcggggtaccccccttagaaggttcagtggacagtggatcgtagggacagtattcactctacacatcagtcagtctagactaacctagtaagtatttagacttaactttactactagtacctaagagtacttaaccactaccccgtggacttccgtaacgtttcgggacggtaagggaccgtaagggtgacgnttacgaaagtacgtggtgcgttacncaacgtg

SEQ ID NO: 412078 - DNA, 518 bp, Homo sapiens
  misc_feature: GZ8MTXP01A9WGV.17.26.C04.1.454.CMB.2.raw
  modified_base (222)..(222): a, c, t, g, unknown or other
  modified_base (280)..(280): a, c, t, g, unknown or other
  modified_base (514)..(514): a, c, t, g, unknown or other
  modified_base (518)..(518): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccggnaagtcagagcattagcagtcttaatttaaatggtatcagacaagaaaccagggaaacncccctaagctctgatcttgctgcatcctagtttgactaaaggtcgggttccccttagaaggttcagtgacagtgatcgtgggacagtattcactctcaccatcagcagtctagacaactgaagttatttcgactaacttactactagtacaacagtactaacactacccctgctcgtaacgttcgggaggtacggacgaagggtgacgattacgaaacgagtggtggcttcgcncgtn

SEQ ID NO: 412079 - DNA, 580 bp, Homo sapiens
  misc_feature: GZ8MTXP01C0CDC.17.26.C04.1.454.CMB.2.raw
  modified_base (221)..(221): a, c, t, g, unknown or other
  modified_base (278)..(278): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggnaagtcagagcattagcagtctaatttaaatggtatcagacaagaaaccagggaaacncccctaaagctcctgattctttgctgctatcctagtttgactaaaggtcggggtcccccttagaaggttcagtggacaggtggatcgtgggacagtatttcactctacaccatcagcagtctagacaacctgaagtatttcgacttaaactttactactagtacaaacgtagtaacgttaaccaacttaccccgtcggtaccttccgtaacgtttcggggacgggtaacgggaacccgtaaaggggtcggaagacgttaacgaaacggtaactgggtacggcttacgccgttaaccgtaacg

SEQ ID NO: 412080 - DNA, 556 bp, Homo sapiens
  misc_feature: GZ8MTXP01DYA24.17.26.C04.1.454.CMB.2.raw
  modified_base (197)..(197): a, c, t, g, unknown or other
  modified_base (222)..(222): a, c, t, g, unknown or other
  modified_base (276)..(276): a, c, t, g, unknown or other
  modified_base (550)..(550): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcattagcagtctaatttaaatggatcagacagaaaccagggaaancccctaaagctcctagacttctttgcttgcatccgtagtttgactaaaggtcggggttaccccttacgaaggttcaggtcggacagttggattcgtagggacagtactttcactctacacatacagcagtctgacaactgaatatttacgactaacttactactacgtacaactagtacgttaacaacctaccctcggccttcgtaacgtttcgggacggtacggaccgtaaagggtggaagttattacgaaacgtaactggtaggcttacgcnccgtaa

SEQ ID NO: 412081 - DNA, 669 bp, Homo sapiens
  misc_feature: GZ8MTXP01BU7FL.17.26.C04.1.454.CMB.2.raw
  modified_base (223)..(223): a, c, t, g, unknown or other
  modified_base (277)..(277): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggnaagtcagagcattagcagctatttaaatggtatcagacaagaaaccaggaaacnccctaagctctgatcttgctgcatccgtagtttcgacgtaaaggttcggggttaccccccttacgtaaaggttcgaaggttggaacgtagggttgggaattccggtaggggacctaaggttactttacactctaccacctaatcagcaacgttctacgacctaaaccgtagtaaacggttatttttacgaaccttaaaacgtttacttaaccgttacggttaaacctaaaccggttaacggggttaaacctaaacccggttaaccccgttaaacgttaccggttttacgggaacccggtaacgggggaacccttaaggtaccgttaggaacgtaacgttaaccgaaaacggttacgtggttacggcgtcgaccttacctaattccgttaacg

SEQ ID NO: 412082 - DNA, 588 bp, Homo sapiens
  misc_feature: GZ8MTXP01CAYSX.17.26.C04.1.454.CMB.2.raw
  modified_base (222)..(222): a, c, t, g, unknown or other
  modified_base (276)..(276): a, c, t, g, unknown or other
  modified_base (411)..(411): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagctatttaaatggtatcagcaagaaaccagggaaacncccctaaagctcctgattctttgctgcatcctagtttgactaaaggtcggggtcccccttagaaggtttcagtggactagtggatcgtgggacagtactttcactctcacctatcagcagtctgacactgaagtntttagactaacttactactacgtacaaacgagtaacgttaccaacttaccccgtcggtccttaccgtaacgtttccggggaccgggtaaacgggttacccgtaaaggggtcggaacgttacgttaaccgaaaacggtaacgttggtacgggccttacggaaccgttaacccgttaag

SEQ ID NO: 412083 - DNA, 587 bp, Homo sapiens
  misc_feature: GZ8MTXP01AW5F4.17.26.C04.1.454.CMB.2.raw
  modified_base (277)..(277): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattagcagctattaaatggtatcagacaagaaaccagggaaacncccctaaagctcctgatctttgctgcatcctagtttcgacgtaaaggtcggggtacccccttagaaggttcaggtcggacaggtggatcgtaggggactagtactttcactctcaccatcagtcagtctcgactaaccgtagtaagttattttacgaactaactttactaactacgttaccaaacgtagtaacgtttaaccaacgttaccccgtcggtccttccgtaacgtttcggggacgggtaacgggaccgtaaaggggtggaagacgttacgaaacgtacgtggtcggcttacggccaacgtaacg

SEQ ID NO: 412084 - DNA, 531 bp, Homo sapiens
  misc_feature: GZ8MTXP01DBEI9.17.26.C04.1.454.CMB.2.raw
  modified_base (197)..(197): a, c, t, g, unknown or other
  modified_base (222)..(222): a, c, t, g, unknown or other
  modified_base (270)..(270): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcattagcagctattaaatggatcagcagaaacaggaacncccctaaagctcctgattctttgctgctatcctagtttgactaaaggtcggggtcccccttgaaggttcagtggcagtggatcgtgggacagtatttcactctcacatcagcagtctgcaactgaagtatttgactaaactttctactgtacaatagtacttaacaactaccccgtcgtctcgtaacgtttcgggacggacgggaccgtaaagggtggaacgcttaacgaaacgtacgtggtcgcgttacgccaaccgtaa

SEQ ID NO: 412085 - DNA, 516 bp, Homo sapiens
  misc_feature: GZ8MTXP01DI3XA.17.26.C04.1.454.CMB.2.raw
  modified_base (221)..(221): a, c, t, g, unknown or other
  modified_base (441)..(441): a, c, t, g, unknown or other
  modified_base (492)..(492): a, c, t, g, unknown or other
  modified_base (513)..(513): a, c, t, g, unknown or other
  modified_base (516)..(516): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggnaagtcagagcatagcagctaatttaatggtatcagacaagaaaccaggaaagcccctaaagctcctgattctttgctgcatcctagtttgacgaaaggtcggggttacccccttcgaaaggttcgagtggacagtggatcgtagggacagtatttcactctacaccatcagcagtctagacaactgaagttatttcgactaaactttctactgtacaaanagtattaacactacccctgctctaacgttggacggtaggaccagggtgagnttacaacgatgtggcagtccnctn

SEQ ID NO: 412086 - DNA, 565 bp, Homo sapiens
  misc_feature: GZ8MTXP01BP96C.17.26.C04.1.454.CMB.2.raw
  modified_base (197)..(197): a, c, t, g, unknown or other
  modified_base (222)..(222): a, c, t, g, unknown or other
  modified_base (276)..(276): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcattagcagctatttaaatggtatcagcaagaaaccagggaaacncccctaaagcctctgacttctttgctgcatccagtttgacaaaggtcgggtccccttgaaggttcagtgacagtgatcgtgggactagtatttcactctcaccagtcagctagtctagacaacctagaatatttacgactaaactttactacgtagtacaacgtagtaacttaaccaacttaccccgtcggccttcgtaaccgtttcggcggaacgggaccgtaaagggtcgaagttacttaaccgaaaacgtaccgttaaggtacgggccttaggccttaacccgtaa

SEQ ID NO: 412087 - DNA, 569 bp, Homo sapiens
  misc_feature: GZ8MTXP01DDNT6.17.26.C04.1.454.CMB.2.raw
  modified_base (197)..(197): a, c, t, g, unknown or other
  modified_base (222)..(222): a, c, t, g, unknown or other
  modified_base (284)..(284): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcaattagcagacttaatttaaatggtatcaagacaagaaaaccgagggaaacncccctaaagcctcctgattctttgctgctatcctagtttcgacgtaaaggtcgggttcccccttagaaggttcagtgactagtggatcgtgggactagtactttcactctacactatcagcagtctgacactagtaatatttcgactaacttactaactgtaacaagtagtacgtaaactaaccgtaccccgtcggaccttaccgtaacgtttcgggacgggtaacgggaaccgtaagggtgaaagcttaaccgaaaacgtacgtgtacggcttacgccaacgtc

SEQ ID NO: 412088 - DNA, 601 bp, Homo sapiens
  misc_feature: GZ8MTXP01AW5IE.17.26.C04.1.454.CMB.2.raw
  modified_base (180)..(180): a, c, t, g, unknown or other
  modified_base (384)..(384): a, c, t, g, unknown or other
tcagcgtagactagcacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaccgggacaaccgtcgcccggcaacatagccttctcccgtcccccttgcagtaacaccaagtacagaatattaacctgttccatcgactacgcctttcggcctcgccttaggggcactcaccctgccccgattaacgtggacaggaccttgctcgcgagcggtctttcaccgtctttatcgttacttatntcagcattcgctcttctgactacctccagcatcgcctcacacgacacctacccttcacacggtccttacaacgaaccgtacccttaccccgtaaccccaaacaaccgacaactaacgcgtccgacctcgcccgcacgtccgttcggtgcctagttcggttacgtcccctttcttacttcccgttcccgcctaactctcgacttaacgttcgtaaccg

SEQ ID NO: 412089 - DNA, 606 bp, Homo sapiens
  misc_feature: GZ8MTXP01CZEW4.17.26.C04.1.454.CMB.2.raw
  modified_base (220)..(220): a, c, t, g, unknown or other
  modified_base (277)..(277): a, c, t, g, unknown or other
  modified_base (357)..(357): a, c, t, g, unknown or other
  modified_base (368)..(368): a, c, t, g, unknown or other
  modified_base (587)..(587): a, c, t, g, unknown or other
tcagcgtagactagcacgaccggtgctcgatttagtctagcgactttgggtttggggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacttgccgggnaagtcagagcattagcagtcttaatttaaatggatcagcaagaaaccgagggaaacnccctaagctctgatcttgctgctatccagtttgacgtaaaggtcgggtacccttagaaggttcaggtggcaaggttcggntcgtgggaacngtacttcactctacacatcagcagtctacgactaaccgtagtaacgttatttacgaccttaaacgtttacctaacttacgttacaaaacgtagtaacttaacaaacccgttccccgtcggtacctacgtaccggtttccggggacggttaaacggggtaacccggaaagggttacggaacgacgttaaaccgaaaacggtaaccgtaggtcggcgtacncctaaccttaagtttcccg

SEQ ID NO: 412090 - DNA, 618 bp, Homo sapiens
  misc_feature: GZ8MTXP01ASA8M.17.26.C04.1.454.CMB.2.raw
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccgggcaagtcagagctattagcagtacttaatttaaatggtaatcgagacaaacggaaaccgaaggggaaacctccccgtaaagccttcctagactttcgtttgctgactacttccgtagtttgacgtaaaggttcgggtacccccttagaggttcaggtggacaggtggatcgtagggactagtacttcactctaccactatcgagctacgtctagactaaccgtagtaacgttactttacgaaccttaacttacctagtacgtaacaaacgtaggtaacttaaccaaccgttaccccgtacgtccttaccgtaacgggtttcgggacggggtaacggaccgtaagggtacgacgttacttaaccgaaacggtactggtcggcttacgcccttaactcg

SEQ ID NO: 412091 - DNA, 615 bp, Homo sapiens
  misc_feature: GZ8MTXP01CI6Q1.17.26.C04.1.454.CMB.2.raw
  modified_base (457)..(457): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattagcagtacttaatttaaatggtaatcaagacaaggaaacccgaaggggaaacctccccctaaagccttcctagacttctttgctgactactccgtagtttgacgtaaaggtcggggttacccccttaggaaggttcaggtcggaactagggtggatcgtagggacagtactttcactctacactatcgagtactagtctacgacctaacgtagtaaacttntttacgaacttaacttactaactcgtaacaacgtagtaacgttaaccaaccttccccgtgtaccttcgtaaccggttcgggacgggtaacgggaccgtaaagggtcgaacgttcttaacgaaacgtacgtcggtagcgttacgaaccttaacgtaacg

SEQ ID NO: 412092 - DNA, 578 bp, Homo sapiens
  misc_feature: GZ8MTXP01BRYQI.17.26.C04.1.454.CMB.2.raw
  modified_base (222)..(222): a, c, t, g, unknown or other
  modified_base (273)..(273): a, c, t, g, unknown or other
tcagcgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggnaagtcagagcattagcagctattaaatggtatcagcagaaaccaggaaacncccctaaagctcctgatctttgctgcattccagtttgactaaaggttcggggtaccccccttagaaggtttcaggtggacaggtgggatcgtggggactaggtatttcactctcaccatcagcagtctgcaacctgaagtatttcgactaactttacgtaactcgtacaactagtaacgttaaccaactaccccgtcggtaccttcgtaacgttttcgggcgggtaacgggacccgtaaagggtgggttaacgacgttacgaaaacggtaccgtggtacgggacttcggaaccgaaccgttaacg

SEQ ID NO: 412093 - DNA, 592 bp, Homo sapiens
  misc_feature: GZ8MTXP01DJY5Y.17.26.C04.1.454.CMB.2.raw
  modified_base (219)..(219): a, c, t, g, unknown or other
  modified_base (270)..(270): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggnaagtcagagcattagcagctattaaatggatcagcaagaaaccaggaaacnccctaagctcctgatcttgctgcatccagtttgactaaaggtggggtcccttacgaaggttcaggtgcgaagtggaatcgtggggactagtactttcactctacacatacagcagtctgcctaacctgtaatattttagacctaactttactacttagtacaaacgtacgtagttaaaccaaacctaccccgttacgggtaccttccgtacgtttaaccggggaccgggaaggggtaacccgttaaaggggtagggaacgttaacgttacgaaaaaccggtaacgtacgggtcggtactacggaccctaaccgaactttccg

SEQ ID NO: 412094 - DNA, 551 bp, Homo sapiens
  misc_feature: GZ8MTXP01BQVCP.17.26.C04.1.454.CMB.2.raw
  modified_base (276)..(276): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgaccccagtctccatccctccctgtctgcatctgtaggagacagagtcaccatcacttgccgggcaagtcagagcattagcagtctaatttaaatggatcagcaagaaaccagggaacncccaagctctgattcttgctgctactcctagtttgacgtaaaggttcggggtacccttagaaggttcgagtggcaagggtgaatcgtagggactagtactttcactctcactatcagcagtctgacacgtagaagttactttgaactaacgttacactgtacaaactgtaacttaacaaacttcccctaggtcctacgtcgttcgggacggttaacgggacagggtacggaagttacgttacaaacgtaagtggaacgctgacctaacgttgtcg

SEQ ID NO: 412095 - DNA, 585 bp, Homo sapiens
  misc_feature: GZ8MTXP01C3DBP.17.26.C04.1.454.CMB.2.raw
  modified_base (219)..(219): a, c, t, g, unknown or other
  modified_base (275)..(275): a, c, t, g, unknown or other
  modified_base (438)..(438): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtaggagacagatcaccatcacttgccggnaagtcagagcattagcagctaattaaatggtatcagacaagaaaccgagggaaacncccctaaactcctagtatctttgctgctattccagttttacgacgtaaaggttcggggtacccctttagaaagggtttcaaggttggacaagggttgggaattcggtaggggaactaggtactttcaactctacaccatcagtcagtctgacaactgaaagtntttacgactaacttactactagactaaacagtaacttaacaacgtacccctggtcctcgtaacgttcgggaacgggaggtaccgagggtacgattaacgttacgaaaacgtaacgtggtcggctcggacctaaccgttaagttcccg

SEQ ID NO: 412096 - DNA, 582 bp, Homo sapiens
  misc_feature: GZ8MTXP01D8UND.17.26.C04.1.454.CMB.2.raw
  modified_base (425)..(425): a, c, t, g, unknown or other
  modified_base (500)..(500): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgctgggacaagtcagagcattagctagtacttaattaaatggtaatcgaagacaaagaaaccgaagggaaacctccccctaagcctcctgtactttctttgctgactacttcctagtttgacgtaaggttcccgggtacccttagaaggttcaggtgacgtggtaggtatcgtgggactagtacttcactctacacatcagactagtcngacctaacgtgtaaagttatttacgacttaacttactactagtacaactagtaaacctttacaaaccgttccccnggtcctaacgtacgttcggggacgggttaggaccgtaagggttgaacttacgtaacaaacggtctggtagcctcgcgtaacc

SEQ ID NO: 412097 - DNA, 620 bp, Homo sapiens
  misc_feature: GZ8MTXP01D2DTK.17.26.C04.1.454.CMB.2.raw
  modified_base (197)..(197): a, c, t, g, unknown or other
  modified_base (230)..(230): a, c, t, g, unknown or other
  modified_base (278)..(278): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagngcattagcagctaatttaaatggtatcagacaagaaaccagggaaacncccctaaagcctcctgattctttgctgctatccgtagtttcgacgtaaaggttcggggttacccccttacgtaaaggttcaggttcggactaagggtgggattaccggtaggggacaggtactttcactctacaccatcagctagtctacgacaaccttagaagtattttacgacttaaacttactactagtaacctaactaagtacttaaacctaaccttaccccgtacggtccttccgtaacggtttccggggacgggtaacggggaccgtaaaggggtcggaaggaacttaccgaaaacggtaaccgtggtacgggcttacggccgttaacccgttaag

SEQ ID NO: 412098 - DNA, 515 bp, Homo sapiens
  misc_feature: GZ8MTXP01DJ1G1.17.26.C04.1.454.CMB.2.raw
  modified_base (268)..(268): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggatcagcagaaacaggaaancccctaagctcctgatcttgctgcatccagtttgcaaagtggggtcccttcaaggttcagtggcaagtggaatcgtgggacagtatttcactctcaccatcagcagtctgcaactgaagtatttgactaacttactactgtacaaacagagttaacaaactacccctggcctcgactttcggcggagggaccgaaggtggagacttacgaaacgaactgtaacgggctggacctaaccgaagttccg

SEQ ID NO: 412099 - DNA, 551 bp, Homo sapiens
  misc_feature: GZ8MTXP01DL2XY.17.26.C04.1.454.CMB.2.raw
  modified_base (221)..(221): a, c, t, g, unknown or other
  modified_base (277)..(277): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacttgccgggnaagtcagagcattagcagctaatttaaatggtatcagacaagaaaccagggaaacncccctaaagctctgatctttgctgcatcctagttgacgtaaaggtcgggtcccccttagaggttcagtgacagtggatcgtagggactagtactttcactctcacctatcagtcagtctgcaacgtagaagtatttgactaactttaactactgtacaacagtaacgttaaccaacttacccctgtcctcgtaacgtttcgggcgggtaacgggacgtaaagggtggaacgacgttaacgaaacgaacgtggtcggacttacgccgaaccgtaa

SEQ ID NO: 412100 - DNA, 591 bp, Homo sapiens
  misc_feature: GZ8MTXP01ETPWI.17.26.C04.1.454.CMB.2.raw
  modified_base (197)..(197): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagtctatttaaatggtatcagacaagaaaccgaggaaacgcccctaagctcctgattctttgctgctatcctagtttcgacgtaaaggtcggggtccccccttagaaaggtttcagttggactaggtggatcgtgggactagtactttcgactctcaccatcagctagtctgacaactgaatatttcgactaaactttactactcgtaacaaacgtagttaacgttaacctaaccgtaccccgttcgtccttacggtaaccgttttcggggaacgggtacgggaaccgtaaaggggtcggaacgttacttaaccgaaacgtacgtggtacggcttacgaacccttaactaacg

SEQ ID NO: 412101 - DNA, 543 bp, Homo sapiens
  misc_feature: GZ8MTXP01BF033.17.26.C04.1.454.CMB.2.raw
  modified_base (274)..(274): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccagggaaacncccctaagctcctgatctttgctgcatcctagttttgacgtaaaggtcggggtaccccctttcgaaaggttcaggtggacagtggatcgtgggacagtatttcactctcacatcagcagtctgacaacgtgaacgtatttcgactaaactttctaactgtacaacagtaacgttacaactacccctcggtcctcaacgtttcgggcggtacgggaccgaaggttggaagcgttacaaacgtacgtgtcggacttcggaaccaacgtaac

SEQ ID NO: 412102 - DNA, 624 bp, Homo sapiens
  misc_feature: GZ8MTXP01EPIHE.17.26.C04.1.454.CMB.2.raw
  modified_base (199)..(199): a, c, t, g, unknown or other
  modified_base (222)..(222): a, c, t, g, unknown or other
  modified_base (281)..(281): a, c, t, g, unknown or other
  modified_base (402)..(402): a, c, t, g, unknown or other
tcagcgtagactagcacgaccggtgctcgatttagtctagcgactttgggtttggggggagtcagtctcagtcaggacacagcatggacatgagggtccccgctcagctcctggggctcctgctactctggctccgaggtgccagatgtgacatccagatgacccagtctccatccctccctgtctgcatctgtagganacagatcacatcacttgccgggnaagtcagagcattagcagtcttaatttaaatggtatcagacaagaaaccgagggaaacncccctaagctcctgattcttgcttgctatccgtagtttgacgtaaaggttcggggtaccccccttaggtaaggttcaggtggactaggtggatcgtgggacagtactttcactctcacctntcagctagtctagaccaacttagaattactttcgacttaaactttactactacgtacaaacgtacgtacgttaaacctaaccgttaccccgtcggtaaccttccggtaacgtttccggggaacggggtaacggggaaacccgtagggggtaaggaacgttaacgttaaccgaaaaccggtacgttaagggtcggtacccgttacgaacccttaacgttaacg

SEQ ID NO: 412103 - DNA, 543 bp, Homo sapiens
  misc_feature: GZ8MTXP01COQT6.17.26.C04.1.454.CMB.2.raw
  modified_base (220)..(220): a, c, t, g, unknown or other
  modified_base (272)..(272): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagctattaaattggatcagcagaaaccagggaaacncccctaagctcctgatctttgctgcatccagtttgactaaaggtcggggtcccttcgaaggttcagtggctaaggtggaatcgtagggacagtatttcactctcacatcagcagtctgacaacctgaagtatttgactaacgttactactgtacaactagtacgttacaactacccctgccttcgtacgtttcgggacggacgggaccaagggtacggagacgttccgaaaacgtaacgtggtaacggctacggcctaaccgttaattccg

SEQ ID NO: 412104 - DNA, 590 bp, Homo sapiens
  misc_feature: GZ8MTXP01C6LCS.17.26.C04.1.454.CMB.2.raw
  modified_base (407)..(407): a, c, t, g, unknown or other
  modified_base (414)..(414): a, c, t, g, unknown or other
  modified_base (428)..(428): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccggcaagtcagagcattagcagtctattaaatggtatcagacagaaaccaggaaacgcccctaaagctcctgatctttgctgcatcctagtttgactaaaggttcggggttccccttacgtaaaggttcaagtggcaaggtggaattcgtaggggtacaggtatttacactctacacactcagccagttcngacaacngtaagtacttttanacgtaacttactactacgtacaaacgtacgtaactaacctaaccgtaccccgtcgtacctacgtaaccgttcgggaccgggtaacgggaaaccgtaaagggtacggaacgttaacgttaaccgaaacgtaacgtcggtacgcttacgtaaccaaccgtaacg

SEQ ID NO: 412105 - DNA, 631 bp, Homo sapiens
  misc_feature: GZ8MTXP01EAA23.17.26.C04.1.454.CMB.2.raw
  modified_base (198)..(198): a, c, t, g, unknown or other
  modified_base (284)..(284): a, c, t, g, unknown or other
  modified_base (364)..(364): a, c, t, g, unknown or other
  modified_base (373)..(373): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacttgccgagcaagtcagagcattagcagtacttaattaaattggtatcagacaaagaaaccgaagggaacncccctaagcctcctgtacttcttgctgctatcctagtttgacgtaacggttccggggtaccttagtaaggttcaggtgcnggtgatcgngggactagtactttcacttctacacatcagctagtctacgactaacgtgtaaagttcttttacgggaacctttaactttactacttacgtaaccaaacgtaagttaaacttaacctaaaccgtttaccccgtcggtaccttaaccgtacggtttccggggaacgggttaaaggggaaacccgtaaggggttacggttaacgttaaaccgttaaccggaaaacgtcgttgggtacggaccttaacgaacccgttaaccg

SEQ ID NO: 412106 - DNA, 562 bp, Homo sapiens
  misc_feature: GZ8MTXP01CUDSG.17.26.C04.1.454.CMB.2.raw
  modified_base (195)..(195): a, c, t, g, unknown or other
  modified_base (221)..(221): a, c, t, g, unknown or other
  modified_base (229)..(229): a, c, t, g, unknown or other
  modified_base (254)..(254): a, c, t, g, unknown or other
  modified_base (256)..(256): a, c, t, g, unknown or other
  modified_base (275)..(275): a, c, t, g, unknown or other
  modified_base (280)..(280): a, c, t, g, unknown or other
  modified_base (285)..(285): a, c, t, g, unknown or other
  modified_base (287)..(287): a, c, t, g, unknown or other
  modified_base (292)..(292): a, c, t, g, unknown or other
  modified_base (295)..(295): a, c, t, g, unknown or other
  modified_base (331)..(331): a, c, t, g, unknown or other
  modified_base (335)..(335): a, c, t, g, unknown or other
  modified_base (342)..(342): a, c, t, g, unknown or other
  modified_base (367)..(367): a, c, t, g, unknown or other
  modified_base (372)..(372): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtagganacagatcaccatcacttggccggganagtcaganctatagacagtattaattaagtgananagacaacgaacgaggaacncctanctctntnttctnctnactatcgtagttagacgtaggtcggtactacgagtngtgngagtgtntgagatagtacttcactctacacanacacntacgtctacgactaacgtagtaagttattacgacttaacgttactaactagtaacaagtacgtaactacctaaccgtcccgtcgtacctcgtacggttcgggaacggaacgggaacgttaagggtacgaacgttaacgttaacgaaacggttaagtacggtcgtacgtacgaacctaaccgttcgttccg

SEQ ID NO: 412107 - DNA, 537 bp, Homo sapiens
  misc_feature: GZ8MTXP01DIW1Y.17.26.C04.1.454.CMB.2.raw
  modified_base (272)..(272): a, c, t, g, unknown or other
  modified_base (525)..(525): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccaggaaancccctaaagctcctgatctttgctgcatccagtttcgactaaaggttcggggtcccccttgaaggttcagtggacagtggatcgtagggacagtatttcactctcaccatcagcagtctgacaactgaagtatttgactaacttactactgtacaaactagtaattaaccaacttaccccgtggtcctctaacgtttcggacggtacgggaccgtaaagggtgaacgacttaacgaaacgtaactggtcggcncgtcaacctaag

SEQ ID NO: 412108 - DNA, 669 bp, Homo sapiens
  misc_feature: GZ8MTXP01A3NBW.17.26.C04.1.454.CMB.2.raw
  modified_base (222)..(222): a, c, t, g, unknown or other
  modified_base (279)..(279): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccggganaagtcagagcattagcagtcttaatttaaatggatcagacaagaaaccgaggaaacncccctaagcctcctgtacttctttgctgctacttccgtagtttgacgtaaaggttcggggttacccttacgaagggtttcgaggtcggacgtaagggtggtaacgtcggttaggggactaaggttacttttaccgacttccctaccaacctaattaccgagacctaaggttcctacggaacctaaaccgttagtaaacgttagtttacgaaccttaaactttacgttaactacgtaacaaacgttaacgtaacgttaacctaaacccgttaccccgtcgtaccttaccgttacggttaaccggggacgggttaaacgggtaaccgaagggttacggaagttacgttacgaaacgtaacgtggtcgtacgcgacctccgttaacgtttccg

SEQ ID NO: 412109 - DNA, 564 bp, Homo sapiens
  misc_feature: GZ8MTXP01B4CYV.17.26.C04.1.454.CMB.2.raw
  modified_base (223)..(223): a, c, t, g, unknown or other
  modified_base (404)..(404): a, c, t, g, unknown or other
  modified_base (536)..(536): a, c, t, g, unknown or other
  modified_base (552)..(552): a, c, t, g, unknown or other
  modified_base (564)..(564): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttggccggnaagtcagagcattagcagctattaaatgtatcagcaagaaaccagggaaccccctaaagctcctgatctttgctgctatcctagtttgacgtaaaggttcgggggttccccccttacggaaggtttcgaggtggacaggtggatcgtaggggactagtactttcactctacacctatcagnaacgtctagacctaaccgtagaaagttattttacgaccgttaactttaactactacgtaccaaacgtaagtactttaaccaacttaccccgcggtactctaacgttcgggacgggagttaccgaaggtgagnttacaacgactgcggnttacgcaacgtn

SEQ ID NO: 412110 - DNA, 575 bp, Homo sapiens
  misc_feature: GZ8MTXP01CDV7L.17.26.C04.1.454.CMB.2.raw
  modified_base (197)..(197): a, c, t, g, unknown or other
  modified_base (222)..(222): a, c, t, g, unknown or other
  modified_base (279)..(279): a, c, t, g, unknown or other
  modified_base (420)..(420): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcattagcagtctaatttaaatggtatcagacaagaaaccagggaaacncccctaagctctgatctttgctgctatcctagtttgacgtaaaggtcggggtaccccccttagaaaggtttcagttggacaggtggatcgtagggactagtacttcactctcacatcagcagtctgacaactgaaacgttntttacgacttaacttacgtactacgtaacaacgtagtaacttaaccaccgtacccctgtaccttacgtaacggttcggggacggtaacgggaacgtaaagggtgaacgttacgttaacgaaacgtacgtcggtcggcttacgtaaccttaacgtg

SEQ ID NO: 412111 - DNA, 637 bp, Homo sapiens
  misc_feature: GZ8MTXP01EE5HF.17.26.C04.1.454.CMB.2.raw
  modified_base (199)..(199): a, c, t, g, unknown or other
  modified_base (224)..(224): a, c, t, g, unknown or other
  modified_base (397)..(397): a, c, t, g, unknown or other
  modified_base (425)..(425): a, c, t, g, unknown or other
  modified_base (628)..(628): a, c, t, g, unknown or other
tcagcgtagactagcacgaccggtgctcgatttagtctagcgacttttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacgttgccggnaagtcagagctatagcagtacttaatttaaatggtatcgaagacaacgaaaccgagggaaacctcccctaaagctcctgtacttcgttgctgacctacttccgtaggtttcgaacgtaaacgggttccgggttaccccccttaggaaggtttcgagggtcggacgtaggtggntcggtagggactagtcttcactctcacntcgacgtctacgttcagaccctaacgtagtaattattttaccgaactttaaactttactacgttacgtaacaaacgtagttaacttaaacctccgttaccccgtgtcccttacggtaaccggtttcggggaccgggtaacgggttaccgtaagggtacggaacgttcttaaacggtaacgtacgttggcggtacttcgaaccncgtttaacg

SEQ ID NO: 412112 - DNA, 551 bp, Homo sapiens
  misc_feature: GZ8MTXP01CVPBJ.17.26.C04.1.454.CMB.2.raw
  modified_base (197)..(197): a, c, t, g, unknown or other
  modified_base (276)..(276): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatcacttgccgggcaagtcagagcattagcagctaatttaaatgtatcagacaagaaaccagggaaacnccctaaagctcctgatcttgctgctatcctagtttgacgaaaggtcggggttcccccttaggaaggttcaaggtggacagtggatcgtagggacagatttcactctacacatcagcagtctgacaacctagtaagtattttagacttaacttactacctagtacaaactagtaacttacaactaccccgtcgctcgtaacgtttcgggacgggtacggaccgaaagggtcgagttattaccaaacggaacgtgtcggacttgcccaacgttaacg

SEQ ID NO: 412113 - DNA, 599 bp, Homo sapiens
  misc_feature: GZ8MTXP01B5BWI.17.26.C04.1.454.CMB.2.raw
  modified_base (223)..(223): a, c, t, g, unknown or other
  modified_base (280)..(280): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggnaagtcagagcattagcagtctaatttaaatggtatcagacaagaaaccgaggaaacncccctaaagctcctgattctttgctgctatccgtagtttgacgtaaaggtcggggttaccccccttaggaaggttcaggtcggacagtggatcgtagggacagtatttcactctacacctatcagctagtcagaccaaccttagaagttatttgaaccttacttaactactacgttaacaaccgtagtacgttaaacctaaccgttacccctcgggtaccttcgtaacggtttcggggacgggtacggggaaccgtaaagggtcggaagttacttaaccgtaaaacgtacgtggtcggtacttcgaaccgttaaccgtg

SEQ ID NO: 412114 - DNA, 534 bp, Homo sapiens
  misc_feature: GZ8MTXP01DI4NS.17.26.C04.1.454.CMB.2.raw
  modified_base (270)..(270): a, c, t, g, unknown or other
  modified_base (370)..(370): a, c, t, g, unknown or other
  modified_base (527)..(527): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatgtatcagcagaaaccaggaancccctaagctctgatctttgctgcatcctagtttgcaaagtcggggtcccccttcgaaggttcagtgcagtggatcgtgggacagtatttcactctcacntcagcagtctgcaacctgaagtatttgactaacttactactgtacaactagtacgttaacaactaccccgtcggtcctcgtaacgtttccgggacggtacgggaccgtaaagggtcgggaagttattaccgaaacgtaacgtggtaggcttaggccnccgttaa

SEQ ID NO: 412115 - DNA, 576 bp, Homo sapiens
  misc_feature: GZ8MTXP01C2DOQ.17.26.C04.1.454.CMB.2.raw
  modified_base (218)..(218): a, c, t, g, unknown or other
  modified_base (275)..(275): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccggnaagtcagagcattagcagtcttaatttaaatggatcagcaagaaaccgagggaaacncccctaagctcctagatctttgctgctatccagtttgactaaaggtcgggtaccttagaaggttcagtgctaagtgaatcgtagggactgtacttcactctcacatcagctagtctacgactaaccgtagtaagttatttacgacttaaacgtttacttaactgtaaccctaagtacgtaacttaacaacctaccccgtgaccttacgtacggtttcggacgggaggaaccgttaaggtcggaagttacttcgaaaaaccgtgtcggttcggactacggttacctaaccgttaagtttccg

SEQ ID NO: 412116 - DNA, 622 bp, Homo sapiens
  misc_feature: GZ8MTXP01C8T51.17.26.C04.1.454.CMB.2.raw
  modified_base (225)..(225): a, c, t, g, unknown or other
  modified_base (287)..(287): a, c, t, g, unknown or other
tcagcgtagactagcacgaccggtgctcgatttagtctagcgactttgggtttggggggagtcagtctcagtcaggacacagcatggacatgagggtccccgctcagctcctggggctcctgctactctggctccgaggtgccagatgtgacatccagatgacccagtctccatccctcctgtctgcatctgtaggagacagagtcaccatcacttggccggganaagtcagagcaattagcagtacttaatttaaagtggtatcagacaagaaaccgagggaaacncccctaagctctgattcttgctgcctatccgtagtttgacgtaaaggttccggggttcccccttaggtaaggttcaggtggacaggtggatcgtagggactagtacttcactctacacatcagcagtctacgaccaacgtagtaagttattttacgaccttaaactttaccgtaactacgtaccaaacgtaggtaactttaaacccaccttaccccgttggtccttccgtaacgggtttccggggacgggtaacggggaacgtaaaggggtggaaacgttaacgttaaccggaaaacgtacgtcggtacgggtcttacggccgttaaccgttaag

SEQ ID NO: 412117 - DNA, 550 bp, Homo sapiens
  misc_feature: GZ8MTXP01EW422.17.26.C04.1.454.CMB.2.raw
  modified_base (328)..(328): a, c, t, g, unknown or other
  modified_base (341)..(341): a, c, t, g, unknown or other
  modified_base (378)..(378): a, c, t, g, unknown or other
  modified_base (391)..(391): a, c, t, g, unknown or other
tcagcgtagactagcacgaccggtgctcgatttagtctagcgactttgggtttggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaaagtcagagcattagcagctatttaaattggatcagcaagaaaccaggaaagcccctaagctcctgatctttgctgcatcagtttgcaaagtgggtccttcaaggttnaggtgcaagtggntcgtgggacagtatttcactctcaccatcagcagtcngacaactgaagtntttagactaacttacttactagttacaaacagtacgtttaaccaaacttccccctggtaccttcgtaaccgtttcgggacgggaaacgggtaccgaaagggtcggaagttacgttaacgaaacggtaacgtggtcgggactcgactaaccgttaatccg

SEQ ID NO: 412118 - DNA, 590 bp, Homo sapiens
  misc_feature: GZ8MTXP01A7C2J.17.26.C04.1.454.CMB.2.raw
  modified_base (198)..(198): a, c, t, g, unknown or other
  modified_base (283)..(283): a, c, t, g, unknown or other
  modified_base (393)..(393): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacttggccgggcaagtcagagcattagcagtcttaatttaaatggtatcagacaacgaaacgagggaaacncccctaagctacctgtattcttgctgctatcctagttgacgtaaggtcgggtcccccttagaggttcagtgacaggtgatcgtgggactgtacttcactctcaccatcancagtctgacctaacgtgtaagttatttcgaaccttaactttactaactcgtaactaaacgtaacgtaacgtttaacctaaaccttcccccgtaggtaccttaccgtaacggtttcgggacggggtaacgggaccgtaaagggtgaacgttacgaaccgtaaacgacgtggtacggcttacgtaaccgaacgttaacg

SEQ ID NO: 412119 - DNA, 606 bp, Homo sapiens
  misc_feature: GZ8MTXP01DKJAR.17.26.C04.1.454.CMB.2.raw
  modified_base (269)..(269): a, c, t, g, unknown or other
  modified_base (345)..(345): a, c, t, g, unknown or other
  modified_base (393)..(393): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacttgccggcaagtcagagcattagcagctattaaatggatcagcaagaaaccaggaaacncccctaagctcctgatctttgctgcattccagtttgactaaaggtcggggtcccttcgaaggttcagtgcaagtgntcgtgggacagtatttcactctcacatcagcagtctgcaactgaagtnttttagaccttaacgtttaactacttagtacctaaacgtagtacgtttaaccaaaaccgtttcccccgtacgggtaccttaccgttaaaccggttttccggggtaacggggaaacggggtaaacccgttaaagggttacgggaacgttaaacgttaccgaaaaacggtaaccgttggtcgggtaccttagggaccctaaacccgttcgttccg

SEQ ID NO: 412120 - DNA, 595 bp, Homo sapiens
  misc_feature: GZ8MTXP01ARNLN.17.26.C04.1.454.CMB.2.raw
  modified_base (223)..(223): a, c, t, g, unknown or other
  modified_base (278)..(278): a, c, t, g, unknown or other
  modified_base (383)..(383): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggnaagtcagagcattagcagcttatttaaatggtatcagcaagaaaccagggaaacncccctaaagctcctgattctttagctgcattcccgagtttcgacgtaaaggttcggggtaccccccttagaaaggttcaggtggactaagtggtatcgtgggacngtactttcactctcaccatcagcagtctagtaccaacgttgaaacgtatttacgactaacttactactacgtacaaactacgtaacgtaacaaaccttaccccgtggtaccctcgtaaccgttttcggggaccgggtacgggaaccgaaagggttcggaacgcttaacggaaaccgtagtaacggtggccttacggaaccttaaccgttaag

SEQ ID NO: 412121 - DNA, 599 bp, Homo sapiens
  misc_feature: GZ8MTXP01EW4Q6.17.26.C04.1.454.CMB.2.raw
  modified_base (201)..(201): a, c, t, g, unknown or other
  modified_base (286)..(286): a, c, t, g, unknown or other
  modified_base (401)..(401): a, c, t, g, unknown or other
tcagcgtagactagcacgaccggtgctcgatttagtctagcgactttggggtttggggggagtcagtctcagtcaggacacagcatggacatgagggtccccgctcagctcctggggctcctgctactctggctccgaggtgccagatgtgacatccagatgacccagtctccatccctccctgtctgctatctgtagganacagagtcaccatcacttggccggcaagtcagagctattagcagtcttaatttaaatggtatcagacaagaaaccgagggaaacncccctaaagcctctgatctttgctgctatcctagtttgacgaaaggtcgggtacccccttagtaaggttcaggtggacagtgatcgtgggactagtacttcactctacacatcanctagtctagacaacgtgtaagttatttacgacttaacttactactacgtactaacgtagtaacttaacaaccgttaccccgtacggtccttacgtaacggtttacgggacgggtaaacgggaaccgtaaaggggtggaacggttacttaaacgaaacgtacgtaacggttcggaccttacgaaccgttaacgttaacg

SEQ ID NO: 412122 - DNA, 602 bp, Homo sapiens
  misc_feature: GZ8MTXP01BC3LR.17.26.C04.1.454.CMB.2.raw
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtcctccatccctccctgtctgcatctgtaggagacagagtcaccatcacttggccggacaagtcagagacattagcagtacttaatttaaatggtatcagacaaagaaaccgagggaaacacccctaagcctctagtattcgtttgctgactactccgtagtttcgacgtaaacggtcgggttacccttacgaaggttcaggtggactaaggtgaagtcgtagggactagtacttcactctcacatcagcagtcagacaacgtagaagtatttacgaccttaacgttactactacgtaacaagtacgtaacttaaccaaccttccccgtcggtacctaccgtacggttccggggacgggttacgggtaaaccgagggtaggtaacacgttccgaacgtaacgtaaccgttgggtcggacttaccggccttaacgttcg

SEQ ID NO: 412123 - DNA, 616 bp, Homo sapiens
  misc_feature: GZ8MTXP01BU36R.17.26.C04.1.454.CMB.2.raw
  modified_base (217)..(217): a, c, t, g, unknown or other
  modified_base (272)..(272): a, c, t, g, unknown or other
  modified_base (371)..(371): a, c, t, g, unknown or other
  modified_base (402)..(402): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctcctgtctgcatctgagagacagagtcaccatcactgccggnaagtcagagcatagcagtactatttaaatggtatcagacaagaaacaaggaaacncccctaaagctcctgattcttagctgactatccgtagtttacgacgtaaaggttccgggttaccccttacgtaaggttcaggtggaactaggtgatcgngggatagtactttacactctacactatcganctagtctagactacgtagtaacttatttacgacgttaaacttactactacgtaacaacgtagtaacttaaccacttaccccgttcggaccttcgtaaccgggtttccgggacggggtaacgggttaaccgtaaaggggtacggttaacgttacgttaaaccgtaaacgggtaccgttggtaccggtacgttaccggaaccttaaccgttaaccg

SEQ ID NO: 412124 - DNA, 616 bp, Homo sapiens
  misc_feature: GZ8MTXP01CH3UD.17.26.C04.1.454.CMB.2.raw
  modified_base (199)..(199): a, c, t, g, unknown or other
  modified_base (285)..(285): a, c, t, g, unknown or other
tcagcgtagactagcacgaccggtgctcgatttagtctagcgactttggggtttggggggagtcagtctcagtcaggacacagcatggacatgagggtccccgctcagctcctggggctcctgctactctggctccgaggtgccagatgtgacatccagatgacccagtctccatccctcctgtctgcatctgtagganacagagtcacatcacgttggccgggacaagtcagagcattagcagtacttaatttaaatggtatcagacaagaaaccgaggaaacncccctaaagcctcctgtattctttgctgctactctagtttcgacgtaaaggttcgggtacccccttagagttcagtgactagtcgatcgtagggactagtacttcactctacacatcagctagtctacgactaacgtagtaaacgttatttacaacttaaactttaactacttacgtaactaaacgtaggtaactttaaaccaaccgttaccccgtacggtaccttacgtaaccggtttacggggaccgggtaaacgggaaccgtaaaggggtagaaacgttacttaaaccgtaaagtacgtggtacggcttacgaaccttaacgttaacg

SEQ ID NO: 412125 - DNA, 610 bp, Homo sapiens
  misc_feature: GZ8MTXP01CEHR4.17.26.C04.1.454.CMB.2.raw
  modified_base (370)..(370): a, c, t, g, unknown or other
  modified_base (424)..(424): a, c, t, g, unknown or other
  modified_base (430)..(430): a, c, t, g, unknown or other
tcagcgtagactagcacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctaggaaaaccagcctacacgcttaaaaccgggacaaaccgtcgcccggaccaaacatacgccttcctccgtccccccttgcagtaacacaagtacagaatattaacctgttcccatcgactacgccttcggcctcgccttagggtcactcaccctgccccattaacgtgacagacctgctcggcagcggctttcaccgtnttatcgttactatgtcagtcattcgctaacttctgactacctccaagcatcgcncacacncacacttcacacgacttacacaacgacctaccctaacccaaaccaacacaactaagacgtcgttcgccgtccgacgcgtcgtcgtcgttacgttcggtttaacggttccccgtttccttacgttccttccccgtccctaaccttccgttcgtaccgttacgttaaccgttaaccgtccgg

SEQ ID NO: 412126 - DNA, 600 bp, Homo sapiens
  misc_feature: GZ8MTXP01CDM3P.17.26.C04.1.454.CMB.2.raw
  modified_base (198)..(198): a, c, t, g, unknown or other
  modified_base (224)..(224): a, c, t, g, unknown or other
  modified_base (464)..(464): a, c, t, g, unknown or other
  modified_base (515)..(515): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctcctgtctgcatctggtagganacagagtcaccatcacttggccgganaagtcagagctattagcagtacttaatttaaatggtatcaagacaaaggaaaccgagggaaactcccctaaagccttacctagtactttcctttagccttgacctattccgtagtttacgacgtaaaggttcgggtaccccccttagaaggttcaggtcgaactaggtcggatcgtagggacagttctttacacttctacactagtcgaagtctacgtctacgactaacgtagtaacttntttacgacttaactttacctatactacaacgagtataacccactaccccgngtcctcgtaacgttcgggacgggtacgaacgaagggtcgaacgattaccgaaaggtctaaggtccgacttagaacccttcgttaa

SEQ ID NO: 412127 - DNA, 542 bp, Homo sapiens
  misc_feature: GZ8MTXP01C07QY.17.26.C04.1.454.CMB.2.raw
  modified_base (275)..(275): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctaattaaatggtatcagcaagaaaccagggaaancccctaaagctcctgatctttgctgcatccagtttgacaaaggtcggggtcccccttcgaaggttcagtggacagtggatcgtggggacagatttcactctcaccatcagcagtctgacaacctgaaagtattttacgactaaactttaactaactgtacaacagacttaacaactacccctcggtctctaacgtttcggacgggtacgggaccgaaagggtgaagttattaccgaaaacgacgtggtcggcttacgtccaacctaa

SEQ ID NO: 412128 - DNA, 671 bp, Homo sapiens
  misc_feature: GZ8MTXP01AWS27.17.26.C04.1.454.CMB.2.raw
  modified_base (220)..(220): a, c, t, g, unknown or other
  modified_base (274)..(274): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccggnaagtcagagcattagcagcttaattaaatggatcagcaagaaaccagggaaacncccctaagctcctgattctttgctgcattcctaggtttcgacgtaaaggttcgggggttaccccttagtaaacgggtttcgaaggttggggaccgtaaagggttcgggtaacgttcgtagggggtaacctaggtacttttccaacttcctaccaaccctattacaggtacctaaggttccttacggacctaaaccgttgtaaaacgttattttacgaaccttaaactttaacgtaacttacgtaacctaaacgtacgtaacgttaacctaaaccttcccccgtacggtcccttaccgtaaccggtttcggggaccggggttacgggaacccgttaaggggtacggaagaacgttacgaaaacgtaacgtgtcgggctacgactaaccgttaattccg

SEQ ID NO: 412129 - DNA, 679 bp, Homo sapiens
  misc_feature: GZ8MTXP01CCP3A.17.26.C04.1.454.CMB.2.raw
  modified_base (219)..(219): a, c, t, g, unknown or other
  modified_base (286)..(286): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacttcgccggnaagtcagagctattagctagtacttaatttaaagttggtatacgagacaacgaaaccgagggaaacncccctaagcctcctgacttcgtttgctgactattccgtagtttcgacgtaaaggttccggggttaccttacgtaaggttcgaggtcggtacgtaaggttgggtaacttcgggtacggggaactagttactttacactactaccaacctacgtcacgactacgttacctacgaacctaaccgttaggaacgtttagttttacgtaaccttaaacgttttaacttacgttacgttaacaaacgtaacggttaactttaaccgtaacccttaccccgtacgtccttaccgttcggtttaaccggggacgggttaacgggaaccggttaaagggtacggaacgttaacgttaacgaaacggtaagtaggtcgtacgtacgacctaaccttgtttccg

SEQ ID NO: 412130 - DNA, 608 bp, Homo sapiens
  misc_feature: GZ8MTXP01ALIJ3.17.26.C04.1.454.CMB.2.raw
  modified_base (200)..(200): a, c, t, g, unknown or other
  modified_base (227)..(227): a, c, t, g, unknown or other
  modified_base (285)..(285): a, c, t, g, unknown or other
tcagcgtagactagcacgaccggtgctcgatttagtctagcgactttgggtttggggggagtcagtctcagtcaggacacagcatggacatgagggtccccgctcagctcctggggctcctgctactctggctccgaggtgccagatgtgacatccagatgacccagtcctccatcctccctgtctgcatctggtagganacagagtccaccatcacttggccgggnaaagtcagagcattagcagtcttaattaaatggtatcagacaagaaaccagggaaacncccctaagctcctgattcttgctgcattccgtagtttgacgtaaacggttcggggttacccccctttagtaaaggttcgaggttggaactagggtcggatcgtagggactagtactttcaccttctacaccatcgagcagtctacgacaaccgtagtaacgtatttacgaccttaacttactactacgtactaaaccgtaagtaacgttaacctaaccttaccccgtggtaccctcggtaaccgtttcggggacgggtacgggaaccgtaagggtacggagttacgttaccgaaacgtcgtaaggtggcacgtaacgaacctc

SEQ ID NO: 412131 - DNA, 630 bp, Homo sapiens
  misc_feature: GZ8MTXP01CZX71.17.26.C04.1.454.CMB.2.raw
  modified_base (221)..(221): a, c, t, g, unknown or other
  modified_base (280)..(280): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggnaagtcagagcattagcagtacttaatttaaatggtatcagacaagaaaccgaggaaacncccctaagctcctagacttctttgctgctatccgtagtttcgacgtaaaggtcggggttaccccccttagtaaggttcaggtggacaggtggatcgtagggacagtacttcactctcacatcagcacgtctacgacaactagtaactagtttacgacttaaactttactactacgtactaaacgtaagttaacgttaaacctaaccgttaccccgtcggtccttccgtaaccggtttccggggacggggttaacgggaaacccgtaaaggggtcggttaaacggttacgttaaaccgtaaacggtaaaccgttgggtacggtcgttacggtaacccgttaacgttaaccg

SEQ ID NO: 412132 - DNA, 671 bp, Homo sapiens
  misc_feature: GZ8MTXP01B9188.17.26.C04.1.454.CMB.2.raw
  modified_base (104)..(104): a, c, t, g, unknown or other
  modified_base (262)..(262): a, c, t, g, unknown or other
  modified_base (304)..(304): a, c, t, g, unknown or other
tcagcgtagactagcacgaccggtgctcgatttagtctagcgactttggggtttggggggagtcagtctcagtcaggacacagcatggacatgagggtccccgntcagctcctggggcccctgctactctggctccgaggtgccagatgtgacatccagatgacccagtctccactcctccctgtctgcatctgtaggagacagagtcaccatcacttggccggcaatcagagcattagcagtacttaatttaaatggtatnagacgaagaaaccgaggaacgacccctagctcctgtatcttnctgcacttccgtagtttaggacctaaagggttccggggttacccttacgagggtttacgaggtcggaccgtaaggttacggtgtcgttacggggaacgttataactttcaactcttacccaactatcacgactggtactcgaactaaccgtaggtaaacgtttactttacacccttaaactttaaccgttaacttacgtaaccaaacgtacgtaaaccgtttaaccctaaacccgttccccgtacccggactttacccgtaaccgggtttccgggggaacgggttaaccgggaaaccggttaagggtagggtaacgaaccttaacggaaaacgtaacgtcgtaacggctcgacaacttaacttaacg

SEQ ID NO: 412133 - DNA, 653 bp, Homo sapiens
  misc_feature: GZ8MTXP01ARB2L.17.26.C04.1.454.CMB.2.raw
  modified_base (198)..(198): a, c, t, g, unknown or other
  modified_base (223)..(223): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacttggccggnaagtcagagctattagctagtacttaatttaaagtggtaatcgaagacgaaacggaaaccgaacggggaaacctccccctaaagcctcgtagtacttcgtttgctgactacgttccgtagtttacgacgttaaggtccggggttacccccttaggtaaggttcgaggtggaactaggtggagtcggtagggactagtacttcactactcactatacgagtctacgtcctacgaaccttaaccgtaggtaaacttacgtttacgaccttaaacgtttactacctacgtaacaaacgtagtaacttaaccaccgtccccgtacgtccttacgtaaccggttcgggacgggtaacggaaccgttaaagggcggaaacgttacttaaaccggtaaacggtcgtcggtacggtccttaccggccgttaacttccg

SEQ ID NO: 412134 - DNA, 571 bp, Homo sapiens
  misc_feature: GZ8MTXP01EFF87.17.26.C04.1.454.CMB.2.raw
  modified_base (199)..(199): a, c, t, g, unknown or other
  modified_base (289)..(289): a, c, t, g, unknown or other
  modified_base (418)..(418): a, c, t, g, unknown or other
tcagcgtagactagcacgaccggtgctcgatttagtctagcgactttgggtttggggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacttggccgggacaagtcagagctaattagcagtacttaatttaaatggtatcagacaagaaaccgaagggaaacncccctaaagcctctgtatctttgctgctatctagttgacgtaaggttcgggtacccccttagaaggttcgagtggacagtggatcggagggactagtcttacactctacaccatacagactagtcgtanaccgtaactgtaagttactttacgacttaaacttactactacgtaacaacgatacgtaacacttaccctgctctcgttcgggacggtacgggaccgaagggtcgaagcttaaacgaaaccgtagtggtcggcttacggaaccttaaccgtaag

SEQ ID NO: 412135 - DNA, 683 bp, Homo sapiens
  misc_feature: GZ8MTXP01CCVP4.17.26.C04.1.454.CMB.2.raw
  modified_base (196)..(196): a, c, t, g, unknown or other
  modified_base (222)..(222): a, c, t, g, unknown or other
  modified_base (280)..(280): a, c, t, g, unknown or other
  modified_base (301)..(301): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacttcggccggnaagtcagagctattagctagtacttaatttaaatggatcagacagaaaccaggaaacncccaagctacctgattctttnctgactatccgtagtttcgacgtaaacggttcggggtaccccccttaggtaaggttcgaggtcggaacgtagggtggtactacgggtagggaacctaggttactttacaccttcctactaaccacgtacgaacggtactacggttctacgtaccgtaaaccgttagttaagtttactttaccgaacgtttaaactttaactactaacggtacctaaacgtacggtaaacttaacctaacccgttacccgtcgtaccttaaccggttaacgggtttaccggggaccgggtaaacggggttaaccgtaaaggggtcggaaaacggttacttaaacccggaaaaccgtggttcggtacggcgttacgaacccgttaacttaaccg

SEQ ID NO: 412136 - DNA, 642 bp, Homo sapiens
  misc_feature: GZ8MTXP01DR5LB.17.26.C04.1.454.CMB.2.raw
  modified_base (197)..(197): a, c, t, g, unknown or other
  modified_base (285)..(285): a, c, t, g, unknown or other
  modified_base (313)..(313): a, c, t, g, unknown or other
  modified_base (424)..(424): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctcctgtctgcatctgtagganacagagtcaccatcacttggccgggacaagtcagagcattagcagtacttaatttaaagtggtatcagacaagaaaccgagggaaacncccctaagctctgtacttcgtttgcctnactacgtacgtagttacgaacggttacgggttccggttacccctaggtaggttcgaggtcggtaagtaggtcgtatcgggtaggactagttcttacaccttctacaacgtnacgagtactacgtactacgaacctaacgtaagtaactttacgttacgtaaacctttaactttacgtaacgtacgtaaacaaacggttacgttaaaccttaaccctacccgttacccgtcgtaccttacggtaacggtcggggacgggtacggaacggtagggtacgaacgttaacgttaaccgtaaacggtgtggtacgtcacgtcgttaacgtaacg

SEQ ID NO: 412137 - DNA, 624 bp, Homo sapiens
  misc_feature: GZ8MTXP01EV5RK.17.26.C04.1.454.CMB.2.raw
  modified_base (220)..(220): a, c, t, g, unknown or other
  modified_base (284)..(284): a, c, t, g, unknown or other
  modified_base (371)..(371): a, c, t, g, unknown or other
  modified_base (386)..(386): a, c, t, g, unknown or other
  modified_base (436)..(436): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacgttgccgganaagtcagagcattagcagtacttaatttaaattggtatacagacaaagaaaccgaagggaaacncccctaagctcctgattctttgctgacactactagtttagacgtaaaggtcgggttaccctagtaaggttcaggtgctaaggtaggngtcgagggactagtntttacactctacacatcgagtctacgtactcgacctaactgaaacgtttntttacacttaacttactactacgtaacaacgtacgtaacgttaacctaaccgttccccgtacgtaccttaccgttaccgggttaaccgggaacggggttaacgggtaaccggttaaaggggtacggaacgttaacgttaaccgaaacggtcgtacgggtaacgacgtacgacctaaccgttcgttccg

SEQ ID NO: 412138 - DNA, 601 bp, Homo sapiens
  misc_feature: GZ8MTXP01CVZI6.17.26.C04.1.454.CMB.2.raw
  modified_base (226)..(226): a, c, t, g, unknown or other
  modified_base (290)..(290): a, c, t, g, unknown or other
tcagcgtagactagcacgaccggtgctcgatttagtctagcgactttggggtttggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttggccgggnaagtcagagctattagcagtacttaatttaaatggtatcaagacaagaaaaccgaagggaaacncccctaaagccttacctgacttctttagctgctatcctagtttgacgtaaaggtcgggtacccccttagtaaggtcaggtgacgtagtggatcgtagggactagtacttcactctacacctatcagctagtctagacaactagtaagtactttacgaacttaacttacgtactacgtaacaacgtaagttaacttaacctacctaccccgtcgtaccctcgtaaccggtttcgggacgggtacggaacgtaaagggtcgaaagttacttaaccggaaacgtacgttggcgtacacgtccttaaccgttaag

SEQ ID NO: 412139 - DNA, 573 bp, Homo sapiens
  misc_feature: GZ8MTXP01EAW1C.17.26.C04.1.454.CMB.2.raw
  modified_base (199)..(199): a, c, t, g, unknown or other
  modified_base (225)..(225): a, c, t, g, unknown or other
  modified_base (285)..(285): a, c, t, g, unknown or other
tcagcgtagactagcacgaccggtgctcgatttagtctagcgactttgggtttggggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacttggccgggnaagtcagagctattagcagtcttaatttaaatggtatcagacaagaaaccgagggaaacncccctaagctctgtattctttgctgctatccgtagtttcgacgtaaaggtcggggtacccccttagaaggttcaggtgacagtgatgtgggactagtacttcactctacacctatcagtctagtctagacctaactagtaattatttcgaacttaaactttactaactacgtaacaacgtagtaacttaacctacctacccgtcgtcctcgtaacggttcgggacgggtaaggaccgtaaggtgagacttacgaaacgtagtggtacgcttacgaaccttaacgtaac

SEQ ID NO: 412140 - DNA, 676 bp, Homo sapiens
  misc_feature: GZ8MTXP01BWKIB.17.26.C04.1.454.CMB.2.raw
  modified_base (222)..(222): a, c, t, g, unknown or other
  modified_base (275)..(275): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagtctatttaatgtatcagcaagaaaccagggaaacncccctaaagctcctgatctttgcttgctatcctagtttcgacgtaaaggttcggggttccccccttacgaaaggtttccaaggttcggacctaggttcgggatcgtaggggactaaggtactttcaacttcctacaccagtcaagctaacgtctacggaccaaaccgttagtaacgttaagttttacgaacttaaactttacgtaaccttacggttaacctaaaccgtagtaaccggtttaaacctaaaccgttacccccgttaccgggtccttcccgtaaccggttttccgggaccgggttaacgggggaacccgtaaagggggtcggttaaacggttacgttaaccggtaaaaccggtaacgttcggttacggacgttacgaacccgttaaccttaacg

SEQ ID NO: 412141 - DNA, 614 bp, Homo sapiens
  misc_feature: GZ8MTXP01AX4Y6.17.26.C04.1.454.CMB.2.raw
  modified_base (195)..(195): a, c, t, g, unknown or other
  modified_base (221)..(221): a, c, t, g, unknown or other
  modified_base (278)..(278): a, c, t, g, unknown or other
  modified_base (359)..(359): a, c, t, g, unknown or other
  modified_base (382)..(382): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccggganaagtcagagcattagcagtcttaatttaaattggatcagacaagaaaccgaggaacncccctaagctcctgattctttgctgctatcctagtttcgacgtaaggtcggggtccttacgaaggtcaggtgctaagtggntcgtgggactagtacttcactcncacatcagcatcgtcgactaacgtagtaaagttacttttacgaccttaaacgtttactaacgttacgtaacctaaacgacgttaaacgtttaacctaaacccgttacccccgtcgggtaccttaccgttaaccgggtttcgggaacggggttaacggggtaacccgttaagggtacggaagttaccgttaccgaaacgtaacgttggaacggctacgacctaacttcgttcg

SEQ ID NO: 412142 - DNA, 524 bp, Homo sapiens
  misc_feature: GZ8MTXP01B7HSD.17.26.C04.1.454.CMB.2.raw
  modified_base (197)..(197): a, c, t, g, unknown or other
  modified_base (271)..(271): a, c, t, g, unknown or other
  modified_base (324)..(324): a, c, t, g, unknown or other
  modified_base (373)..(373): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagctattaaatggatcagcagaaaccaggaaancccctaaagctctgatctttgctgcatcagtttgcaaagtcgggtcccccttnaaaggttcagtggacagtggatcgtgggacagtattctactctcaccanacagacagtctgacaactagtaatattatacgtaacttactactactactaacagtaactaactaactaccgtacgtctctaacgtcggttacggtacggacgtaaggtagagacttaacaacgaacgtaagtgtcgttacgtcgaactaa

SEQ ID NO: 412143 - DNA, 718 bp, Homo sapiens
  misc_feature: GZ8MTXP01AC90M.17.26.C04.1.454.CMB.2.raw
  modified_base (167)..(167): a, c, t, g, unknown or other
  modified_base (195)..(195): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtcnccatccctcctgtctgcatctgtagganacagatcaccatcacttggccggcaaagtcaagagctattagcagtacttaatttaaatcggtatcagacaaacggaaaccgagggaaaccgtcccctaagcctccgtagtattccttgcttagctacttaccgtaggtttacgacgtaaaggttccggggtacccttagtaaacgggtttcagggttcggacgtaaggtacggtaagttcggtacggggtaactagttaccttttacgacttacttaccggaactaacttcgaacgtactaacggttcacgtaacctaaaccgtggtaacttaacgttttacgacctttaaacgttactaccgttaaggtacccaaacgtaaaggtacccgtttaaccaaacccgttccccgtaccgggtacttacccgttacgggtttcccggggaacggggttaaacggggaacccttaaagggggcccggttaaaacgttaaccggttaaccgttaaacgtaacggtggtaaccgacgtacgaccgtaaccttgttccg

SEQ ID NO: 412144 - DNA, 685 bp, Homo sapiens
  misc_feature: GZ8MTXP01B8ELS.17.26.C04.1.454.CMB.2.raw
  modified_base (149)..(149): a, c, t, g, unknown or other
  modified_base (227)..(227): a, c, t, g, unknown or other
  modified_base (288)..(288): a, c, t, g, unknown or other
tcagcgtagactagcacgaccggtgctcgatttagtctagcgactttgggtttggggggagtcagtctcagtcaggacacagcatggacatgagggtccccgctcagctcctggggctcctgctactctggctccgaggtgccagatgngacatccagatgacccagtctccatccctccctgtctgcatctgtaggagacagagtcaccatcacgttggccggganaagtcagagcattagctagtacttaatttaaatggtatacagacaagaaaccgaggaaacncccctaagcctctgtacttctttgctgactacttccgtagtttcgaacgtaaacggttccggggttaccccccttaggtaacggttcgaaggtcggactaggtggacttcggtagggactagtacgtttaccacttcctacacctatacagtctagtcctagacctaaccgtagtaacgttactttacgaacttaaactttaacttacgtacgtaacctaaacgtaacggtaactttaaacgaaaccccttccccgtacggtccttccggttaaccggtttccgggaccgggggttaaaccgggaaccggtaaaggggttacggaaacgttaacgttaaaccggaaaacccggtagttcgggtcggtacccgttacggtaacccgttaacgtttccg

SEQ ID NO: 412145 - DNA, 587 bp, Homo sapiens
  misc_feature: GZ8MTXP01E2ZQQ.17.26.C04.1.454.CMB.2.raw
  modified_base (196)..(196): a, c, t, g, unknown or other
  modified_base (223)..(223): a, c, t, g, unknown or other
  modified_base (277)..(277): a, c, t, g, unknown or other
  modified_base (424)..(424): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacttggccggganaagtcagagctattagcagtctatttaaatgtatcagacaagaaaccaggaacnccctaagctctgatcttgctgactatccgagtttcgacgtaaacggttcgggttcccccttagaaggttcgaggtgaacgagtggatcgtagggactagtatttccactctacacagtcagcagtctacactaaccgtgtaaacttntttacgacttaaacttacgtactacgtacaaatagtaacgttaacaacgtcccgtgtacttaccgtcgtttacgggacgggtaacggttaccgaagggtacggaacgttacttacccggtaaaagtaccgttggtacgtaccgttacgtccgttaacttaacg

SEQ ID NO: 412146 - DNA, 530 bp, Homo sapiens
  misc_feature: GZ8MTXP01EM2GM.17.26.C04.1.454.CMB.2.raw
  modified_base (431)..(431): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattagcagctaatttaaatggtatcagacagaaaccagggaaacgcccctaaagctcctgatctttgctgcatccagtttgctaaaggtcggggtcccccttgaaggttcagtggacaggtgatcgtgggactagtatttcactctcaccatcagctagtctgcaactgaagtatttgactaacttatactgtacaanagtagtaacactacccctgctcaacgtttcgggcgggacgggttaccgaagggtggagacttacgaaacgtacgtggtaggcttacggccaaccgtaac

SEQ ID NO: 412147 - DNA, 550 bp, Homo sapiens
  misc_feature: GZ8MTXP01DWBV5.17.26.C04.1.454.CMB.2.raw
  modified_base (197)..(197): a, c, t, g, unknown or other
  modified_base (221)..(221): a, c, t, g, unknown or other
  modified_base (230)..(230): a, c, t, g, unknown or other
  modified_base (239)..(239): a, c, t, g, unknown or other
  modified_base (272)..(272): a, c, t, g, unknown or other
  modified_base (410)..(410): a, c, t, g, unknown or other
  modified_base (483)..(483): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccggnaagtcagancatagcagnttattaatgatcagacaagaaaccgaggaaacncccctaagctctgtactctttgctgctatccgtagtttcgacgtaaaggttcggggtccccccttggtaggttcaggttggactaaggttggatacggtgggaactagtactttcactctacactatcagtcagttcntacaacgtagaattatttacgaacttaacttactactagtacaacgtatacgttaacactaccctcggccttnaacgttcgggacggtacggaacgaagggtgaagacgttacaaacgtatgtagcttagccttaactaa

SEQ ID NO: 412148 - DNA, 881 bp, Homo sapiens
  misc_feature: GZ8MTXP01EBKE9.17.26.C04.1.454.CMB.2.raw
  modified_base (223)..(223): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtcctccactcctccctgtctgctatctgtaggagacagatcacatcacttcggccgganaagtcagagacagttacgcaagtacttaaagtttaaattggtaatacgacgacgaaaacgaaaccgaaacggggaaacctaccccgtaaagtcccttacccgttagtacttttccgttttacggacttacgtacctaactttaccggtttacgggttttacgggaaaccggttaaaaccggggtttcccggggggttaaccccttttaaccggtaaacggggtttaccgaggggtttaggacccggtaaaaggggtttgggtaacggtttaccgggtaacgggggtaaaccttaacggtttacttttacccgaccttttaccgaaccctaacctaacttacccgaagttcccgttaaaggtttcccctaaacgggtaacccttaaaccggttaggttaaaaagtttcgtttttaaaccgaaaccccttttaaacgtttaaaccttacggtttaaacctaaaccgtaaacggtaaacgttaaaccgtttaacccttaaaaccccgttccccggttacgggtaccctttacccgggggttaaccggttaacgggggaccggggttaaaggacccgttaaaggggtagggaacttaaaccggttaaccgttaaaacgggtccttagggccgttcgaccgttacctaaccggttgtttcccg

SEQ ID NO: 412149 - DNA, 572 bp, Homo sapiens
  misc_feature: GZ8MTXP01BHL1E.17.26.C04.1.454.CMB.2.raw
  modified_base (198)..(198): a, c, t, g, unknown or other
  modified_base (222)..(222): a, c, t, g, unknown or other
  modified_base (281)..(281): a, c, t, g, unknown or other
  modified_base (412)..(412): a, c, t, g, unknown or other
  modified_base (564)..(564): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacttgccggnaagtcagagctattagcagtcttaatttaaatggtatcagacaagaaaccgaggaaacncccctaaagctactgattctttgctgctatcctagtttcgacgtaaaggttcggggtaccccccttaggtaacggttcgagttcggactaggtggatcgtagggactagtctttcactctacactatcganctaagtctacgacctaacgtagaagttatttcgaacttaacttactactacgtaacaaactagtaacttaaccacttacccccgtgtacctcgtaacgttcgggacggacgacgaggtagacgttagttaccaagtactgacgcgctaaccncgttaacg

SEQ ID NO: 412150 - DNA, 822 bp, Homo sapiens
  misc_feature: GZ8MTXP01CTXHU.17.26.C04.1.454.CMB.2.raw
tcagcgtagactagcacgaccggtgctcgatttagtctagcgactttggggtttggggggagtcagtctcagtcaggacacagcatggacatgagggtccccgctcagctcctggggctcctgctactctggctccgaggtgccagatgtgacatccagatcgacccagtcctccatccctccctgtctgctatcgtggtaggagacagacgtccaccatcacgttcggccgggacaagtcagagctattagctagtactttaaatttaaagtggtaatcgaagaccgaaaacggaaaaccgaacgggggaaacctacccccgttaaagtcccgttacccgtttagtacgttttccgttttagccgttaggtaccctttaacgtaccccgtttaggttttacggaaccggttaaacgggggtttcccggggttttaccccccccttaaggtaaacgggttttccgaagggtcgggtaacgttagggtcggtaacgttccgggtaaggggaacttaggttaacttttcccgaccttacctacaacctagtaccgaggtacctaacggttccaacggtaacccctaacgttagtaaacgtttcgtttaccctaaaccgtttaaacctttaacgtacgttaccgtaaaccgtaaacggttacttaaacccgttaaacccgtacccgttaacccccggtcgttaaccgttaccgggtttaacccgggttaacgggggaacccggggttaaagggaacccggtaaaggggtcgaaacggttaccaaccggtaaacgtacggttgcggttcaccgtccttaacgttcg

SEQ ID NO: 412151 - DNA, 628 bp, Homo sapiens
  misc_feature: GZ8MTXP01ESX0R.17.26.C04.1.454.CMB.2.raw
  modified_base (291)..(291): a, c, t, g, unknown or other
tcagcgtagactagcacgaccggtgctcgatttagtctagcgacttttggggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtccaccatcacgttggccgggacaagtcagagctaattagcagtcttaatttaaagtggtatcagacaagaaaccgagggaaacncccctaagcctctgtattcttgctgactattcctagtttcgacgtaaacgggtccggggttacccccttacggtaaggttcgaggtcggacgtagggtggattcggaggggactaggttactttacacgttccacctacatcaagtctagtctagaccaacgttagaagttatttcgaactaactttatactgtaacaactacgtaacttaacctacctccccgtacgtacctcgtaaccgtttcggggacgggtaacggttaaccgaaggggttacggaacgttacgttaaaccgtaacggtaccgtgggttacgccgttagcccttaacgtaacg

SEQ ID NO: 412152 - DNA, 655 bp, Homo sapiens
  misc_feature: GZ8MTXP01D33QW.17.26.C04.1.454.CMB.2.raw
  modified_base (463)..(463): a, c, t, g, unknown or other
  modified_base (467)..(467): a, c, t, g, unknown or other
tcagcgtagactagcacgaccggtgctcgatttagtctagcgactttggggtttggggggagtcagtctcagtcaggacacagcatggacatgagggtccccgctcagctccgtggggctcctgctactctggctccgaggtgccagatgtgacatccagatcgacccagtctccacttccctccctgtctgctattcgtaggtaggacgacagacgtaccaccatctacgttcggaccgggactaagtcagagactaattacgcagtacttaaatttaagtggtatacgagaacgaacggaaaaccgagggaaacctccccgtaaagtccttacctagtactttctttagctcgaccttacgttaccgtaggtttacgaacggttaagggttccgggtaccccctagtaaggttcaggtcgaacgtagtgtatcggaggactagtacttcactctacactancagntacgtctacgactaacgtagtaacttatttacacgttaacttactactacgtaacaacgtacgttaacttaacctacccgttacccgtcgttactaccggtaacggttcgggacgggtaaaggttaccggtaagggtacgaacgttacgttaaaccgaaggtacgtggtcgacgttcaacgttcttcg

SEQ ID NO: 412153 - DNA, 695 bp, Homo sapiens
  misc_feature: GZ8MTXP01BFRW3.17.26.C04.1.454.CMB.2.raw
  modified_base (262)..(262): a, c, t, g, unknown or other
  modified_base (284)..(284): a, c, t, g, unknown or other
  modified_base (673)..(673): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatcgacccagtcctccactccctccctgtctgcatcgtgtaggagacagagtccaccatcacgttggccggacaagtcagagctattagcagtcttaatttaatgancagacaagaaacgaaggaaccnccctaagcctctagtacttctttgctgactacgttaccgtagtttacggaacgttaaacggggttccgggttaccctttaggtaacgggtttcgagggttcggacgtaaggggttacggtaacgttcgggtaaggggacttacgttactttacccacttccctactaactatcacggtctaacgttcgtacgaacctaacgtagtaaacgtttactttacgaacctttaacggttaactacgtacctaactaaacgtacggtaaacttaaccgtaacccgttccccgtgtaccttacggttaccgggttcgggaacggggttaaacgggtaccgttaaagggtacggtaacgttaaacgttaccggaaaaccggtgttgggccgttacncggttacctaacccgttgttcg

SEQ ID NO: 412154 - DNA, 839 bp, Homo sapiens
  misc_feature: GZ8MTXP01AJXZZ.17.26.C04.1.454.CMB.2.raw
  modified_base (203)..(203): a, c, t, g, unknown or other
  modified_base (231)..(231): a, c, t, g, unknown or other
tcagcgtagactagcacgaccggtgctcgatttagtctagcgactttggggtttggggggagtcagtctcagtcaggacacagcatggacatgagggtccccgctcagctcctggggctcctgctactctggctccgaggtgccagatgtgacatccagatcgacccagtctccatccctccctgtctgcatcgtggtagganacagagtcactatcacgttggccggganaagtcaagagactattagctagtacttaatttaaagtggtaatcgaagacgaaacggaaaacccgaaggggaaacctaccccctaaaggtcctaccgtagtactttcgtttgcgttacgactacttaccgttaaggtttacggaaccgttaaaacggggtttcccggggttacccccctttaacgggtaaggggtttaccgaagggggttcgggtaacggttaagggtaacgggtacgttaaccgggtaacggggtaaccttaacggtttaccctttaaccgtacccttacccttaacccgaaaccgtattacccggaacgttaccgtacgttaccgttaaacgaacccgttaaacccgttaaggttaaacttttaacctttttaacgaaaccctttaaactttaacgttaccgttaaaccttaaacgtaaacgttacggttaaaccgttaaacccctaccgttacccccggtacgtcccgttaaacccggttaaccgggttaccgggggaaccggggtaaacgggttaaaccggaaagggtaacggttaacgttaaccgaaaaccggtaacggttacgtgggtacgtcgacctaaccgttcttaacg

SEQ ID NO: 412155 - DNA, 577 bp, Homo sapiens
  misc_feature: GZ8MTXP01D6O5V.17.26.C04.1.454.CMB.2.raw
  modified_base (220)..(220): a, c, t, g, unknown or other
  modified_base (225)..(225): a, c, t, g, unknown or other
  modified_base (577)..(577): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctcctgtctgcatctgtaggagacagatcaccatcacttgccggnaagtnagagcatagcagtctaattaaatgtatcagacaagaaaccagggaaaccccctaaagctctgacttcttgctgctatccgtagtttacgacgtaaacggttcggggtacccccttagaaggtttcagtggacagtggatcgtgggacagtacttcacttcacacatcagactagtctacgctaacgtagaaagttatttacacgttaaacttacttaacgtacgtacaaacgtacgtattaactaactaccccgtacgtcctcgtaacgtttcgggacgggtaacgggaacgtaaagggtgaacggattaacgaaacgtaacgtggttacgggcttacgtaacttaaccgtn

SEQ ID NO: 412156 - DNA, 567 bp, Homo sapiens
  misc_feature: GZ8MTXP01D2HWB.17.26.C04.1.454.CMB.2.raw
  modified_base (221)..(221): a, c, t, g, unknown or other
  modified_base (282)..(282): a, c, t, g, unknown or other
  modified_base (363)..(363): a, c, t, g, unknown or other
  modified_base (373)..(373): a, c, t, g, unknown or other
  modified_base (377)..(377): a, c, t, g, unknown or other
  modified_base (386)..(386): a, c, t, g, unknown or other
  modified_base (402)..(402): a, c, t, g, unknown or other
  modified_base (449)..(449): a, c, t, g, unknown or other
tcagcgtagactagcacgaccggtgctcgatttagtctagcgactttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtagagacagatcaccatcacttgccgggnaagtcagagcaattagcagtacttaatttaaatggtatcaagacaagaaaccagggaaacncccctaaagctcctgattctttgtgctatcctagtttgacgtaaggtcgggtacccttagaaggttcaggtgctaaggtgntcgtaggganagtnttcacttcncactatcagcagttcngacctaactagtaagtatttagacttaacttactactgtaaccaaanaacgtaacgttaacaaactaccccgtcggaccttcgtaccgtttcgggcggaacggggaacttaagggtacggaagaacttacgaaaccgtaagagttcggctcgactaaccttgtcg

SEQ ID NO: 412157 - DNA, 644 bp, Homo sapiens
  misc_feature: GZ8MTXP01CYY8I.17.26.C04.1.454.CMB.2.raw
  modified_base (223)..(223): a, c, t, g, unknown or other
  modified_base (422)..(422): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatcgacccagtctccatccctcctgtctgcatctgtaggagacagagtcaccatcacgttgccggnaagtcagagtcaattagcagtacttaatttaaatggtatcagacaagaaaaccagggtaaaccccctaaagctacctgacttcttgcttgctagtccgtagtttgacgtaaggtccgggttacccctagtaaggttcaggtcgaacgtagtgggattcgagggactagtacttcacttactcaccatcgatcagttccngactacgtagaacttatttacacgttaaacgttaccttaaacgtacgtaaactaaccgtaacgttaaccgttaaacccgtaaccgttacccggtcgtaccgttaacccggttaaccggttacggggaaccggggtaaccggttacggtaaagggtcgttaacgttaacttaacgtaaacgtaacgtaacggtacgtacgttacgtaaccgttaaccgtaacg

SEQ ID NO: 412158 - DNA, 662 bp, Homo sapiens
  misc_feature: GZ8MTXP01CJKT7.17.26.C04.1.454.CMB.2.raw
  modified_base (224)..(224): a, c, t, g, unknown or other
  modified_base (283)..(283): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatccacttggccgggnaagtcagagacattagctagtcttaatttaaatggtatcagcaagaaaccgagggaacnccctaagcctctgatcttgctgctatcctagtttgacgtaaggtcggggttaccccccttagaaggttcgaggtcggcgtaaggtgggtactcggtagggtactagtactttccaccttcctacacctatccgagacctagttcctagacctaaccgttagtaaacgttatttacgaaccttaactttaacgtaccttacggtaacctaaacgtaaggttaacttaaaccctaaccgttacccccgtacggtaccgttacccgtaaccggtttccggggaaccggggtaaacggggttacccgtaaaagggggttcgaaacgttcgttaaaccgaaaccggtacgttgggtaccggacttcggaaccttaacccgtaag

SEQ ID NO: 412159 - DNA, 574 bp, Homo sapiens
  misc_feature: GZ8MTXP01BKLL2.17.26.C04.1.454.CMB.2.raw
  modified_base (274)..(274): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccggcaagtcagagcatgcagctatttaaatggtatcagacagaaaccagggaaacncccctaagctctgattctttgctgctatcctagtttcgacgtaaaggttcggggtccccccttagaaggtttcaggttcggaactaggtgatcgtgggactaggtactttcactctcacatcagctagtctagactaacgtgtaaatatttacgactaactttactactacgtacaaacgagtaacgttaaccaacttaccccgtcgtacctccgtaacgtttcgggacgggtacggaaccgtaagggtacgaagacttaacgaaacgtacgtggtcggacttcggaaccttaacgtaac

SEQ ID NO: 412160 - DNA, 592 bp, Homo sapiens
  misc_feature: GZ8MTXP01CZBMB.17.26.C04.1.454.CMB.2.raw
  modified_base (196)..(196): a, c, t, g, unknown or other
  modified_base (276)..(276): a, c, t, g, unknown or other
  modified_base (376)..(376): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacttgccggacaagtcagagcattagcagtctaatttaaatggtatcagacaagaaaccaggaaancccctaaagcctacctgactctttagctgactaatcctagtttgacgtaaagtcggggtaccccctgaaggttcacgtgacagtgatcgtagggacagtnttaccatctacaccatcagcagttctagacctaactagtaaattcttttacacttaaactttaactaactgtaaccaaacaacggtaatttaaacccacttaacccccgtcggtacttaccgtaacgtttccgggacgggtaaagggacccgtaaagggtggaagttcaaacgtaaacggtaacgtggtacgggacttacggaaccttaacccgtg

SEQ ID NO: 412161 - DNA, 652 bp, Homo sapiens
  misc_feature: GZ8MTXP01ARV18.17.26.C04.1.454.CMB.2.raw
  modified_base (229)..(229): a, c, t, g, unknown or other
  modified_base (238)..(238): a, c, t, g, unknown or other
  modified_base (441)..(441): a, c, t, g, unknown or other
  modified_base (447)..(447): a, c, t, g, unknown or other
  modified_base (496)..(496): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatcgacccagtcctccatccctccctgtctgcatctgtaggagacagactccaccatcacgttcggccgganaagtcaagngactaattacgctaagtactttaaatttaaagtggtaactcgaagaccaaaaggaaacccggacgggaaacctcccctaaagcccttaccgtgtactttcttgctagctactccgtagtttacgaacgttaacgggtccggttaccccctagtaggttcgaggtcggaataggtggatcgggaggtactagtcttcactccanacctancgagtctagtcacgactaagtgttaattacttacaactttacttactanaacgtaacaacgtacgttaactaaccctcccgtccgtcgtacttccgggtaacgggtaccgggaacgggtaaaccgttacggtaagggtaaccgaacgttaacgaaaccggtaaccggtcgttaacgggcgtccttaccgtaaccgttcgttaacg

SEQ ID NO: 412162 - DNA, 593 bp, Homo sapiens
  misc_feature: GZ8MTXP01DMCDF.17.26.C04.1.454.CMB.2.raw
  modified_base (204)..(204): a, c, t, g, unknown or other
  modified_base (417)..(417): a, c, t, g, unknown or other
  modified_base (423)..(423): a, c, t, g, unknown or other
  modified_base (430)..(430): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgagtgccagatgtgacatccagatcgacccagtctccatccctccctgtctgcatcgtgtaggagacagntcaccatcacgttggccggcaagtcagagctattagctagtacttaaatttaaagtggtatcaagacaaacggaaaaccgagggaaaccgtcccctaaagccttaccgtgtacttcgtttgcgtgactactccgtagtttcgaacgtaaggtcgggtaccccctagtaggtcgagtggacagtgatcgaggtacagtcttcactctacgactnacgacngactcanaccgtaactagtaacttactttcgaactttaacttaacgtaccttagtaacgaaactgtaactaaccctacgtacccgtcgtacctcgttaacgggttcggacgggaggttaacgagggtcgaacgttacacgaactagtcgtacggcttacgcttaaccgtg

SEQ ID NO: 412163 - DNA, 609 bp, Homo sapiens
  misc_feature: GZ8MTXP01BBZH4.17.26.C04.1.454.CMB.2.raw
  modified_base (220)..(220): a, c, t, g, unknown or other
  modified_base (276)..(276): a, c, t, g, unknown or other
  modified_base (355)..(355): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagcttaatttaaatggtatcagcaagaaaccagggaaacncccctaagcctctgattcttgctgcatcctagtttgactaaaggtcggggtcccttacgaggttcaggtggcaagtggntcgtaggggacaggtactttcacttctccactatcagtcagtctgactaacgtgaattatttacgactaacgttactactacgtacaaactaagtacttaacaaaccgttccccgtcggtaccttaccgaaccgttttcggggaaccggggttaaacggggtaacccgttaaagggggttaggaacggttaaacgttaccggttaaaacgtaaccggttggtcgtaccgttggaccctaaccttaagtttcccg

SEQ ID NO: 412164 - DNA, 630 bp, Homo sapiens
  misc_feature: GZ8MTXP01DDDC9.17.26.C04.1.454.CMB.2.raw
  modified_base (197)..(197): a, c, t, g, unknown or other
  modified_base (614)..(614): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttggccggacaagtcagagctattagctagtacttaatttaaatggtatacagacaagaaaccgagggaaactcccctaaagcctcctagtacttcttgctgctactccgttagtttcgaacgtaaaggttccgggttacccccttaggtagttcgaggtgacgtaggtggtatcggtacgggactagttacttcactctactacatcgacgtctacgtctacgactaacgtagtaacgttatttactaacttaactttaacgtacttacgtaaacctaaacgtacgttaaccgttaaacctaacccgttacccgtaccgtaccgtaccgttaacggttcggggacgggtaacggaaccggtaagggtacgacgttaacgttaacgtaagacgtggtacgnttacgtaacaacgttc

SEQ ID NO: 412165 - DNA, 746 bp, Homo sapiens
  misc_feature: GZ8MTXP01BOR41.17.26.C04.1.454.CMB.2.raw
  modified_base (198)..(198): a, c, t, g, unknown or other
  modified_base (227)..(227): a, c, t, g, unknown or other
  modified_base (298)..(298): a, c, t, g, unknown or other
tcagcgtagactagcacgaccggtgctcgatttagtctagcgactttgggtttggggggagtcagtctcagtcaggacacagcatggacatgagggtccccgctcagctcctggggctcctgctactctggctccgaggtgccagatgtgacatccagatgacccagtctccatccctcctgtctgcatctgtagganacagagtcaccatcacgttggaccggganaagtcagagactattagctaagtacttaatttaaatggtatacgaagacaaacgaaaccgaggggaaaccnccccgtaaagcctacctagtacttcgtttagctgtactattccgtagtttcgaacgtaaacgggttcgggttaccccccttacggtaaaggttccgaagggtcggtaacgtagggttcggtacgtacgggttacggggaacttaaggttactttaccctaacgttcccttaaccaaacccttaacgtccgaaacggtccgttaaacggttccctacggtaacccgtaaacccgttaaggtaaacggtttaacttttaccggaaccgtttaaacctttaccgtaacgttacgtaaacgtaaacgtaacgttaaacgtttaaacctaacccgttaaccccgtggtaccccttcgttaaccggttccggggacgggtaacggaaccggtaagggtcgaaggttacttaccgaaaacgtcgtcggtcgtaccttacggtaaccttaacgtcg

SEQ ID NO: 412166 - DNA, 759 bp, Homo sapiens
  misc_feature: GZ8MTXP01ANZRY.17.26.C04.1.454.CMB.2.raw
  modified_base (219)..(219): a, c, t, g, unknown or other
  modified_base (227)..(227): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcacatcacttgccggnaagtcagngcattagcagtcttaattaaatgtatcagacaagaaaccagacgaaacgcccctaagctcgtgtattcttgctgctactctagttcgagtaacggtcggtacccttagtaacggttcgaggttcgggactaaggggttcggtaacgttaccgggtacgggggtaaactacggttacttttacccaacctttcccgttaaccaaacccctagtttaaccgaacggtaccccgttaacggtttccctaacggtaaaccccttaaaacccgttaaggttaaaaccgtttattttttaaccggggaacccttttaaaaccgttttaaccttaaccgtttacgttaaacctaaaccgtaaacggttaaaccgtttaaaccctaaacccgttacccccgtcgggttaaccttaacccgttaaccgggtttacgggggaacgggttaaaccggggaaccggtaaaggggttcgaaacggttacgtaaaccgtaaaacggtaacgtttacgggacgggttacctcggttaaccctaaccg

SEQ ID NO: 412167 - DNA, 716 bp, Homo sapiens
  misc_feature: GZ8MTXP01C06P3.17.26.C04.1.454.CMB.2.raw
  modified_base (229)..(229): a, c, t, g, unknown or other
  modified_base (313)..(313): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatcgaccccagtcctcccatccctccctgtctgcatctgtaggagacagacgtcaccatcacttggccgganaagtcagagctaattagctagtcttaatttaaatggtatcagacaaggaaacagggaaactccctaaagcctctgacttcgttnctgacctatccgtagtttacgacgtaacggttccgggttaccccttagtaaggttcaaggttcggaactaagggttggaacgttccgggtaaaggggtaactaggttactttaccacttacctaccaacctataccgacggtacctagttaccgtactaacctaaccgtaagtaaggtttacttttacgaaactttaaaccgttaacttaacgtacgtaaactaaacgtaaacggttacgttaaaacccctaccgttacccccgtcggtaaacctttcccgggttaaacgggtttccgggggaacggggttaacgggaaccggttaaaaggggcgggttaaaaagttacgttaaaaccggtaaacgtacggttcggtacgacgttacgtaaccttaacgttcg

SEQ ID NO: 412168 - DNA, 671 bp, Homo sapiens
  misc_feature: GZ8MTXP01DLN0O.17.26.C04.1.454.CMB.2.raw
  modified_base (203)..(203): a, c, t, g, unknown or other
  modified_base (294)..(294): a, c, t, g, unknown or other
  modified_base (309)..(309): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatcgacccagtctccatccctcctgtctgactatcgtaggtagganacagtacgtcacctatctacgttggccggacaagtcagagactagtagctagtacttaattaatggtatcgagtacaagaaaccaggaacncccctaagctctagnttcttgactgctactcgtagttagacgtaagtccgggttacccttacggaagttcgagtcggacgtagtcggtatacgtagggactagttcttacacctctacaccgtatacgtatacgacgtctacgaccgtaacgttagtaacgttaatttacgtaacgttaaccttactaaccgtacgtaacctaaacgtacgttaaccgttaaacctaacccgtccccgtacgtccgtttaccgtaacgggtttacccggggaccggggtaaacgggttacccggtaaaggggtacgggttaaacgttaccgttaaaccgtaaacgttacggtgttacgggccttaacgtcccttaaccgtttaaccg

SEQ ID NO: 412169 - DNA, 556 bp, Homo sapiens
  misc_feature: GZ8MTXP01BPL01.17.26.C04.1.454.CMB.2.raw
  modified_base (197)..(197): a, c, t, g, unknown or other
  modified_base (223)..(223): a, c, t, g, unknown or other
  modified_base (372)..(372): a, c, t, g, unknown or other
  modified_base (410)..(410): a, c, t, g, unknown or other
  modified_base (429)..(429): a, c, t, g, unknown or other
  modified_base (532)..(532): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatcgacccagtctccatccctccctgtctgcatctgtagganacagagtcaccatcacgttggccggnaagtcagagcattagcagtacttaatttaaattggatcgagacaaagaaaccgagggaaacctccccgtaagcctctgtacttctttgctgctacttccgtagtttcgactaacgggtcgggtccttacgaggttcaggtggcaagtgntcgtaggactagtacttcactctcacatcagctagtcncgacaaaccttgaaagttntttacgaccttaactcgtactagtacaacagtactacaacctcccgtgtcctacgtcggttaacgggcggacggtaccaggtgaacgttacttacgaaaccgntggtgacctgacctaacgttcgtc

SEQ ID NO: 412170 - DNA, 619 bp, Homo sapiens
  misc_feature: GZ8MTXP01DOY83.17.26.C04.1.454.CMB.2.raw
  modified_base (200)..(200): a, c, t, g, unknown or other
  modified_base (228)..(228): a, c, t, g, unknown or other
  modified_base (292)..(292): a, c, t, g, unknown or other
  modified_base (401)..(401): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatcgacccagtctccatccctccctgtctgctatctgtagganacagagtcaccatcacgttcggccgganaagtcagagctaattgcagtacttaatttaaagtgtatcaagacaaagaaaccgagggtaaacncccctaaagctactgtacttctttgctgactatccgtagttcgactaaggttcggtaccccttagaaggttcagtggaactagtgatcgtaggatagtattcactctanactatacagctacggttctacgacctaaacgttagaaattcgtttacaacgtttaaactttacgtaacgtacgttaaccaaaacgttcgtaacgtttaaacccaccttacccccggtgtacctacggtaacggttcgggaccgggtaaacgggactaaggggcgttaacgttacttaacgtaaaccgagttcggacgacttcggaaccttaaccgttg

SEQ ID NO: 412171 - DNA, 596 bp, Homo sapiens
  misc_feature: GZ8MTXP01BG04W.17.26.C04.1.454.CMB.2.raw
  modified_base (199)..(199): a, c, t, g, unknown or other
  modified_base (222)..(222): a, c, t, g, unknown or other
  modified_base (231)..(231): a, c, t, g, unknown or other
  modified_base (287)..(287): a, c, t, g, unknown or other
  modified_base (380)..(380): a, c, t, g, unknown or other
  modified_base (397)..(397): a, c, t, g, unknown or other
  modified_base (409)..(409): a, c, t, g, unknown or other
  modified_base (411)..(411): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatcgacccagtctccatccctccctgtctgcatctgtagganacagatcacatcacttggccggnaagtcaganctattagcagtacttaatttaaagtggtatcagacaaggaaaccgagggtaaaccncccctaaagtcctctgtacttcttgctagctatcctagttacgactaaggttcgggtacccccttagtagttcaggtgaactggtgactacgngggtactagtacttacncctcacaccgtncngtacacgtctacgactaacgttagtacgttatttacgacgttaacgttactactacgtaaccaacgtacgtaacttaaccctaccgttccccgtacgtcttaccggtaacggtcggggacggacggttacggtaggtacgacttacgaacgtaacggtcgtcggacgtcacgtaaccgttctaag

SEQ ID NO: 412172 - DNA, 616 bp, Homo sapiens
  misc_feature: GZ8MTXP01DVHT1.17.26.C04.1.454.CMB.2.raw
  modified_base (139)..(139): a, c, t, g, unknown or other
  modified_base (227)..(227): a, c, t, g, unknown or other
  modified_base (261)..(262): a, c, t, g, unknown or other
  modified_base (277)..(277): a, c, t, g, unknown or other
  modified_base (291)..(291): a, c, t, g, unknown or other
  modified_base (410)..(410): a, c, t, g, unknown or other
tcagcgtagactagcacgaccggtgctcgatttagtctagcgactttgggtttggggggagtcagtctcagtcaggacacagcatggacatgagggtccccgctcagctcctggggctcctgctactctgctccgagtnccagatgtgacatccagatgacccagtctccatcccgtccctgtcctgcatctgtaggagactagagtcaccatcacgttgccggganaagtcatagctatgcagctattaaatggtatcannagtaaaccaggtaancccctaaagctccngactcttgctagcatcctagttacgtcaaaggttcggggtcccccttagaaacgggtttccaaggttggaccaaggttgaacgtccgtaggggaacaggtacttctaactctccacctntaccgatcaacggttctacgactacgtacgtaagtactttagacgttaaacttacgtaacgtacgtactaacgtacgtaaacgttacctaaccgttcccgtacgacccttcgtaaccggtttcggacgggtaacgggttaccgtaagggtacggaacgaacgttacgaaaccgtagtcggtacgtacgttccgtaacgaaccgtcg

SEQ ID NO: 412173 - DNA, 535 bp, Homo sapiens
  misc_feature: GZ8MTXP02G24ZL.17.26.C04.1.454.CMB.2.raw
  modified_base (375)..(375): a, c, t, g, unknown or other
tcagcgtagactagcacgaccggtgctcgatttagtctagcgactttgggtttggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaccaggaaagcccctaagctcctgatctttgctgcatccagtttgcaaagtggggtccttcaaggttcagtggcagtggatctgggacagatttcactctcaccatcagcagtcnacaactagaagtatttagactaaacttactactgtacaaacagtaagtaacaaactacccctcgctactacgtttcggacgggaacgggaaccgaaagggtacggaacgaacgtaacgaaaacgaaacgtacggtacggtacgtacgacgacctactacg

SEQ ID NO: 412174 - DNA, 766 bp, Homo sapiens
  misc_feature: GZ8MTXP02H3Q3Y.17.26.C04.1.454.CMB.2.raw
tcagcgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgctatcgtaggtaggagacgagtacgtaccaacctatacctacgttcgggcccgggaactaacgtcgaaggacgactaagttacgacgacgttactttaaatttaaaggttggtaactacgaacgacgaaaacggaaaaccggaaaggggaaacccccgtaccgtaaacggtcccttccgtagtactttcgtttcgctcgactacttacgtaggtttcgaaacgtaaggggtccggttacccccctaggtaaggttcgaggttcggacgtagggtgtacttggacgaactagttcttacacttccaaccacactacgacgacgttagttccgacaaaccctaacgtagtaaactttaagtttcaaacttaaaccttttaactaacgttacgtaaaccaaacgtaaaggttaacttaaacctaaaaccccgttaccccggtccgtacttaacccgttttaccggacccgggggttacggggaaaccgaaacccggttaaaggggtaacgtaaacgtaacgtaaaaccggaaaaaccgttcgtacgggttaacggacgttccggaaaccctaaacggtttacccg

SEQ ID NO: 412175 - DNA, 521 bp, Homo sapiens
  misc_feature: GZ8MTXP02GL3UB.17.26.C04.1.454.CMB.2.raw
  modified_base (218)..(218): a, c, t, g, unknown or other
  modified_base (367)..(367): a, c, t, g, unknown or other
tcagcgtagactagcacgaccggtgctcgatttagtctagcgactttgggtttggggtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggnaagtcagagcattagcagctattaaatgatcagcagaaaccaggaaagcccctaagctcctgatctttgctgcatccagtttgcaaagtggggtccttcaaggttcagtggcagtggatctgggacagatttcactctcaccatcgaancatctcacaactagtaagtattagtactaacttaactactagtacaacaagtagtaactaactacctaccgtactctacgttacggtacggacggaacgaacggtacggacgacgtaacgaaacgaacgtacgtacgacgtacgacactactcg

SEQ ID NO: 412176 - DNA, 487 bp, Homo sapiens
  misc_feature: GZ8MTXP02J11GA.17.26.C04.1.454.CMB.2.raw
  modified_base (323)..(323): a, c, t, g, unknown or other
  modified_base (487)..(487): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattagcagctattaaatggtatcagcagaaaccagggaaagcccctaagctcctgatctttgctgcatccagtttgcaaagtgggtcccctnagttcagtgcagtggatcgtgggacagatttcactctcaccatcagcagtctgcaactgaagtatttgactaacttactactgtacaacagtattacaaactcccctagctcacttcggcgacgggaccaaggtcgagatacaaacgactgtacgctcgcactn

SEQ ID NO: 412177 - DNA, 511 bp, Homo sapiens
  misc_feature: GZ8MTXP02IBIF6.17.26.C04.1.454.CMB.2.raw
  modified_base (268)..(268): a, c, t, g, unknown or other
  modified_base (301)..(301): a, c, t, g, unknown or other
  modified_base (500)..(500): a, c, t, g, unknown or other
tcagcgtagactagcacgaccggtgctcgatttagtctagcgactttgggtttggggtcagtctcagtcaggacacagcatggacatgagggtcccgctcagctcctggggctcctgctactctggctccgaggtgccagatgtgacatccagatgacccagtctccatcctcctgtctgcatctgtaggagacagagtcaccatcacttgccgggcaagtcagagcattagcagctattaaatggtatcagcagaaaccagggaaancccctaagctcctgatctttgctgcatcagttnacaaagtggggtcctcaaggttcagtggcagtggatcgtgggacagtattcactctcacatcagcagtctgcaacctgagtatttagctaaacttactaacttgtacaaacagtaacttaacaactaccccttggcctcaacgtttcgggaccggagggaacctaaagggtcgaacgattacaaaacgaactgtaggcngacactactcg

SEQ ID NO: 412178 - DNA, 531 bp, Homo sapiens
  misc_feature: GZ8MTXP02HCGH9.17.26.C04.1.454.CMB.2.raw
  modified_base (323)..(323): a, c, t, g, unknown or other
tcagcgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccagggaaagcccctaagctcctgatctttgctgcatccagtttgcaaagtgggtcccctnaagttcagtgcagtggatctgggacagtatttcactctcaccatcagcagtctgacaacctgaagtattttgactaactttactactgtacaaactagaacgtttaccaaactaccccctcggacctacctacgtttcgggacgggtaacgggaccaaacggggtgaacgatacgaaaacgaacgtaggtacggctcggacaacctac

SEQ ID NO: 412179 - DNA, 496 bp, Homo sapiens
  misc_feature: GZ8MTXP02IHI22.17.26.C04.1.454.CMB.2.raw
tcagcgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaccaggaaagccctaagctctgatctttgctgcatccagtttgcaaagtggggtccccttcaagttcagtgcagtggatctgggacagatttcactctcaccatcagcagtctgcaacctgaagaattttgctaaactttactactgtacaaacagaagttacaaactaccctcggactctactttcggccggaggaccaaggtcgagatacaaacgaactggcgctcgacaca

SEQ ID NO: 412180 - DNA, 487 bp, Homo sapiens
  misc_feature: GZ8MTXP02H9IHS.17.26.C04.1.454.CMB.2.raw
  modified_base (325)..(325): a, c, t, g, unknown or other
tcagcgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaccagggaaagcccctaagctcctgatcttgctgcatccagtttgcaaagtggggtccccttnaagttcagtgcagtggatctggggacagatttcactctcaccatcagcagtctgcaacctgaagattttgactaactttactactgtacaacagattacaataccctgctcactttcggcgtaggaccaaaggtcgagatacaaacgactgtagctgcacca

SEQ ID NO: 412181 - DNA, 495 bp, Homo sapiens
  misc_feature: GZ8MTXP02IPQ62.17.26.C04.1.454.CMB.2.raw
  modified_base (382)..(382): a, c, t, g, unknown or other
  modified_base (473)..(473): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatgtatcagcagaaaccaggaaagcccctaagctcctgatctttgctgcatccagtttgcaaagtgggtcccctcaagttcagtgcagtggatctgggacagatttcactctcaccatcagcagtctgcaaaccngaagtattttgacaaactttactacttgtacaaacagaattacaaatacccctacgctctactttcggacgacgggaccaaggtcgaacgntacaaagaactgtgctgcacta

SEQ ID NO: 412182 - DNA, 554 bp, Homo sapiens
  misc_feature: GZ8MTXP02G51OJ.17.26.C04.1.454.CMB.2.raw
  modified_base (195)..(195): a, c, t, g, unknown or other
  modified_base (274)..(274): a, c, t, g, unknown or other
  modified_base (445)..(445): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagctaattaaatggtatcagcaagaaaccagggaaacncccctaaagctcctgatctttgctgctatccagtttgactaaaggtcggggttcccttacgaaggttccagtggctaggtgatcgtagggacagtatttcactctcaccatcagccagtctcgactaaccgtagtaaagtattttagacttaaacttactactgtacaaanagtattaacaactaccctcgtacctactacgtttacggacggaggtaccgaaagggtacggacgtaactaacgaaaacgtaacgtggtacgactagacctaccattccg

SEQ ID NO: 412183 - DNA, 519 bp, Homo sapiens
  misc_feature: GZ8MTXP02I4IMW.17.26.C04.1.454.CMB.2.raw
  modified_base (345)..(345): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccagggaaacgcccctaagctcctgatctttgctgcatccagtttgcaaagtggggtcccttcgaaggttcagtggcagtggntctggggacagatttcactctcaccatcagcagtctcgacaacctgaagtattttagactaaactttactactgtacaaacagagttacaactacccctggactctacgtttcggcggaaggaccgaaaggtcggagactacgaaaacgaacgtgtacggactcgcaccattcc

SEQ ID NO: 412184 - DNA, 488 bp, Homo sapiens
  misc_feature: GZ8MTXP02IVZLB.17.26.C04.1.454.CMB.2.raw
tcagcgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggcaagtcagagcattagcagctatttaaattggtatcagcagaaaccagggaaagccctaagctcctgatctttgctgcatccagtttgcaaagtggggtccccttcaagttcagtgcagtggatctgggacagatttcactctcaccatcagcagtctgcaacctgaagtattttgcaacttactactgtacaacagagttacaataccctacgctcactttcggcggacgggaccaaggtgagatcaaagaactgtacgcttcacatc

SEQ ID NO: 412185 - DNA, 523 bp, Homo sapiens
  misc_feature: GZ8MTXP02GWKGU.17.26.C04.1.454.CMB.2.raw
  modified_base (404)..(404): a, c, t, g, unknown or other
  modified_base (512)..(512): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcaagaaaccaggaaacgcccctaagctcctgatctttgctgcatccagtttgacaaaggtcggggtccccttgaaggttcagtggcagtggatcgtaggggacagtatttcactctcaccatcagcagtctgcaactgaatatttnactaacttactactgtacaaactagaattacaacttacccctgccttctaacgtttcggacggacgggaaccaagggtcgaagactacgaaacgtaactggtacggcncggacactacg

SEQ ID NO: 412186 - DNA, 502 bp, Homo sapiens
  misc_feature: GZ8MTXP02GE1FD.17.26.C04.1.454.CMB.2.raw
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccagggaaagcccctaagctcctgatctttgctgcatccagtttgcaaagtggggtcccccttcaaggttcagtggcagtggatctggggacagatttcactctcaccatcagcagtctgcaacctgaagtattttgctaacttactactgtacaacagagttacaactacccctcggctcactttcggcggacggaccaaggtgacgatacgaaaacgactagtcggctcgcactac

SEQ ID NO: 412187 - DNA, 536 bp, Homo sapiens
  misc_feature: GZ8MTXP02JU494.17.26.C04.1.454.CMB.2.raw
  modified_base (275)..(275): a, c, t, g, unknown or other
  modified_base (330)..(330): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaccagggaaacncccctaagctcctgatctttgctgcatccagtttgcaaaggtcggggtccccctnaaggttcagtggcagtggatcgtggggacagtatttcactctcaccatcagcagtctgcaacctgaatattttgactaacttactactagtacaaacagtaacgttaacaactaccccctcggtactccgtaacgtttcgggacgggaacgggacccgtaaacggtgaacgtactacgaaacgtactaggtcgactgaccactacg

SEQ ID NO: 412188 - DNA, 483 bp, Homo sapiens
  misc_feature: GZ8MTXP02JD2PH.17.26.C04.1.454.CMB.2.raw
  modified_base (222)..(222): a, c, t, g, unknown or other
  modified_base (414)..(414): a, c, t, g, unknown or other
  modified_base (445)..(445): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagctattaaatggtatcagcagaaaccagggaaagcccctaagctcctgatctttgctgcatccagtttgcaaagtggggtcccccttcaaggttcagtgcagtggatcgtgggacagatttcactctcacaatcagcagtctgcaacctgatgattttgactaacttattacttnaccaacagtatcatcatcattgtaattcggngtacggcaaggtgagtcgaacgaacgtgtaggctgcac

SEQ ID NO: 412189 - DNA, 531 bp, Homo sapiens
  misc_feature: GZ8MTXP02F1RWR.17.26.C04.1.454.CMB.2.raw
  modified_base (259)..(259): a, c, t, g, unknown or other
  modified_base (354)..(354): a, c, t, g, unknown or other
  modified_base (357)..(357): a, c, t, g, unknown or other
  modified_base (366)..(366): a, c, t, g, unknown or other
tcagcgtagactagcacgaccggtgctcgatttagtctagcgactttgggtttgggggagtcagtctcagtcaggacacagcatggacatgagggtccccgctcagctcctggggcccctcgctactctggctccgacggtgccagatgtgacatccagatgacccacgtctccatcctccctgtctgcatctgtaggagacagagtcaccatcacttgccgggcaagtcagagcattagcagctatttaaattggatnagcagaaaccagggaaagcccctaagctcctgatctttgctgcatcccagtttgccaaaagtcggggtcccttcaaaggttcagtggcagtgggntcnggggacagntttcactctccacatcagcagtctcgactaaaccctgtaaagatttttagacctaaactttactacttgtacaaacagtattaacactaacccgtcgctactacgtttcggacggagggaccgaaaggtggagactacaaacggaacttggagctgaccacattc

SEQ ID NO: 412190 - DNA, 487 bp, Homo sapiens
  misc_feature: GZ8MTXP02J3LA8.17.26.C04.1.454.CMB.2.raw
tcagcgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccaggaagcccctaagctctgatctttgctgcatccagtttgacaaagtgggtcccctcaaggttcagtgcagtggatctgggacagatttcactctcaccatcagcagtctgcaacctgaagtattttgctaacttactactgtacaacagtatacaactaccctgactcactttcggcggacgggaccaaggtcgagatacgaacgaactgcggctcgcactc

SEQ ID NO: 412191 - DNA, 550 bp, Homo sapiens
  misc_feature: GZ8MTXP02J1JWA.17.26.C04.1.454.CMB.2.raw
  modified_base (381)..(381): a, c, t, g, unknown or other
tcagcgtagactagcacgaccggtgctcgatttagtctagcgactttgggtttggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccagggaaagcccctaaagctcctgatctttgctgcatccagtttgcaaagtggggtcccttcaaaggttcagtggcagtggatctggggacagatttcactctcaccatcaagcagtctnacaactagaagtatttagtactaacttaactactagtacaaacaagtaagttaactaaactaaccctaccgtaccgtactacgttacggtacgggaacgggaaccggaaacggtacggaacgaacgtaacaaaacgaaacgtacgtacggtacgtacgacacctactcg

SEQ ID NO: 412192 - DNA, 511 bp, Homo sapiens
  misc_feature: GZ8MTXP02GUHDW.17.26.C04.1.454.CMB.2.raw
  modified_base (305)..(305): a, c, t, g, unknown or other
  modified_base (335)..(335): a, c, t, g, unknown or other
tcagcgtagactagcacgaccggtgctcgatttagtctagcgactttgggtttggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaccaggaaagcccctaagctcctgatctttgctgcatccagtttncaaagtggggtcctcaagtcagtgcagtgntctgggacagatttcactctcaccatcagcagtctgcaactgaagtattttagctaaacttactactgtacaacagtaacgttacaactaacccctcggactacaacgtttcggccgggaaggaccgtaaggtcggagaactacgaaacgaacgtgtacggactggacaccattcg

SEQ ID NO: 412193 - DNA, 559 bp, Homo sapiens
  misc_feature: GZ8MTXP02GM3X3.17.26.C04.1.454.CMB.2.raw
  modified_base (196)..(196): a, c, t, g, unknown or other
  modified_base (278)..(278): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacttggccggcaagtcagagcattagcagctaatttaaattggtatcagcaagaaaccgagggaaacncccctaagctcctgatctttgctgctatcctagtttgacgtaaaggtcggggttacccttacgtaaaggttcaaggttggacgtaggttgggatcgtagggggaactaggtactttcaacttctaccacctatcaagtcaagtctcgactaaaccgtgaaagtatttagactaaactttactactgtacaagaagtactttaacaactacccctggtctactacgtttcggacggtaggaccaaggtcgagactacgaaagaactgtacgctgacacattc

SEQ ID NO: 412194 - DNA, 532 bp, Homo sapiens
  misc_feature: GZ8MTXP02I7EJC.17.26.C04.1.454.CMB.2.raw
  modified_base (272)..(272): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaacagggaaancccctaagctcctgatctttgctgcatccagtttgcaaagtgggtccccttcaaggttcagtggcagtggatcgtgggacagtatttcactctcaccatcagcagtctgacaacctgaacgtattttgactaaactttactactgtacaacagtagtacaaactacccctcggctctaccgtttcgggacggtaacgggaaccgtaaagggtcggaagacgtaacgaaaacgaaccgtaggtcggctacggacaacctac

SEQ ID NO: 412195 - DNA, 558 bp, Homo sapiens
  misc_feature: GZ8MTXP02J22BC.17.26.C04.1.454.CMB.2.raw
  modified_base (197)..(197): a, c, t, g, unknown or other
  modified_base (275)..(275): a, c, t, g, unknown or other
  modified_base (309)..(309): a, c, t, g, unknown or other
  modified_base (416)..(416): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagcttattaaatggtatcagacagaaaccgaggaacnccctaagctcctgatcttgctgctatccagtttnacgtaaaggtcgggtccccctagaagttcaggtgcaggtggatcgtggactagtactttcactctaccacatcgagctacgtctacgactaacgtgtaagtagtttntacactttaactactacgtacaacagtaacgtaactactacccgtccgtacgtactaccgttacggacggtacggggaaccgtaggtacgaggtaacgtaacgtaaccgaaacgtacgtcggtaccgtacgtacaccgtacg

SEQ ID NO: 412196 - DNA, 522 bp, Homo sapiens
  misc_feature: GZ8MTXP02I9KWF.17.26.C04.1.454.CMB.2.raw
  modified_base (276)..(276): a, c, t, g, unknown or other
  modified_base (453)..(453): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcaagaaaccagggaaacncccctaagctcctgatctttgctgcatccagtttgactaaaggtcggggtcccccttacgaaggttcagtggcagtggatcgtaggggactagtatttcactctcaccatcagcagtctgacaacctgaagtatttagactaacttactactgtacaacgagtactacaactacccngctctacgttcggcggacggaccaagggtcgaacgactacgaaacgtactaggtcggactcgacactac

SEQ ID NO: 412197 - DNA, 550 bp, Homo sapiens
  misc_feature: GZ8MTXP02I9AEC.17.26.C04.1.454.CMB.2.raw
  modified_base (273)..(273): a, c, t, g, unknown or other
  modified_base (423)..(423): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacttgccggcaagtcagagcattagcagctaattaaatggtatcagacaagaaaccagggaaacncccctaagcctcctgatctttgctgcatcctagtttgacgtaaaggtcggggttacccttacgtaaaggttcaggtggacgaggttgggatcgtggggaactagtatttacacttctacacatcagcagtctgacaactagaagtatttnactaacttactactgtacaaacagtacttaacaactacccgtgtactcgtaacgttcggacgggtaacggaccgtaaagggtcggaagaactacgaaaacgaacgtgtacggctagactactattcg

SEQ ID NO: 412198 - DNA, 484 bp, Homo sapiens
  misc_feature: GZ8MTXP02F2GB7.17.26.C04.1.454.CMB.2.raw
tcagcgtagactagcacgaccggtgctcgatttagtctagcgactttgggtttggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatgtatcagcagaaaccagggaaagcccctaagctcctgatctttgctgcatccagtttgcaaagtgggtcctcaaggttcagtgcagtgatctgggacagatttcactctcaccatcagcagtctgcaactgaagatttgcaaacttactactgtacaacagagttacaatacccctgctcacgtttcggcggaggaccaaggtcggagactcaaacgaacgtgtaggactgcaccatc

SEQ ID NO: 412199 - DNA, 545 bp, Homo sapiens
  misc_feature: GZ8MTXP02IL1XW.17.26.C04.1.454.CMB.2.raw
  modified_base (193)..(193): a, c, t, g, unknown or other
  modified_base (273)..(273): a, c, t, g, unknown or other
tcagcgtagactagcacgaccggtgctcgatttagtctagcgactttgggtttggggtcagtctcagtcaggacacagcatggacatgagggtcccgctcagctcctggggctcctgctactctggctccgaggtgccagatgtgacatccagatgacccagtctccatcctccctgtctgcatctgtagganacagagtcaccatcacttgccgggcaagtcagagcattagcagcttaattaaatggtatcagcaagaaaccagggaaacncccctaagctcctgatcttgctgctatccagtttgactaaaggtcggggttcccttacgaaggttccaggtggcaggtggatcgtggggactagtactttcacttctacacatcagctagtctcgtacaacctagaagtatttagactaaacttacttactgtacaaacagtagtaacaactaccctcgactcacgtttcggacggacggacgtaacggtaggacgtaacgtacgaaaacgaacgtaggtacgtacgtacgactaccactcg

SEQ ID NO: 412200 - DNA, 549 bp, Homo sapiens
  misc_feature: GZ8MTXP02JMAO2.17.26.C04.1.454.CMB.2.raw
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctaatttaaattggtatcagcagaaaccagggaaacgcccctaagctcctgatctttgctgcatccagtttgactaaaggttcggggtcccccttagaaggttcaggtggacagtggatcgtgggacagtatttcactctcaccatcagcagtctgacaactagaacgtatttgactaactttactactgtacaacagtaagttaacaactacccctcggtcctctacgtttcgggacgggtaacgggaccgaaagggttcggaagtaactacgaaaacgtaacgtaggtacggactcggaccactacg

SEQ ID NO: 412201 - DNA, 543 bp, Homo sapiens
  misc_feature: GZ8MTXP02GUW2D.17.26.C04.1.454.CMB.2.raw
  modified_base (275)..(275): a, c, t, g, unknown or other
  modified_base (357)..(357): a, c, t, g, unknown or other
  modified_base (530)..(530): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcaagaaaccagggaaacncccctaagctcctgatctttgctgcatcctagtttgactaaaggtcggggtcccttacgaaaggttcaggtggctaggtggntcgtggggacagtactttcactctcaccatcagcagtctgacaactgaattatttgactaaacttactactagtacaacagtacttaacaactacccctcggacttcgtacgtttcgggacggtacgggaaccgtaagggtacggagactacgaaaacgaacgtagtcggacncgacctactatcg

SEQ ID NO: 412202 - DNA, 514 bp, Homo sapiens
  misc_feature: GZ8MTXP02GT1Q1.17.26.C04.1.454.CMB.2.raw
  modified_base (324)..(324): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcatagcagctattaaatggtatcagcagaaaccaggaaacgcccctaagctcctgatctttgctgcatccagtttgcaaagtgggtccccttnaagttcagtgcagtggatcgtgggactagatttcgctctcaccatcagcagtctgcaactgaagtatttgactaactttactacttgtacaacgtagtagttacaaactacccctcggtctcgtacgtttcgggacggacgggaccgaaaggtggaagagtacaaaacgactcgtaggctcgacaacctc

SEQ ID NO: 412203 - DNA, 530 bp, Homo sapiens
  misc_feature: GZ8MTXP02GBAG2.17.26.C04.1.454.CMB.2.raw
  modified_base (274)..(274): a, c, t, g, unknown or other
  modified_base (310)..(310): a, c, t, g, unknown or other
  modified_base (330)..(330): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccagggaaancccctaagctcctgatctttgctgcatcctagtttnacaaagtcggggtccccttnaaggttcagtggcagtgatcgtgggacagtatttcactctcaccatcagcagtctagacctaaccgtagaagtattttacgactaaactttaactacttagtacaaacagtaacttaacaactacccctcggtactctacgtttcggacggtacggaccgaaggtgaacgatacgaaacgaactgtacgctacgacacta

SEQ ID NO: 412204 - DNA, 584 bp, Homo sapiens
  misc_feature: GZ8MTXP02JAI80.17.26.C04.1.454.CMB.2.raw
  modified_base (347)..(347): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattagcagctattaaatggtatcagcagaaaccagggaaacgcccctaagctcctgatcttgctgcatcctagtttgactaaagtcggggtacccttcgaaggttcagtggcagtggntcgtgggacagtatttcactctacaccatcagcagtctcgacaacgtgaacgttattttacgacttaaacttactactacgttacaaacgtagtaacttaacaacgttacccctaggtcctacgtacgtttaccgggacgggtaacgggtaaccgaaagggttcggaaacgtaacgttaaccgaaaaccgtaacgttaggtacggtaccgttacggaccctaccgtaacgtttcccg

SEQ ID NO: 412205 - DNA, 593 bp, Homo sapiens
  misc_feature: GZ8MTXP02ISKFR.17.26.C04.1.454.CMB.2.raw
  modified_base (220)..(220): a, c, t, g, unknown or other
  modified_base (460)..(460): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagcttaatttaaattggtatcagcaagaaaccgagggaacacccctaagctcctgtattctttgctgctattccgtagtttcgacgtaaagggttcggggttacccctttacgtaagggttcaaggttcgggacgtaaggttgggagttccgttagggggaacctagttactttacaccttctaccaccatcagctagtactcgactaactagaaagtatttanaacttaacttactactcgtacaaacgagtaacttaacaacttaacccgtcgtactacgtacgtttcgggacggtacggaccgaaagggtcgagaactacgaaaagtaacgtggtacggactcgactacattcg

SEQ ID NO: 412206 - DNA, 532 bp, Homo sapiens
  misc_feature: GZ8MTXP02HA3Q0.17.26.C04.1.454.CMB.2.raw
  modified_base (219)..(219): a, c, t, g, unknown or other
  modified_base (270)..(270): a, c, t, g, unknown or other
  modified_base (425)..(425): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggnaagtcagagcattagcagctattaaatggtatcagcaagaaaccagggaancccctaagctcctgatcttgctgcatccagtttgactaaaggtcggggtccctacgaaggttcagtggcagtggatcgtgggacagtatttcactctcacatcagcagtctgacaactagtaagtatttagactaaacttactactacgtacaanagtaacttaacaactacccgtcggtactcgtaccgtttacggacggtagggaccgaagggtacgaagtactacgaaaacgtaacgtgtacggtctagacacacttcg

SEQ ID NO: 412207 - DNA, 558 bp, Homo sapiens
  misc_feature: GZ8MTXP02JZN2V.17.26.C04.1.454.CMB.2.raw
  modified_base (274)..(274): a, c, t, g, unknown or other
  modified_base (329)..(329): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccagggaaacncccctaagctcctgatctttgctgcatccagtttgctaaagtcggggtccccttnaaggttcagtggcagtggatcgtgggacagtatttcactctcaccatcagcagtctgacaacctgaagtattttagactaaacttactactgtacaaacgtagtaacgttaacaacttacccccgtcggtacttacgtaacgtttcgggacgggtaacgggtaacccgaaagggtcggaacgtaacgtaaccgaaaacgtaacgtaggtcggtacctggaccacctacg

SEQ ID NO: 412208 - DNA, 552 bp, Homo sapiens
  misc_feature: GZ8MTXP02I6EUZ.17.26.C04.1.454.CMB.2.raw
  modified_base (277)..(277): a, c, t, g, unknown or other
  modified_base (389)..(390): a, c, t, g, unknown or other
  modified_base (405)..(405): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccgggcaagtcagagcaattagcagcttaattaatggtatcagcaagaaaccgagggaaacncccctaagcctacctgatctttgctgcatcctagtttgacgtaaaggtcggggtaccttacgaagttcaggtgcagtggatcgtagggacagtattcactctacacatcagnngtctgacactgaatntttagactaacttactactgtacaacgagtacttaacaacttaccccgtagtacctactaccgtttcgggacggtaaggggaaccgtaaagggtacggaagaacgtaacgaaaaccgtaagtaggtacggactagaccacctattcc

SEQ ID NO: 412209 - DNA, 535 bp, Homo sapiens
  misc_feature: GZ8MTXP02IZ9ID.17.26.C04.1.454.CMB.2.raw
  modified_base (272)..(272): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaattgtatcagcagaaaccaggaaacncccctaagctcctgatctttgctgcatccagtttgcaaaggtcggggtccccttagaaggttcagtgcagtggatcgtgggactagtatttcactctacaccatcagcagtctgacaacctgaatatttagactaaactttactactgtacaaacagtagttaacaacttacccctacgacttacgtacgtttcggacgggtacggaaccgaagggtacgaagaactacgaaacgtaacgtacgtaggtctacgaccacgtac

SEQ ID NO: 412210 - DNA, 493 bp, Homo sapiens
  misc_feature: GZ8MTXP02ICUVZ.17.26.C04.1.454.CMB.2.raw
  modified_base (361)..(361): a, c, t, g, unknown or other
tcagcgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccaggaaagcccctaagctcctgatctttgctgcatccagtttgcaaagtggggtccccttcaaggttcagtggcagtggatctggggacagatttnactctcaccatcagcagtctgcaacctgaagattttgctaaacttactactgtacaacagattacaactaccctgctcactttcggacgaggaccaaaggtgagatacaaacgaactgtaggctcgcaccta

SEQ ID NO: 412211 - DNA, 517 bp, Homo sapiens
  misc_feature: GZ8MTXP02HTA7S.17.26.C04.1.454.CMB.2.raw
  modified_base (267)..(267): a, c, t, g, unknown or other
  modified_base (417)..(417): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggcaagtcagagcattagcagctattaaatggtatcagcagaaacaggaancccctaagctcctgatcttgctgcatcctagtttgactaaagtcggggtccttacgaagttcagtggctaggtggatcgtgggactagtatttcactctcaccatcagcagtctgacaactgatatttagctaattactactgtacaaanagtaagttacaaactccccgtacgtactcgtaacgtttcggaccgggtaggaaccaagggtagacgactacgaaacgaacgtggtacgctagcactatcg

SEQ ID NO: 412212 - DNA, 554 bp, Homo sapiens
  misc_feature: GZ8MTXP02G97D7.17.26.C04.1.454.CMB.2.raw
  modified_base (279)..(279): a, c, t, g, unknown or other
  modified_base (395)..(395): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctaatttaaattggtatcagcaagaaaccgagggaaacncccctaagctcctgatcttgctgcatcctagtttgactaaaggtcggggtcccccttagaaggttcagtggcagtggatcgtgggacagtatttcactctacaccatcagcagtcngacaactagaagtatttgactaacttactactagtacaacgtagtattaaccaaacttcccctaggtctactaccggtttcggacgggtacggaaccgtaagggtacggaagtaacgtaacgaaaacggtaacgtggtacggactacggaccaactacg

SEQ ID NO: 412213 - DNA, 512 bp, Homo sapiens
  misc_feature: GZ8MTXP02JZZQP.17.26.C04.1.454.CMB.2.raw
  modified_base (269)..(269): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatgtatcagcagaaacaggaaacncccctaagctcctgatcttgctgcatcctagtttgacgtaaaggtcggggtacccttacgaaggttcagtggcaggtggatcgtgggacagtatttcactctacacatcagcagtctgcaactgaagtatttgactaacttactactgtacaactagagttacaactaccctcggactcgtacgttcggcggtagggaccaaggtgacgactacgaaacgtaacgtgacgctgacctacgatc

SEQ ID NO: 412214 - DNA, 558 bp, Homo sapiens
  misc_feature: GZ8MTXP02F0CXN.17.26.C04.1.454.CMB.2.raw
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccaggaaagcccctaagctcctgatctttgctgcatcctagtttgctaaaggtcggggtcccccttcgaaggttcaggtggcagtggatcgtgggacagtatttcactctcaccatcagcagtctgacaacctgaatatttgactaacttactactgtacaaactagtaacgttaacaacttacccctcggtcttacaccgtttcgggaccggtaacggggaacccgtaaaggggtcggaaacgtacgtaacgaaaaccgtaacgtacggtacggtccgtacgaccacctaacg

SEQ ID NO: 412215 - DNA, 524 bp, Homo sapiens
  misc_feature: GZ8MTXP02FVIPZ.17.26.C04.1.454.CMB.2.raw
  modified_base (271)..(271): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggcaagtcagagcattagcagctattaaatgtatcagcagaaaccagggaaancccctaagctcctgatcttgctgcatccagtttgactaaaggtcggggtcccccttagaaggttcaggtggcagtgggatcgtggggacagtatttcactctcaccatcagcagtctgacaactagaatatttagactaaactttactaacttgtacaaacgtagacgttaacaaactaccctaggtctactacgttcggacggtaggaccgaaggtcgagtacacaaacgaacgtgtacggctgaccactac

SEQ ID NO: 412216 - DNA, 565 bp, Homo sapiens
  misc_feature: GZ8MTXP02HHQTZ.17.26.C04.1.454.CMB.2.raw
  modified_base (219)..(219): a, c, t, g, unknown or other
  modified_base (269)..(269): a, c, t, g, unknown or other
  modified_base (335)..(335): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggnaagtcagagcattagcagctattaaatggtatcagcagaaaccaggaaancccctaagctcctgatcttgctgcatccagtttgctaaagtggggtcctcgagttcagtgcagtgntcgtgggacagtattcactctcacatcagcagtctgacaactgaagtatttgacttaaacttactatacgtacaactaagtacgttaacaacttaccccgtcggtaccttacgtaaccgtttacggggccgggtaaacggggaacccgtaaaggggttacggaacgtaacgttaaccgaaaacggtaaaccgttggtacgggtacttacggacctaaccgtactttccgg

SEQ ID NO: 412217 - DNA, 521 bp, Homo sapiens
  misc_feature: GZ8MTXP02FPQ4E.17.26.C04.1.454.CMB.2.raw
  modified_base (197)..(197): a, c, t, g, unknown or other
  modified_base (271)..(271): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagctattaaatgtatcagcagaaaccaggaaancccctaagctcctgatctttgctgcatccagtttgcaaagtggggtccccttgaagttcagtgcagtggatcgtgggacagtatttcactctcaccatcagcagtctgacaacctgaagtatttgactaacttactactgtacaaactagtacttaacaactacccctcgtctactacgtttcgggacggtacgggaccgaagggtcggaagataacaaaacggtactaggtacggactcggaccactac

SEQ ID NO: 412218 - DNA, 592 bp, Homo sapiens
  misc_feature: GZ8MTXP02FSOOF.17.26.C04.1.454.CMB.2.raw
  modified_base (359)..(359): a, c, t, g, unknown or other
  modified_base (382)..(382): a, c, t, g, unknown or other
  modified_base (436)..(436): a, c, t, g, unknown or other
  modified_base (503)..(503): a, c, t, g, unknown or other
tcagcgtagactagcacgaccggtgctcgatttagtctagcgactttgggtttggggtacgatttgatgttacctgatgcttagaggcttttcctggaagcagggcatttgttgcttcagcaccgtagtgccccgtcatcacgcctcagccttgatttttccggatttgcctaggaaaaccagcctacacgcttaaaccgggacaaccgtcgcccggcaacatagccttctcccgtcccccttgcagtaacaccaagtacaggaatattaacctgtttcccatcgactacgcctttcggcctcgccttaggggtcactcacctgccccgattaacgtgacagacccttggtcttccggngagcggtctttcaccgtctttancgttactatcgtcagcattcgctacttctgactacctccagcatcgctcacacncacaccttacacacgcttacacaacgcctacccctacccaacaacacataagacgcgctcgccgccncgtcgtcgtcgtacgtagttacggttaccgttcccgttacctaccttccctcccgtccgtactactacgtacgtacgtaccgtacgtcg

SEQ ID NO: 412219 - DNA, 561 bp, Homo sapiens
  misc_feature: GZ8MTXP02HAVMV.17.26.C04.1.454.CMB.2.raw
  modified_base (224)..(224): a, c, t, g, unknown or other
  modified_base (280)..(280): a, c, t, g, unknown or other
  modified_base (386)..(386): a, c, t, g, unknown or other
  modified_base (403)..(403): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctggtaggagacagagtcaccatcacttgccgggnaagtcagagcattagcagcttaattaaattggtatcagcaagaaaccgaggaaacncccctaagctcctgattctttgctgctatacctagtttgacgtaaaggttcggggtcccccttagaggttcaggtgacgagtggatcgtgggacagtattcactcncaccatcagctagtccngactaactgaatatttgactaactttacactagtacaacgtagtacttacaacttccctggtacctctaaccggttcggaccgggaacgggtaccaaaggggtcgaaaacgtacgtaacgaaaacgtaacgttggacggtactacggacctaactacg

SEQ ID NO: 412220 - DNA, 557 bp, Homo sapiens
  misc_feature: GZ8MTXP02IRBHD.17.26.C04.1.454.CMB.2.raw
  modified_base (273)..(273): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaacaggaacnccctaagctcctgatctttgctgcatccagtttgcaaagtcggggtcccctgagttcagtgcagtggatcgtgggacagtatttcactctcacatcagcagtctgcaacctgaagtatttgctaacttactactgtaccaaactagtagttaacaacttaccccgtcggtcctacgtaaccgtttcgggacgggtaacggggaaaccgaacggggttaggaacgtaacgttaaccgaaaaccggtaacgttcggttacgggccttacggacctaaccgttaacg

SEQ ID NO: 412221 - DNA, 547 bp, Homo sapiens
  misc_feature: GZ8MTXP02F8MB3.17.26.C04.1.454.CMB.2.raw
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcaagaaaccagggaaacgcccctaagctcctgattcttgctgcatcctagtttgactaaaggtcggggtacccccttacgaaggttcaggtggcagtggatcgtgggactagtatttcactctacaccatcagcagtctgactaactagaagtatttgactaacttactactgtacaaacgagtaacgttaacaacgttacccctcgtcttctaacgtttcgggacgggacgggaccgaagggtggaacacgtaacgaaaacgtaacgtcggtacggctacgaccactac

SEQ ID NO: 412222 - DNA, 500 bp, Homo sapiens
  misc_feature: GZ8MTXP02F67JY.17.26.C04.1.454.CMB.2.raw
  modified_base (271)..(271): a, c, t, g, unknown or other
  modified_base (306)..(306): a, c, t, g, unknown or other
  modified_base (341)..(341): a, c, t, g, unknown or other
tcagcgtagactagcacgaccggtgctcgatttagtctagcgactttgggtttggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaccagggaaancccctaagctcctgatctttgctgcatccagtttncaaagtggggtccttcaaggttcagtggcagtggntctgggacagatttcactctcaccatcagcagtctgcaacctgaagtattttagctaaacttactactgttacaacagagttacaactaccctcggctcactttcggacggtagggaccaagggtcgagactacaaacgaacgtgtagctgcaccgatc

SEQ ID NO: 412223 - DNA, 576 bp, Homo sapiens
  misc_feature: GZ8MTXP02H4935.17.26.C04.1.454.CMB.2.raw
  modified_base (197)..(197): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatcacttgccgggcaagtcagagcattagcagtctattaaattgtatcagcaagaaaccaggaaacgccctaagctcctgattctttgctgcatctagtttgcaaaggtcgggtaccccttgagttcagtggactagtggatcgtggggactagtattcactctcacatcagctagtctagcctaaaccgtgtaaagttattttacgacttaaactttaccttaacgtcgttaccaaacgtaagtaacgtttaaccaacgtacccccgtgaccttaccgtacgtttaccgggcgggaaacgggtaccgaaagggttcggaagacgtaacgaaaacgtaacgtacggtcggtactcggaccttaactacg

SEQ ID NO: 412224 - DNA, 594 bp, Homo sapiens
  misc_feature: GZ8MTXP02H2QKF.17.26.C04.1.454.CMB.2.raw
  modified_base (220)..(220): a, c, t, g, unknown or other
  modified_base (344)..(344): a, c, t, g, unknown or other
  modified_base (396)..(396): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagctaatttaaatggtatcagacaagaaaccgaggaacgcccctaagctcctgatctttgctgcatcctagtttgactaagtcgggtccttgaagttcagtgcagtgntcgtggacagtatttcactctcacatcagcagtctacgacaacctagaagtnttttacgactaaactttactacgttactactaaacagtaacttaactaaacctaccccgtacggtacctacgtaccggtttaccgggacgggttaaacggggaaacccgtaaaaggggttacggaagtaaaccgttaaaccgaaaacggtaaaccgtggttaacgggccttacggacccgtaaccgtaacgtttcccg

SEQ ID NO: 412225 - DNA, 544 bp, Homo sapiens
  misc_feature: GZ8MTXP02FM1PH.17.26.C04.1.454.CMB.2.raw
tcagcgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccaggaaagcccctaagctcctgatctttgctgcatccagtttgcaaaggtggggtcccccttgaaggttcagtggcagtggatcgtggggacagtatttcactctcaccatcagcagtctgcaacctagaacgtattttgactaacttactactgtacaacagtagttacaaactacccctacggctactaccgtttcgggcggacgggaacccgaaagggtacggaacgaagttaccgaaaacgtaacgtacggtaggtacctacggaccacccgtaag

SEQ ID NO: 412226 - DNA, 559 bp, Homo sapiens
  misc_feature: GZ8MTXP02HSZ3C.17.26.C04.1.454.CMB.2.raw
  modified_base (220)..(220): a, c, t, g, unknown or other
  modified_base (275)..(275): a, c, t, g, unknown or other
  modified_base (466)..(466): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagctattaaattggtatcagcaagaaaccgagggaaacncccctaagctcctgattctttgctgctattcctagtttcgacgtaaaggttcggggtcccttacgtaaggttcaggtggctaggtggagtcgtagggactagtatttcactctcaccatcagctagtctgactaacgtagaagtatttcgactaactttactactgtacaatagtattaacaacgtccccngtactcgtacgtttcggacgggtacggacctaagggtacggacgtaactaccgaaaacgtaacgtcggtacgtcacgacctacgtacgtttcg

SEQ ID NO: 412227 - DNA, 601 bp, Homo sapiens
  misc_feature: GZ8MTXP02HZ3PU.17.26.C04.1.454.CMB.2.raw
  modified_base (180)..(180): a, c, t, g, unknown or other
  modified_base (377)..(377): a, c, t, g, unknown or other
  modified_base (499)..(499): a, c, t, g, unknown or other
  modified_base (531)..(531): a, c, t, g, unknown or other
tcagcgtagactagcacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaccgggacaaccgtcgcccggccaacatacgccttctccgtcccccttcgcagtaacaccaagtacagaatattaacctgttcccatcgactacgcttcgctcgcttagggcactcacctgccccgattacgtggacaggaacccttggtctcggcgagcgggtcttttcgacccgtctttancgtttacttacgtgtcagcattccgctcttctgtactacctccagtcatcgcctcacacgccaactaccgttcacacggtacttacgacgaacctcctacccctaacccgaacaaccgcaanaacgcgtacgctcgccgacgacgtctttcggngtacctagttcggtttaccgtccccgtttacaccttccttccccgtactactctacgacttacgtctacg

SEQ ID NO: 412228 - DNA, 561 bp, Homo sapiens
  misc_feature: GZ8MTXP02I7ECP.17.26.C04.1.454.CMB.2.raw
  modified_base (359)..(359): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccagggaaacgcccctaagctcctgatctttgctgcatccagtttgcaaaggtcggggtccccttcgaaggttcagtggcagtggatcgtgggacngatttcactctcaccatcagcagtctgcaactgaagtatttgactaactttactactcgtacaaacagtaacgttaacaactaccccgtacggccttactacgtttcgggacgggtacgggaaccgtaaacggggtggaacgtaacgttaacgaaaaccggtaaacgttcggttacgggccttacggaccgtaaccgtaacg

SEQ ID NO: 412229 - DNA, 567 bp, Homo sapiens
  misc_feature: GZ8MTXP02JP56Q.17.26.C04.1.454.CMB.2.raw
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccaggaaacgcccctaagctcctgatctttgctgcatcctagtttcgactaaaggttcggggtacccccttgaacggttcaggtggacagtggatcgtgggacagtatttcacttctacaccatcagctagtctgacaactgaatatttcgactaacttactatacgtacaactagtacttaacaactaccccgtgtactactacggtttcggaccggggtaaacgggaccgtaaagggtcgggtaacgtacgtaaaccgaaaacggtacgttaggtacggtacgtcggaccgaccgttacg

SEQ ID NO: 412230 - DNA, 536 bp, Homo sapiens
  misc_feature: GZ8MTXP02HCY54.17.26.C04.1.454.CMB.2.raw
  modified_base (272)..(272): a, c, t, g, unknown or other
  modified_base (286)..(286): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggatcagcaagaaacaggaaacncccctaagctcctnatctttgctgcatccagtttgacaaaggtgggtaccccttgaaggttcaggtgcgagtggatcgtgggactagtaactttcactctcactatcagctagtctgacaactagaacgtattttcgactaactttactactacgtacaaactagtacgttaacaacgttaccctacggtctcgtaacgttcggacggtacggaacgaacggtgaacgtactacaaacgtacgtagtacgcgtacgactacacg

SEQ ID NO: 412231 - DNA, 509 bp, Homo sapiens
  misc_feature: GZ8MTXP02JIJK6.17.26.C04.1.454.CMB.2.raw
  modified_base (197)..(197): a, c, t, g, unknown or other
  modified_base (275)..(275): a, c, t, g, unknown or other
  modified_base (323)..(323): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagctattaaattggtatcagcagaaaccagggaaacnccctaagctcctgatcttgctgcatccagttgcaaagtggtccccttnaagttcagtgcagtggatctgggactagtatttcactctcaccatcagcagtctagcgaactgaatatttgactaacttactacttacgtacaaactagacgttaacaataacccctgactcacgtttcggacggtacgggacctacgggtgaacgatacaaacgtactaggtcgactcgacacta

SEQ ID NO: 412232 - DNA, 542 bp, Homo sapiens
  misc_feature: GZ8MTXP02JHSDN.17.26.C04.1.454.CMB.2.raw
  modified_base (221)..(221): a, c, t, g, unknown or other
  modified_base (378)..(378): a, c, t, g, unknown or other
tcagcgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagctattaaatggtatcagcagaaaaccaggaaaagcccctaaagctcctgatctttgctgcatccagtttgcaaaagtgggtcccctcaaggttcagtgcagtggatctgggacagatttcatctcaccatcagcatctnacacagaagtattagtactaacttaactactacgtacaactaagtaacgtaactaaactaaccctaccgtactactacgttacggtacggaacggaacggaaacggtacggaacgaacgtaaacgtaaaacgtaaacgtacgtacgtacgtacgtacaactaac

SEQ ID NO: 412233 - DNA, 655 bp, Homo sapiens
  misc_feature: GZ8MTXP02H44SE.17.26.C04.1.454.CMB.2.raw
  modified_base (387)..(387): a, c, t, g, unknown or other
tcagcgtagactagcacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatataacctgttcccatcgactacgcctttcggcctcgccttaggggtcactcaccctgccccgattaacgttggacaggaacccttggtcttccggcgagcgggtcttttcacccgtctttancgttacttatgtcagcattccgctcttctgactaccctccagctactcgccctcacacgccaactacccttcaaccacggccttaacgacgaaaccgtccctaccccctaacccaaacaaccgctaactaaacgccgtacgctacgcccgacacgtccttcgggtcgtacctaagtttcgggtttaaccgtcccccggttttactaaccttccctttcccccggaccctaacgttcctacggtaaccctttagtacccgtttaaccgg

SEQ ID NO: 412234 - DNA, 519 bp, Homo sapiens
  misc_feature: GZ8MTXP02JU6OC.17.26.C04.1.454.CMB.2.raw
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccagggaaacgcccctaagctcctgatcttgctgcatccagtttgctaaaggtcggggtacccccttcgaaggttcagtggcagtggatgtgggacagtatttcactctcaccatcagcagtctgacaacctgaagtatttgactaacttactatgtacaaacagacgttacaacttacccctcgtactctacgtttcgggacggacggaccgaaggtcgacgatacgaaacgactaggtcgactcgaccactac

SEQ ID NO: 412235 - DNA, 523 bp, Homo sapiens
  misc_feature: GZ8MTXP02HTJQW.17.26.C04.1.454.CMB.2.raw
  modified_base (363)..(363): a, c, t, g, unknown or other
  modified_base (367)..(368): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgaccagtctccatcctcctgtctgcatctgtaggagacagagtcaccatcacttggccggcaagtcagagcatagcagctattaaatgtatcagcagaaaccgaggaagccccaagctctgactcttgctgctactctagttgactaaggtcgggtccccttgaagttcagtgcagtgatcgaggctagatttcactcacactncganntctcacactagtagtattacgtactacttactactacgtactacgacgtaacgtaactactaccgtaccgtacgtacgtacgttacggtacggacggacggtacggtacgacgtaacgaacgtaacgtacgtacgtacgcgtacgtactactacg

SEQ ID NO: 412236 - DNA, 529 bp, Homo sapiens
  misc_feature: GZ8MTXP02JQLA3.17.26.C04.1.454.CMB.2.raw
  modified_base (196)..(196): a, c, t, g, unknown or other
  modified_base (221)..(221): a, c, t, g, unknown or other
  modified_base (263)..(263): a, c, t, g, unknown or other
  modified_base (271)..(271): a, c, t, g, unknown or other
  modified_base (408)..(408): a, c, t, g, unknown or other
  modified_base (439)..(439): a, c, t, g, unknown or other
tcagcgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcatagcagctattaaatgtatcagcagaaaccngggaaacncccctaagctcctgatctttgctgcatccagtttcgctaaaggtcggggtaccccttcgaaggtttcaggttggactaggtggatcgtggggactagtactttcactctcaccatccagtcagtctgaccaaccgtnaacgtatttgactaactactactgtacaacngtacgttacaactaccctcggtactctaccgtttcggcggtacgggaccaaggtcgagtacacgaaacgattcggacggctcgacactac

SEQ ID NO: 412237 - DNA, 519 bp, Homo sapiens
  misc_feature: GZ8MTXP02FX6G9.17.26.C04.1.454.CMB.2.raw
  modified_base (222)..(222): a, c, t, g, unknown or other
  modified_base (275)..(275): a, c, t, g, unknown or other
  modified_base (390)..(390): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcattagcagctatttaaatggtatcagcagaaaccagggaaacncccctaagctcctgatcttgctgcatcctagtttgactaaaggtcggggtcccccttcgaaggttcagtggctaggtggatcgtaggggactagtactttcactctcaccatcancagtctgactaactgaagtatttgactaacttactactgtacaacagtagttacaactaccctcggctctacttcggacggacggaccgaggtgacgatacgaaacgtactagtcggctacgacactac

SEQ ID NO: 412238 - DNA, 723 bp, Homo sapiens
  misc_feature: GZ8MTXP02HM3ZL.17.26.C04.1.454.CMB.2.raw
  modified_base (221)..(221): a, c, t, g, unknown or other
  modified_base (272)..(272): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggnaagtcagagcattagcagctattaaatgtatcagcagaaaccagggaaacnccctaagctcctgatctttgctgctatcctagtttgacgtaaaggttcggggtacccccttacgtaagggttcaaggttcgggaccgtaagggttgggggtaacttcggttaggggaaccgtaaggttaacttttccgaaacccttccgttaaccctaaccccgtaattaccgaaacggtcgtaacggtttccgttacggaaccctaaacccgttaggtaaaggtttactttttacggaaccctttaaaacgttttaaccgtaactttacggtaacctaaaacgtaaggtaaacgtttaacccaaaccgttacccccgttacggtacccttaccgttaaaccggttttccggggaaaccggggtaaccggggtaaaccgtaaacggggttacgggaaactacgtaaccgtaaaaacggtacgttaggtacggacctcggacctaacctacg

SEQ ID NO: 412239 - DNA, 638 bp, Homo sapiens
  misc_feature: GZ8MTXP02JM6YQ.17.26.C04.1.454.CMB.2.raw
  modified_base (296)..(296): a, c, t, g, unknown or other
  modified_base (617)..(617): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatcgacccagtcctccatccctccctgtctgcatctgtaggagacagagtccaccatcacttggccgggacaaagtcaagagctaattagacagtcttaatttaaagttggtatcagacaaaggaaaccgagggaaacncccctaagcctacctagacttctttagcttagctatcctagtttagacgtaaaggttcggggtacccccttagtaacggttctaggtggacgtaggtgggtactcgtaggggactagtactttaccacttcctacctaacctattcgaacgcgtaagttctacggacctaaccgtagtaagtttactttacaaccttaaaccttacttaacgtacgttaacaaactaacggtaacttaactaaacttcccccgtacgtctcgttaaccggttcgggaacgggtacggaccgtaagggacgtaagacgtaacaaacgtacgnggtacgcgtacgactactacg

SEQ ID NO: 412240 - DNA, 548 bp, Homo sapiens
  misc_feature: GZ8MTXP02GX2HF.17.26.C04.1.454.CMB.2.raw
  modified_base (275)..(275): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatgtatcagcaagaaaccagggaaacncccctaagctcctgatcttgctgcatccagtttgactaaaggtcggggtacccccttagaaggttcaagtggcagtggatcgtgggacagtatttcactctcaccatcagcagtctgacaactagaacgtatttgactaactttactactagtacaaacagtaacttacaacgttacccctggacctactacgtttccggacggacgggtaaccgaagggtacgggaataacgtaacgaaaacgtacgtaggtacggctacggaccaactacg

SEQ ID NO: 412241 - DNA, 552 bp, Homo sapiens
  misc_feature: GZ8MTXP02GEDJC.17.26.C04.1.454.CMB.2.raw
  modified_base (222)..(222): a, c, t, g, unknown or other
  modified_base (274)..(274): a, c, t, g, unknown or other
  modified_base (420)..(420): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggnaagtcagagcatagcagctatttaaatggtatcagcagaaaccagggaaacncccctaagctcctgatctttgctgcatcctagtttgacgtaaaggtcggggtacccccttagaaggttcaaggtggctaggtggatcgtgggacagtatttcactctcaccatcagcagtctgacctaacgtagaacgttattttnactaacttactactagtacaaacgtagtattaaccaacttaccccgtaggccttactacgtttacgggacggaacgggtaccaaagggtcgaagataacgaaaacgtaacgtgtcggactacgacctactac

SEQ ID NO: 412242 - DNA, 539 bp, Homo sapiens
  misc_feature: GZ8MTXP02I5JMW.17.26.C04.1.454.CMB.2.raw
  modified_base (196)..(196): a, c, t, g, unknown or other
  modified_base (221)..(221): a, c, t, g, unknown or other
  modified_base (274)..(274): a, c, t, g, unknown or other
tcagcgtagactagcacgaccggtgctcgatttagtctagcgactttgggtttgggggagtcagtctcagtcaggacacagcatggacatgagggtcccgctcagctcctggggctcctgctactctggctccgaggtgccagatgtgacatccagatgacccagtctccatcctccctgtctgcatctgtagganacagagtcaccatcacttgccgggnaagtcagagcatagcagctatttaaatggtatcagcaagaaaccagggaaacncccctaagctcctgatctttgctgcatccagtttgactaaaggtcggggtcccccttagaaggttcagtggctaggtggatcgtgggactagtactttcactctacaccatcagcagtctgacaactgaacgtatttgactaacttacgtatcgtaacaacagtactaacctactacccctggcctacgtaccgttcgggacggacggtaaccagggtacggaactagtaaccgaaaacgactggtacggctacggactacctag

SEQ ID NO: 412243 - DNA, 664 bp, Homo sapiens
  misc_feature: GZ8MTXP02IW2AD.17.26.C04.1.454.CMB.2.raw
  modified_base (199)..(199): a, c, t, g, unknown or other
  modified_base (225)..(225): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtcctccatccctccctgtctgcatctgtagganacagagtcaccatcacttggccgggnaagtcagagcattagcagtcttaatttaaagtggtatcagacaacgaaaccgagggaaaccgcccctaaagctcctgtattccgtttgctgacctatccgtagtttgacgtaaagggttcggggtacccccttagtaaaggttcgaggtggactagggttggaacttcggtacggggtactaaggtacttttaccaaccttcctacctaaaccctataccgacggtacctaacggtctaccggtaacctaaaccgttagtaaagtttacgttttacgaacttaacctttaactacctacgtaacaactagtaacgttaaccaaccttaccccgtcggtactaccgtaccgggttcgggaccgggtaaacggacccgtaaggggtacgaacgtactaaaccggaaacgtaacgttggacggcgttaccgactaaccgttc

SEQ ID NO: 412244 - DNA, 557 bp, Homo sapiens
  misc_feature: GZ8MTXP02I7HEW.17.26.C04.1.454.CMB.2.raw
  modified_base (197)..(197): a, c, t, g, unknown or other
  modified_base (222)..(222): a, c, t, g, unknown or other
  modified_base (404)..(404): a, c, t, g, unknown or other
  modified_base (414)..(414): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcattagcagcttaatttaaattggtatcagacaagaaaccgagggaaacgcccctaagctcctgacttctttgctgcatcctagtttcgacgaaaggttcggggtaccccttacgaaggttcaggttggactaggtgggattcgtaggggactagtactttcacttcacaccntcagcagtcngacaactagatatttcgactaactttactactgtacaaacagtagtaacaactccctgctcgtacgtttcggacggtacgggaacctaagggtcgaaacgtacgtaacgaaaacgtacgtaggtcggactacgaccacttacg

SEQ ID NO: 412245 - DNA, 620 bp, Homo sapiens
  misc_feature: GZ8MTXP02I3XGW.17.26.C04.1.454.CMB.2.raw
  modified_base (223)..(223): a, c, t, g, unknown or other
  modified_base (277)..(277): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccgggnaagtcagagcattagcagcttaatttaaatggtatcaggcggaacagggaaacncccctaaatcctgatctatactgactatcctaatttgacgtaaagtcggggtacccagtaccgaaggttcagtggcaggtgatcgtaggggactagtatttcactctcaccatcagctagtctacgactaaccgtgaggttatttacggactaaactttaacgtacttagtaaccgtaaacgtacggggttaacctaaccggttaacccccgtaagttaccggttttacggacccggtaaacgggggtaaccctaagggaccgttaggggaaactaacgtaaacccgtaaaaacgtccgtttaaggcggtactacgaccgaccttacgttcgttcgtttaccc

SEQ ID NO: 412246 - DNA, 503 bp, Homo sapiens
  misc_feature: GZ8MTXP02FED7P.17.26.C04.1.454.CMB.2.raw
  modified_base (329)..(329): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccagggaaagcccctaaagctcctgatctttgctgcatccagtttgcaaagtggggtcccccttnaaggttcagtggcagtggatctgggacagatttcactctcaccatcagcagtctgcaacctgaagtattttgactaacttactacttgtacaaacagagttacaactacccctggctcactttcggcggacgggaccaaggtggagatacaaaacgactagtcggctgcactac

SEQ ID NO: 412247 - DNA, 577 bp, Homo sapiens
  misc_feature: GZ8MTXP02G3MGQ.17.26.C04.1.454.CMB.2.raw
  modified_base (197)..(197): a, c, t, g, unknown or other
  modified_base (280)..(280): a, c, t, g, unknown or other
  modified_base (421)..(421): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagtacttattaaatggtatcagacaagaaaccgagggaaacncccctaagctcctgactctttgctagctatccgtagtttgaccgtaaaggttcggggtacccccttagaaggtttcaaggttggactagggtggacttcgaggggaactaggtatttcaaccttcctacaacctatcgaancctagtactcgaccaactagtaaattattcgtactacttactactgtacaacgtagtacgtacaacctaccctggtcctacgtacgttcggacggtacggaccgtaagggtcgaacgtaatacgaaaccgtaagtgtacggactcggaccactacg

SEQ ID NO: 412248 - DNA, 628 bp, Homo sapiens
  misc_feature: GZ8MTXP02I0T13.17.26.C04.1.454.CMB.2.raw
  modified_base (280)..(280): a, c, t, g, unknown or other
tcagcgtagactagcacgaccggtgctcgatttagtctagcgactttgggtttgggggagtcagtctcagtcaggacacagcatggacatgaggatccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttaatttaaattggtatcagcaagaaaccgagggaaacnccccaagctcctgacttctttgcttgctatcctagtttcgacgtaacggtccggggtcccttagtaagttcagtcggcaggtgatcgtagggactagtatttcactctaccactatcagcagtctacgactaacgtgtaaattacgttttcaacttaaacctttacttaacgttacgtaactaaccgtaagtaaacgttaaaccaacccgttaaccccgtcggtacccttaaccgtaccggtttaccgggggaccggggtaaacggggtaaccgtaacggggtacgggaaacgtaaacgttaaccgaaaacggtacgttagggtcgtaccgttacggacctaaacccg

SEQ ID NO: 412249 - DNA, 529 bp, Homo sapiens
  misc_feature: GZ8MTXP02H1Q04.17.26.C04.1.454.CMB.2.raw
  modified_base (271)..(271): a, c, t, g, unknown or other
  modified_base (356)..(356): a, c, t, g, unknown or other
  modified_base (398)..(398): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacatcacttgccgggcaagtcagagcattagcagctattaaatgtatcagcagaaaccaggaaacncccctaagctcctgatcttgctgcatcagtttgactaaaggtgggtccccttgaaggttcagtggcagtggatcgtgggacagtnttcactctcaccagtcagctagtctgacaaccgtgaacgttnttagacttaacttactactagtacaacgtagtaacttaacacctacccgtcgtactacgtacgttcgggacggaacggtacgtaggtacgacgtaacaacgaaacgtacgtcggtacgactcgacctactg

SEQ ID NO: 412250 - DNA, 604 bp, Homo sapiens
  misc_feature: GZ8MTXP02JD7EN.17.26.C04.1.454.CMB.2.raw
  modified_base (280)..(280): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacttggccgggcaagtcagagcattagcagcttaatttaattggtatcagacaagaaaccgagggaaacncccctaagctcctgattcttgctgcatcctagtttgacgtaaaggtcgggtcccccttagaaggttcaggtggctaggtggatcgtagggactagtatttcactctcacatcagcagtcagactaactagtaagtatttcgactaacttactactgtaacaacgacgtaacgttaacctaaccttaccccgtacggtccttaccgtaccggtttaccggggaccggggtaaacggggacccgtaaaggggttacgggaaacgtaacgttaaaccggaaaaaccggtacgttacggtacgggtacttacggaccctaacgttacg

SEQ ID NO: 412251 - DNA, 573 bp, Homo sapiens
  misc_feature: GZ8MTXP02HA7AX.17.26.C04.1.454.CMB.2.raw
  modified_base (197)..(197): a, c, t, g, unknown or other
  modified_base (275)..(275): a, c, t, g, unknown or other
  modified_base (288)..(288): a, c, t, g, unknown or other
  modified_base (326)..(326): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccggcaagtcagagcattagcagctaattaaattggtatcagcagaaaccagggaaacncccctaagctccngatcttgctgcatccagttgcaaaggtgggtccccttnaaggttcagtgcagtggatcgtgggacagtatttcactctacaccatcagccagttcagactaacctagtaagtattttcgaactaacttttaactaccttgtaccaaactaggtaacttaacaaaccttaccccgtacggtaccttacgtaaccgtttcgggacgggaacgggtaccgaaagggtcggaacggaacttaacgaaaacggtaacttagggtacgtaccgtacggaccgtaccctacg

SEQ ID NO: 412252 - DNA, 593 bp, Homo sapiens
  misc_feature: GZ8MTXP02FMHAH.17.26.C04.1.454.CMB.2.raw
  modified_base (196)..(196): a, c, t, g, unknown or other
  modified_base (275)..(275): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacttgccgggcaagtcagagcattagcagctaatttaaatggtatcagcaagaaaccagggaaancccctaaagctcctgatcttgctgcatcctagtttcgactaaaggtcggggtcccccttagaaggttcaggttggcagtgggatcgtagggacagtatttcactctacaccatcagctagtcctagacaacctagaacgttattttcgactaacttactactcgtacaacagtaacttaacaacttacccctcggtacctacgtaccgtttacggggaccgggtaacgggaaacccgtaaaggggtacggtaaacggacttaaccgaaaaacggtaaaccgttgggttacgggaccttacggaccctaaccgttaacg

SEQ ID NO: 412253 - DNA, 618 bp, Homo sapiens
  misc_feature: GZ8MTXP02HQZ5L.17.26.C04.1.454.CMB.2.raw
  modified_base (197)..(197): a, c, t, g, unknown or other
  modified_base (222)..(222): a, c, t, g, unknown or other
  modified_base (276)..(276): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcattagcagctaatttaaatggtatcagcagaaaccgaggaaacncccctaagcctcctagatctttgctgctatcctagtttgacgtaaaggtcggggtaccccccttagaaacggtttcgaggttggcgtaggtggtacgttcggtagggactaagtactttacactcctaccacctatcgagctacgttctacgactaaaccgtgaaagttatttgaccttaaactttacctaacttcgtaaccaaacgtacgtaacttaaccaaaccgttaccccgtacggaccttccggtaaccgtttccggggacgggtaacgggtaaaccgtaaggggtacggaacgtaacgtacgaaaacgtacgtggtacggctacggactacctacg

SEQ ID NO: 412254 - DNA, 565 bp, Homo sapiens
  misc_feature: GZ8MTXP02JAYV3.17.26.C04.1.454.CMB.2.raw
  modified_base (223)..(223): a, c, t, g, unknown or other
  modified_base (280)..(280): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggnaagtcagagcattagcagtctatttaaatggtatcagacaagaaaccgagggaaacncccctaagcctcctgattctttgctgctatcctagtttcgacgtaaacggttcggggtcccccttagaaggttcaggtgacaggtggatcgtagggacagtactttcactctcaccatcagcagtctagactaacctagaagttatttagactaactttactactagtacaacagtaacgttacaactaccctacgactacgtacgttacgggacggtaacgggaaccgtaagggtacggaacgtacgtaacgaaacgtacgtacgtacggctacggacacctag

SEQ ID NO: 412255 - DNA, 789 bp, Homo sapiens
  misc_feature: GZ8MTXP02JV8MU.17.26.C04.1.454.CMB.2.raw
  modified_base (277)..(277): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagcttatttaaattggtatcagcaagaaaccaggaaacncccctaagcctcctgatctttgctgctatcctagtttcgacgtaaaggttcggggtacccccctttacgaaagggtttccaaggttgggaccgtaggttcggggtacgttaccggtagggggtaacctaagggtactttttaccaaaccgtttccttaacccgaaaccccgttaaattcccgaacgggaccctaaacgggtttccttacgggaaccccttaaaacccgttaggtaaaacgggtttaaatttttttaccggaaacccgtttaaaaccgtttttaaccctttaaaccgttacggttaaaccaaaaccgttaaacgggttaaacgttttaaacccaaaaccgtttaccccccgtacgggtacccttacccttaaccggtttaccggggaccggggtaacggggtaaacccggaaacgggggttaggaaccggtaaacgtttaacccggtaaaaacggaaaccgtttagggttacggaccgtttacggaccctaaccggttaaccg

SEQ ID NO: 412256 - DNA, 554 bp, Homo sapiens
  misc_feature: GZ8MTXP02HE2M0.17.26.C04.1.454.CMB.2.raw
  modified_base (221)..(221): a, c, t, g, unknown or other
  modified_base (278)..(278): a, c, t, g, unknown or other
  modified_base (350)..(350): a, c, t, g, unknown or other
  modified_base (373)..(373): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacttgccgggnaagtcagagcattagcagcttaatttaaatggtatcagacaagaaaccagggaaacncccctaagctcctgatcttgctgctatccagtttgacaaaggtcgggtcccccttagagtcaggtgcagtgntcgtggactagtatttacactcncaccgtatcagcagtcctagaccaacctagtaacgttatttagactaacttactactgtacaacgagtacgtactaactaccccgcgtctacgtacgtttacgggacggaacggtaccgaaagggtgaacgaagttaaaccgaaacggtacgtacggtcggtacgtacgacctaacttccg

SEQ ID NO: 412257 - DNA, 538 bp, Homo sapiens
  misc_feature: GZ8MTXP02JUK53.17.26.C04.1.454.CMB.2.raw
  modified_base (275)..(275): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaccagggaaacncccctaagctcctgatctttgctgcatccagtttgacaaaggtggggtcccccttgaacggttcagtggcagtggatcgtgggacagatttcactctcaccatcagcagtctgacaacctgaagtatttgactaacttactactgtacaactagtaacgttaccaacgtaccccgtcgtactactacgtttcgggacggtacggaccgaagggtcggagaagtacaaaacggtacgtaggtacggtacacggacctacctacg

SEQ ID NO: 412258 - DNA, 571 bp, Homo sapiens
  misc_feature: GZ8MTXP02H5VXA.17.26.C04.1.454.CMB.2.raw
  modified_base (377)..(377): a, c, t, g, unknown or other
  modified_base (396)..(396): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaccaggaaacgcccctaaagctcctgatctttgctgcatccagtttgcaaagtggggtccccttgaagttcagtgcagtggatctgggacagtatttcactcctcaccatcagnagtctgacaacctgaagtnttttagactaaactttactactactacaaacaggtaacttaacaaactacccctacggtactaccgtacgtttacgggaccgggtacgggaacccgaaagggttacggaacggtaacgttaacgaaaaaccggtaaacgttacggtacgggtacgtacggtaccaacccgttacg

SEQ ID NO: 412259 - DNA, 696 bp, Homo sapiens
  misc_feature: GZ8MTXP02JJVNC.17.26.C04.1.454.CMB.2.raw
  modified_base (197)..(197): a, c, t, g, unknown or other
  modified_base (292)..(292): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctcctgtctgcatctgtagganacagagtccaccatcacgttcggccgggacaagtcagagctattagcagtacttaattaaagttgtatcgaagcaacgaaaaccgagggaaaccncccctaagcctacctgtattcgttgctagctattacctaggtttcgacgtaaacgggtcggggttaccccccttagtaacggttcagggtggacgaggtggtactcggtagggtacctagttactttaccacttcctacaaccatccaagtcacgtcacgtacctaaccgtagtaacgtttacgttttcgaactttaaaccgttacttaaccggtacgttaaaccaaaccgtaacgtaaaccgtttaaccctaaacccgttaacccccgtggtaccccttacggttaccgggtttacggggaccggggaaaccggggtaccggtaaaagggttacggaaacgtaaccgtaaaccgaaaacggtaacggttacgggtacggaccgttaccggacctaaacttccg

SEQ ID NO: 412260 - DNA, 548 bp, Homo sapiens
  misc_feature: GZ8MTXP02GK02J.17.26.C04.1.454.CMB.2.raw
  modified_base (219)..(219): a, c, t, g, unknown or other
  modified_base (269)..(269): a, c, t, g, unknown or other
  modified_base (339)..(339): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggnaagtcagagcattagcagctattaaatggtatcagcagaaaccaggaaancccctaagctcctgatctttgctgcatccagtttgctaaagtcggggtcctcgagttcagtggcagtggntcgtgggacagtattcactctcacatcagcagtctcgcaactgaatatttgactaaacttactactgtacaaactagtaacgttacaacttaccccctggtaccttacgtacgtttcgggacgggtaacgggtacccgaaagggtggaacgtacgttaaccgaaaaggtaaaccgttggtacggaccttaggacctaccgtaatttccg

SEQ ID NO: 412261 - DNA, 608 bp, Homo sapiens
  misc_feature: GZ8MTXP02F5AR5.17.26.C04.1.454.CMB.2.raw
  modified_base (197)..(197): a, c, t, g, unknown or other
  modified_base (279)..(279): a, c, t, g, unknown or other
  modified_base (408)..(408): a, c, t, g, unknown or other
  modified_base (421)..(421): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagcttaatttaaatggtatcagacaagaaaccagggaaacncccctaagctcctgattctttgctgcatcctagtttgacgtaaaggtcggggtacccccttagaaggttcaggttggactaggtggatcgtaggggacagtatttcactctacacccatcagcagtctnacacctagaattntttacgactaacttactacttagtacaaactagtaacgttaacaacttaccccgtacgtcttaccgtaccggtttaccggggacgggtaacggggtaaacccgtaaggggtacggtaaacggtaacgttaaaccgaaaaccggtaacgttacgggttacggaccgttacggaccctaaccgtttacg

SEQ ID NO: 412262 - DNA, 776 bp, Homo sapiens
  misc_feature: GZ8MTXP02GYA04.17.26.C04.1.454.CMB.2.raw
  modified_base (194)..(194): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacttgccggcaagtcagagcattagcagctattaaatggtatcagcagaaaccaggaacgccctaagctcctgatctttagctgcatccagtttacgacgtaaacggtcggggttacccctttacgtaaacgggtttccaaggttcgggacgtaacggttgggtacgttccgttacgggggaactaagtaactttttccgaaacctttccttacctaaccctaacttacccgaaagtcccgtaaacgggttccttacgggaacccttaaaaccccgttaggtaaaaccgggtttattttttaacgggtaacccttaaaaccgtttttaacccgtaaacctttacgggttaaaccctaaaaccgtaaacgggttaaaaccgtttaaacccgaaaacctttaacccccgttccgggtacccttacccgttaacccggtttttaccggggacccggggtaaacggggtaaccccgtaaaacgggggttaacggaaacggttaaacgttaacccgaaaaacggtaaccgttaggtaacgggtaccgttcggaccctaaccgaactttaccgg

SEQ ID NO: 412263 - DNA, 560 bp, Homo sapiens
  misc_feature: GZ8MTXP02G2SWE.17.26.C04.1.454.CMB.2.raw
  modified_base (196)..(196): a, c, t, g, unknown or other
  modified_base (221)..(221): a, c, t, g, unknown or other
  modified_base (282)..(282): a, c, t, g, unknown or other
  modified_base (323)..(323): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaganacagatcaccatcacttgccggganaagtcagagcattagcagtacttaatttaaattggtatcagacaagaaaccgagggaaacncccctaagcctcctgattctttgcttgctattcctagtttnacgtaaaggttcgggtacccccttagtaacgttcaggtcgctaggtggatcggtaggactagtatttcactcacaccatcagctacgtctagactaactgaaagttactttgaactaactttcgtactagtacaactagtaactacaacttcccgtgacttcgtacgttcggacggacggacgtagggtacgaactaacgtaaacgaacgtaacgtcgtaggactacgacctactac

SEQ ID NO: 412264 - DNA, 596 bp, Homo sapiens
  misc_feature: GZ8MTXP02IWM95.17.26.C04.1.454.CMB.2.raw
  modified_base (275)..(275): a, c, t, g, unknown or other
  modified_base (312)..(312): a, c, t, g, unknown or other
  modified_base (349)..(349): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctcctgtctgcatctgtaggagacagagtcacatcacttgccgggacaagtcagagcattagcagcttatttaaatggtatcagcaagaaaccgagggaaacncccctaagctcctgattctttgctgacatcctagttnacgtaaggtcgggtcctcgaagttcagtggcaggtgntcgtgggactagtactttcacttctaccactactacagtctaagttctacgtaccaacgttagaaacgttattttacgaacctttaacttaacttaacgtacgtaacctaaacgtaacgtaacttaacgtaaaccttaccccgtcgtaccttacgtacggtttacggaccggggtaacgggaccgtaaagggtcggaaacgtacgtacgaaaacgtaacgaggtacggactacgacctactacttcg

SEQ ID NO: 412265 - DNA, 632 bp, Homo sapiens
  misc_feature: GZ8MTXP02GNKZP.17.26.C04.1.454.CMB.2.raw
  modified_base (197)..(197): a, c, t, g, unknown or other
  modified_base (221)..(221): a, c, t, g, unknown or other
  modified_base (276)..(276): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccggnaagtcagagcatgcagtctaatttaaatggtatcagacaagaaaccgaggaaacncccctaagcctcctagattcttgctgctattccgtagtttgacgtaaaggttcggggtacccccttagaaggtttcgaaggttcgggacgtagggttggacgttacggtaggggtactagttactttaccacttcctaccactactacgacgtacgtacgtcctagtacctaacgtagtaagttactttacgaaccttaactttaactacttacgtaactaaacgtagttaacttaactaacccttcccgtggtaccttacgttaccggttacggggacgggaaacgggtaccggtaaacgggtacgggaataacgtaacgtaaaacgtacggtggtacggtcacgacctacgttc

SEQ ID NO: 412266 - DNA, 593 bp, Homo sapiens
  misc_feature: GZ8MTXP02JT7J0.17.26.C04.1.454.CMB.2.raw
  modified_base (198)..(198): a, c, t, g, unknown or other
  modified_base (286)..(286): a, c, t, g, unknown or other
  modified_base (393)..(393): a, c, t, g, unknown or other
  modified_base (427)..(427): a, c, t, g, unknown or other
tcagcgtagactagcacgaccggtgctcgatttagtctagcgactttggggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggacaagtcagagcattagcagtcttaatttaaattggtatcaagcaaacgaaaccgagggaaacncccctaagcctctgtatctttgctgctactcctaggtttcgacgtaaaggtcgggtcccccttagaagttcagtgcagtgatgtggacagtactttcactctacaanatcagctagtcctagacctaacgtagtaaagttntttacgaaccttaacttactactacgtaacaaacgtacgtaacttaaaccaaccttaccccgtacggtctaccgttaccggttacggggacgggtaacgggaaccgaagggtacgaacgtaacgtaacaaaacggtacgttggaccgtactacgaccaccgttacg

SEQ ID NO: 412267 - DNA, 583 bp, Homo sapiens
  misc_feature: GZ8MTXP02HVXL3.17.26.C04.1.454.CMB.2.raw
  modified_base (339)..(339): a, c, t, g, unknown or other
tcagcgtagactagcacgaccggtgctcgatttagtctagcgactttgggtttggggtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccggcaagtcagagcattagcagctattaatggtatcagcagaaaccaggaaagcccctaagctcctgatcttgctgcatccagtttgcaaaagtggggtacccttcgaagttcagtggcagttggntctgggacagatttcactctcaccatcagacagtctgcaacctagagtaatttatactaaacttaacttaactacgttactaaccaaggtaaagttaactaaactaaccctaccggtaccgtacctaaccgtttacggtaccgggacggggaacccgaaaacgggtacgggtaacggtaaggtaaccaaaaccgaaaaccgttaacggtaaggtcggtacggtaccgtaaccaaacgtttaccg

SEQ ID NO: 412268 - DNA, 586 bp, Homo sapiens
  misc_feature: GZ8MTXP02JI849.17.26.C04.1.454.CMB.2.raw
  modified_base (276)..(276): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtccaccatcacttgccgggcaagtcagagcattagcagcttaattaaatggtatcagcagaaaccagggaacnccctaagctcctgatcttgctgactatcctagtttgactaaaggttcggggtcccccttacgaaggttcaggttggcaggtggatcgtaggacagtatttcactctcacatcagcagtactgaccactagaacttatttacgacttaaccttatacttgtaacaaacgtagtaagttaaccctaaacttacccccgtaggtacccttacgtaaccgtttcgggaccgggtaacgggtaacccgtaaacggggtggaaacgtacgtaaacgaaaaccggtaagttcggacggtctacggtaccaaccttcg

SEQ ID NO: 412269 - DNA, 602 bp, Homo sapiens
  misc_feature: GZ8MTXP02F4VK8.17.26.C04.1.454.CMB.2.raw
  modified_base (221)..(221): a, c, t, g, unknown or other
  modified_base (280)..(280): a, c, t, g, unknown or other
  modified_base (422)..(422): a, c, t, g, unknown or other
  modified_base (477)..(477): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatccctcctgtctgcatctgtaggagacagagtcaccatcacttggccgganaagtcagagcattagcagtcttaatttaaagtgtatcagacaagaaaccgagggaaacncccctaagcctctgacttcttgctgactactcctagtttgacgtaaaggttcggggttacccttagtaacggttcgaggtcggactaaggttcggagttccggaggggtaactagttactttcgacttcctacaccatcganctagtctagactaacgtagtaactatttacgacttaacttactactagtacaaanagtacgtacaactacccgtgacctacgtacgttacggacgggtaacggaccgtaagggtacgaacggtaactaacggtaaaacgtaacgtaggtacggtaccgtacgaacctacccttacgttcg

SEQ ID NO: 412270 - DNA, 526 bp, Homo sapiens
  misc_feature: GZ8MTXP02J4C8N.17.26.C04.1.454.CMB.2.raw
  modified_base (223)..(223): a, c, t, g, unknown or other
  modified_base (503)..(503): a, c, t, g, unknown or other
  modified_base (513)..(513): a, c, t, g, unknown or other
  modified_base (519)..(519): a, c, t, g, unknown or other
  modified_base (521)..(521): a, c, t, g, unknown or other
tcagcgtagactagcacgaccggtgctcgatttagtctagcgactttgggtttgggggagtcagtctcagtcaggacacagcatggacatgagggtcccccgctcagctcctggggctcctgctactctggctccgaggtgccagatgtgacatccagatgacccagtctccatcctccctgtctgcatctgtaggagacagatccaccatcacttgccgggnaagtcagagcaattagctagtcttaattaaattggactcagacaagaaaccgaggaaacgcccctaagcctctgatctttgctgctatccgtagtttgacgtaaggtcgggttccccctagagttcaggtgctagtggatcgtggacagtctttcactctacacctatcacgcagtctcgacaacctagtaagtatttatactaacttactactactacaacagtactactaacctaccctccgtctcgtacgttcggacggacggacgacggacgaganacaacgacgngtcgcncncactc

SEQ ID NO: 412271 - DNA, 642 bp, Homo sapiens
  misc_feature: GZ8MTXP02I3754.17.26.C04.1.454.CMB.2.raw
  modified_base (196)..(196): a, c, t, g, unknown or other
  modified_base (282)..(282): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacttgccgggcaagtcagagcattagcagcttaatttaaatggtatcagacaagaaaccgaggggaaaaccnccctaagcctctagtacttcttgctcgactacttccgttagtttacgaacgtaaacgggttccgggttaccccttacgtaggttcgaggtcggacgtaggtcggtacgtcggtagggactagttactttacctacctctacctaacctatacgacgtcgtacgttctacgtacctaacgtagtaagtttactttacgaacttaacttactacgtactaacaacgtagtaacgttaacctaaaccgttcccgtacgtacttacgtaccggttacggggaacgggtaaccgggtaaccgtaagggtacggaacgtaacgtaacgaaaaccggtcgtacggtcgaccgtacgacctacgtacg

SEQ ID NO: 412272 - DNA, 569 bp, Homo sapiens
  misc_feature: GZ8MTXP02GYK98.17.26.C04.1.454.CMB.2.raw
  modified_base (197)..(197): a, c, t, g, unknown or other
  modified_base (285)..(285): a, c, t, g, unknown or other
  modified_base (426)..(426): a, c, t, g, unknown or other
  modified_base (555)..(555): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttggccgggcaagtcagagcattagcagacttaatttaaattggtatcagcaaagaaaccgaggggaaaccncccctaagcctcctagacttcttgctgactatccgtagtttacgacgtaaaggttcggtacccccttagaagttcaggtcggacaggtggattcggtagggactagttactttacacctctactaccatcagctacgttcncgactaacgtagtaacttattcgaacttaacttactactgtaacaacgagtaactactaacctccgcgtctacgtacgtcggacgacgggtaacgacggtagacgtactaacgaaaacgtcgtacggcncgtacaccactacg

SEQ ID NO: 412273 - DNA, 602 bp, Homo sapiens
  misc_feature: GZ8MTXP02GASGN.17.26.C04.1.454.CMB.2.raw
  modified_base (221)..(221): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggnaagtcagagcattagcagctattaaattggtatcagcagaaaccagggaaagcccctaaagctcctgatctttgctgctatcctagtttcgacgaaaggttcggggtacccccctttagaacggtttcaggttggccaggtgggatcgtagggacagatttcacttctcaccatcagctagtctgctaacctgaagtattttgactaacttactacttacgtacaaaccaggtaacttaacaacgttacccccgtacggtccttacgtaccgttttaccggggacggtaacggggtaacccgtaaagggttacgggaagtaacgttaaccgaaaaacggtaacccgtaggttacggggtacctacggacctaaccctaacg

SEQ ID NO: 412274 - DNA, 566 bp, Homo sapiens
  misc_feature: GZ8MTXP02I1MDG.17.26.C04.1.454.CMB.2.raw
  modified_base (356)..(356): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaccaggaaacgcccctaagctcctgatctttgctgcatccagtttgcaaagtcggggtcccccttcaagttcagtggcagtggatctgggacngatttcactctcaccatcagccagtcctgactaacctgaagtattttgactaacttactactgtacaaacagtagttacaactacccctggaccttcgtacgtttcgggaccgggtacggggaaccctaaaggggtcggaaagtacgttaaccgaaaaaccggtaaaccgttggtacggggtaacccttggacccgtaacccgtttaacg

SEQ ID NO: 412275 - DNA, 543 bp, Homo sapiens
  misc_feature: GZ8MTXP02HKIRR.17.26.C04.1.454.CMB.2.raw
  modified_base (221)..(221): a, c, t, g, unknown or other
  modified_base (274)..(274): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagagacagagtcaccatcacttgccgggnaagtcagagcattagcagctaattaaattgtatcagcaagaaaccaggaaacncccctaagctcctgatcttgctgcatccagtttgacaaaggtggggtcccccttacgaaaggttcaggtggcaagtggatcgtaggggacagtatttcactctcaaccatcagcagtcagacaaacctgaaagtatttgactaaacttactactgtacaaacgagtaattaacaaactaccccctggactcaactttcgggcggaacggaaccgaaaggtcggaacgaaacgtaacgaaaacgtacgtacggtcgacgtacgacaacta

SEQ ID NO: 412276 - DNA, 557 bp, Homo sapiens
  misc_feature: GZ8MTXP02I8X3W.17.26.C04.1.454.CMB.2.raw
  modified_base (220)..(220): a, c, t, g, unknown or other
  modified_base (229)..(229): a, c, t, g, unknown or other
  modified_base (277)..(277): a, c, t, g, unknown or other
  modified_base (481)..(481): a, c, t, g, unknown or other
  modified_base (554)..(554): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacttggccgganaagtcagancattagcagtcttaatttaaatgtatcagacaagaaacgagggaaacncccctaagctcctgtacttcttgctgctactccaggtttcacgtaaaggtcggggtccttcgaaggttcagtcggactaggtgtagtcggtaggaactagtactttacactctaccactataccagtcagtctcgaactaactagaatatttacgacttaaacttacttcgtactacaatacgtacttaacaaccgttacccgngtcctacgtacgttccggacggtacgggacgaaggtcggacgactagaaactaacgttgacgctcgacacgtntcg

SEQ ID NO: 412277 - DNA, 590 bp, Homo sapiens
  misc_feature: GZ8MTXP02JD3MD.17.26.C04.1.454.CMB.2.raw
  modified_base (280)..(280): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcatagcagtacttaattaaatggtatcagacaagaaaccgaaggaaacncccctaagcctcctagtatctttgctgctatcctagtttcgacgtaaaggtcgggttaccccttacgaaggtttcgaagtggctagtcgggatcggtagggactagtacttcactctacacatcagcagtctgactaactagaattatttgactaaacttactattacgaactaaagaggtaactaacctaaacctaccccgtgtacctacgtaccggttacgggaccgggaacgggtaaaccaaggggtacgaaagtaactaaaccgaaaacggtaccgttaggacggtactacgacctaaccttaacg

SEQ ID NO: 412278 - DNA, 587 bp, Homo sapiens
  misc_feature: GZ8MTXP02GUINJ.17.26.C04.1.454.CMB.2.raw
  modified_base (225)..(225): a, c, t, g, unknown or other
tcagcgtagactagcacgaccggtgctcgatttagtctagcgactttggggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccggganaagtcagagctattagcagtcttaatttaaagttggtatcagacaagaaaccgaggaaacgcccctaagcctcctgattctttgctgactatcctagtttagacgtaaacggttcggggtcccccttagaaggttcaggtcggctagggtggattcggtagggactagtatttcgactctacacctatacagcagtctagactaacgtgaaattatttacgacctaaactttactactagtacaaacgtagtacttaacaaccttacccgtcgtactacgtacggttcgggacggtaacgggacgtaaaggggtcgaacgtaactaacgaaacgtacgtggtacggctacggacctacctag

SEQ ID NO: 412279 - DNA, 586 bp, Homo sapiens
  misc_feature: GZ8MTXP02IVSX0.17.26.C04.1.454.CMB.2.raw
  modified_base (198)..(198): a, c, t, g, unknown or other
  modified_base (224)..(224): a, c, t, g, unknown or other
tcagcgtagactagcacgaccggtgctcgatttagtctagcgactttgggtttgggggagtcaggtctcagtcaggacacagcatggacatgagggtccccgctcagctcctggggctcctgctactctggctccgaggtgccagatgtgacatccagatgacccagtctccatcctcctgtcctgcatctgtagganacagacgtcaccatcacttgccgggnaagtcagagcattagcagtctattaaatggtatcagtcaagaaaccagggaaacgcccctaagctcctgattcttgctgcattccagtttcgctaaaaggtcggggtaccccttacgaacggttcaggttggccgaggtggagttcgtggggaactaggtagtttcacttcgtacaccagtaccaggtcctaagtcgtacgactaaaccgtagtaagtattttacggactaaacgttacttacgtagtaacaacagtacgttacaacttacccgtagctactaacgttcggaggtacggtaccgaaggttcggaacgacgttaacgaaacgaacgttggtacggcttacggcctaaacgtcg

SEQ ID NO: 412280 - DNA, 539 bp, Homo sapiens
  misc_feature: GZ8MTXP02G7UP4.17.26.C04.1.454.CMB.2.raw
  modified_base (390)..(390): a, c, t, g, unknown or other
  modified_base (498)..(498): a, c, t, g, unknown or other
tcagcgtagactagcacgaccggtgctcgatttagtctagcgacttttgggtttgggggagtcagtctcagtcaggacacagcatggacatgagggtccccgctcagctcctggggctcctgctactctggctccgaggtgccagatgtgacatccagatgacccagtctccatccctcctgtctgcatctgtaggagacagagtcaccatcacttgcgggcaagtcagagcattagcagctattaaatgtatcagcagaaacaggaaacgcccctaagctccagatctttgctgctatcctagtttgactaaaaggttcggggtacccccttcgaaaggttcagtggactagtgggatcgtaggggacagtatttcactctcaccagtnaagcagtcagcaactagaagtatttcgactaactttactactgtacaacagtattaacaactacccctgtctactacgttcgggacggaacggacaaggggttcgganaacgttaaccgaaagtaacgtggtcggactagaccaaccta

SEQ ID NO: 412281 - DNA, 567 bp, Homo sapiens
  misc_feature: GZ8MTXP02FGFXO.17.26.C04.1.454.CMB.2.raw
  modified_base (351)..(352): a, c, t, g, unknown or other
  modified_base (367)..(367): a, c, t, g, unknown or other
  modified_base (372)..(372): a, c, t, g, unknown or other
  modified_base (382)..(382): a, c, t, g, unknown or other
  modified_base (402)..(402): a, c, t, g, unknown or other
  modified_base (454)..(454): a, c, t, g, unknown or other
tcagcgtagactagcacgaccggtgctcgatttagtctagcgactttgggtttggggtacgatttgatgttacctgatgcttagaggcttttcctggaagcagggcatttgttgcttcagcaccgtagtgccccgtcatcacgcctcagccttgattttccggatttgcctaggaaaaccagcctacacgcttaaaccgggacaaccgtcgcccggcaacatagccttctccgtcccccttgcagtaacacaagtacagaatattaacctgttcccatcgactacgtcctttcggcctcgcttaggggcactcacctgccccgattacgtgacaggacccttggtctcggnngcggctttcaccgtntttancgttacttancgtcagcattcgctacttcngactacctcagcatcgcctcacagcacaccttacacgagcttacacgaaccncctacccctaaccaacacgacaataagccgtcgctcgccgacacgtcgttcggcgactagttcggttacgtcccctttacactccttcccgctatctcgactacgtctacgcg

SEQ ID NO: 412282 - DNA, 540 bp, Homo sapiens
  misc_feature: GZ8MTXP02FQ9DO.17.26.C04.1.454.CMB.2.raw
  modified_base (276)..(276): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattgtatcagcaagaaaccagggaaacncccctaagctcctgatctttgctgcatcctagttgacaaaggtcggggtccccttcgaaggttcagtggcagtgggatcgtgggacagtatttcactctcaccatcagcagtctgactaacctagaagtagtttagtactaacttactacttacgttacaacagtacttactaactaccctacgtctcgtaccgttacggtcacgggggggggggaccaagggtacggagagtacgaaacgtaacgtagtcgcgtcgacactac

SEQ ID NO: 412283 - DNA, 608 bp, Homo sapiens
  misc_feature: GZ8MTXP02GQ5BX.17.26.C04.1.454.CMB.2.raw
  modified_base (224)..(224): a, c, t, g, unknown or other
  modified_base (287)..(287): a, c, t, g, unknown or other
  modified_base (398)..(398): a, c, t, g, unknown or other
  modified_base (406)..(406): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccggganaagtcagagcattagcagtacttaatttaaattggtatcagacaacggaaaccgagggaaacncccctaagcctcctgattcttgctgctatcctagtttcgacgtaaaggttcgggtacccccttagaaggttcaggtggctaaggtggatcgtagggacagtatttcactcncacatcancatctagactaactagtaattatttacgaacttaactttacgtacttacgtaactaaaccgtagtaacgttaacctaacttacccccgtcggtaccttaccgttaccggttcgggaaccgggtaacggaaccgtaaaggggtcgaaacgtaacgtaaccgaaaacggtacgtaggtaccggtactacggtacctaaccttcg

SEQ ID NO: 412284 - DNA, 642 bp, Homo sapiens
  misc_feature: GZ8MTXP02I58IT.17.26.C04.1.454.CMB.2.raw
  modified_base (198)..(198): a, c, t, g, unknown or other
  modified_base (294)..(294): a, c, t, g, unknown or other
tcagcgtagactagcacgaccggtgctcgatttagtctagcgactttggggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagatcaccatcacgttgccgggacaagtcagagctaattagcagtacttaatttaaagttggtatcaagacaaacggaaaccgaagggaaaccnccccgtaaagcctcctagtacttctttagctagctatccgtagtttgacgtaaaggtcgggttaccccctagaaggtttcaggtgacgagtggatcggagggactagtactttcacttcacacatcgagtctacgtcacgactaaccgtagtaacgttatttacgaaccttaaactttactacgttacgtaacaaacgtagtaaccgttaaccgtaaacttcccccgtagtaccgttaccgtaaccggtttaccggggacggggtaacgggtaaaccggtaaggggttacgggaaactacgtaaccgaaaaccgtaggtacggtacggtacacggtactaccgttacg

SEQ ID NO: 412285 - DNA, 638 bp, Homo sapiens
  misc_feature: GZ8MTXP02G88PG.17.26.C04.1.454.CMB.2.raw
  modified_base (198)..(198): a, c, t, g, unknown or other
  modified_base (224)..(224): a, c, t, g, unknown or other
  modified_base (283)..(283): a, c, t, g, unknown or other
  modified_base (426)..(426): a, c, t, g, unknown or other
  modified_base (453)..(453): a, c, t, g, unknown or other
tcagcgtagactagcacgaccggtgctcgatttagtctagcgactttggggtttgggggagtcagtctcagtcaggacacagcatggacatgagggtccccgctcagctcctggggctcctgctactctggctccgaggtgccagatgtgacatccagatcgacccagtctccatccctcctgtctgcatctgtaganacagatcaccatcacttcggccgganaagtcagagctattagcagtacttaatttaaagtgtatcagacaagaacagaacgaacnccctaagcctactgtacttcgtttgctcgctattccgtagtttacgacgtaaggtcccggggttaccccttagtaacggttcgaggtggactgggtcggattcggagggactagttacttccactcctaccacatacgagacncgtcacgacctaacgtagtaaacgttntttacgaacttaacttactacgttagaacctaacgtacgtaacgttacccaaccgttacccccgtggaccttaccggttaacggtttccgggggaacggaaacgggtaccggtaagggtacggaaacgtaaccgtaaacggaaaccggtacgttacggggtacgtacccgacggtaaccctaacg

SEQ ID NO: 412286 - DNA, 558 bp, Homo sapiens
  misc_feature: GZ8MTXP02HGYHP.17.26.C04.1.454.CMB.2.raw
  modified_base (195)..(195): a, c, t, g, unknown or other
  modified_base (220)..(220): a, c, t, g, unknown or other
  modified_base (236)..(236): a, c, t, g, unknown or other
  modified_base (270)..(270): a, c, t, g, unknown or other
  modified_base (341)..(341): a, c, t, g, unknown or other
  modified_base (393)..(393): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcattagnagctattaatggtatcagcagaaaccagggaaancccctaagctctgatcttgctgcatccagtttgactaaaggtggggtcccttcgaagttcagtggcagtgntcgtggacagtattcgactctcacctatcagcagtctcgacaactgaaagtnttttagacttaaacttactactagtacaacgtagtacgttaacaaccttaccccgtacggtacctactaccggtttacggccgggtaacgggacccgtaaagggtcggaacgtaacgtacgtaaaacggtaacgttcggtacggacctggaccacctagtttccg

SEQ ID NO: 412287 - DNA, 678 bp, Homo sapiens
  misc_feature: GZ8MTXP02JBAK3.17.26.C04.1.454.CMB.2.raw
  modified_base (198)..(198): a, c, t, g, unknown or other
  modified_base (294)..(294): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcacatcacgttcggccgggcaagtcagagctaattagcagtacttaatttaaagttggtatcgagacaacggaaaaccgagggaaaccncccctaagcctaccgtgtacttcttgctgactactccgtagtttacgacgtaaacgggttccggggttaccccccttagtaacgtttcgaggttcggactaggtggtactcgtagggactagtactttcactcacaccctatcagtactagtcctacgacctaacgtagaattagtttacaaccttaaactttactacgttacgtaacaaacgtaacgtaacttaaacctaacccgttacccgtacggtacccttaaccggttaccggtttacggggaccggggtaaaccgggtaaaccgtaaaggggtacggaaaacgtaacgtaaaaccgtaaaacggtaacgttcgggtacgggtaccttacggaacccgtaacgtttacg

SEQ ID NO: 412288 - DNA, 724 bp, Homo sapiens
  misc_feature: GZ8MTXP02IK7ZP.17.26.C04.1.454.CMB.2.raw
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccgggcaagtcagagcattagcagtctaattaaattggtatcagacaagaaaccgagggaaacgcccctaagctcctgattcttgctgacatcctagtttacgacgtaaaaggttcggggtacccccctttacgtaacgggtttcgacggttagggccgtaagggtcgggtaacgttcggttagggggaacctaggttaactttcaaccttcctacctaaccctaatccgtaacgaccgtacgttccttaggaccctaaaaccgtagtaaacgttagtttttacgaaccttaaaacttttaccgtaaacttcggtaaacctaaaacgtaacggtaaacgtttaaaccgtaaaacccttacccccgtacggggtacccttaccgttaaccggtttttacccgggggaacccggggaaacggggtaaacccgtaaagggggttaccggggaagtaacgttaaaccggaaaacggtaacgtaggttacggactaccggacctacctaacg

SEQ ID NO: 412289 - DNA, 519 bp, Homo sapiens
  misc_feature: GZ8MTXP02H18YU.17.26.C04.1.454.CMB.2.raw
  modified_base (196)..(196): a, c, t, g, unknown or other
  modified_base (275)..(275): a, c, t, g, unknown or other
  modified_base (308)..(308): a, c, t, g, unknown or other
  modified_base (360)..(360): a, c, t, g, unknown or other
  modified_base (380)..(380): a, c, t, g, unknown or other
  modified_base (386)..(386): a, c, t, g, unknown or other
  modified_base (393)..(393): a, c, t, g, unknown or other
  modified_base (403)..(403): a, c, t, g, unknown or other
  modified_base (424)..(424): a, c, t, g, unknown or other
  modified_base (441)..(441): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacttgccgggcaagtcagagctattagcagtctaatttaatggtatcaagcaagaaacaggaacnccctaagctcctgatcttgctgcatccagtttnacgtaaagtcgggtcccccttagaaggtttcagtgcagtggatcgtggtacngtatttcactctcacatcancatcancgaactnacgttatttnactaactttctactgactaanagtagtacaactacccngctacgtacttcggacgggacggaaccgaacggtggaactagtacaaaacgtactacggtacgcgtcgactaacctag

SEQ ID NO: 412290 - DNA, 635 bp, Homo sapiens
  misc_feature: GZ8MTXP02HTKDY.17.26.C04.1.454.CMB.2.raw
  modified_base (225)..(225): a, c, t, g, unknown or other
  modified_base (426)..(426): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggcccggganaagtcaagagctaagttagcaagtacttaagtttaaagttggtaatcaagacaaaggaaaaccgaaggggaaacctccccgtaaagccttcctgtacttcgtttgctgactatcctagtttgacgtaaaggttcggtacccccttagaaggttcaggtgactagggtgtagtcgagggactagtcttacactctacactancgagctagtcacgaactaaccgtagtaacgttagtttaccaacttaaactttactacgttagtaaccaaacgtaggtaaaccttactaaaccctcccgttacggtaccttacgttaccggttacggggacgggtaaacgggaaccgtaaagggtcgaaacgtaacgtaaccgaaacgtacgttggtacggactacgaccctaaacgtcg

SEQ ID NO: 412291 - DNA, 624 bp, Homo sapiens
  misc_feature: GZ8MTXP02JV4OQ.17.26.C04.1.454.CMB.2.raw
  modified_base (224)..(224): a, c, t, g, unknown or other
  modified_base (285)..(285): a, c, t, g, unknown or other
tcagcgtagactagcacgaccggtgctcgatttagtctagcgactttggggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacttggccggganaagtcagagctattagcagtcttaatttaaagtggtatcagacaagaaaccgagggaaacncccctaagcctcctgattcttgctgcacttcctagttacgactaagggttcgggtacccccttaggtaaggttcagtggcgtaaggtcgagtcgtaggactagttctttaccacgttccacctaactatcgacgtacgtagttaccgacgtaaccaaaccgttgtaaaagtttactttacgaaaccttaacgttaacctagttacgtaaactaaagtaccggtaacttaaaccaccgttaaccccgtcgtactaccgttacggttaccgggacggggaacggtaacggaggtacgaacgtaacgtaacgaaacgtcgagtcggacacggtaccagttcc

SEQ ID NO: 412292 - DNA, 603 bp, Homo sapiens
  misc_feature: GZ8MTXP02G3I8W.17.26.C04.1.454.CMB.2.raw
  modified_base (198)..(198): a, c, t, g, unknown or other
  modified_base (224)..(224): a, c, t, g, unknown or other
  modified_base (281)..(281): a, c, t, g, unknown or other
  modified_base (293)..(293): a, c, t, g, unknown or other
  modified_base (393)..(393): a, c, t, g, unknown or other
  modified_base (401)..(401): a, c, t, g, unknown or other
  modified_base (408)..(408): a, c, t, g, unknown or other
tcagcgtagactagcacgaccggtgctcgatttagtctagcgactttggggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttggccgggnaagtcagagcattagcagtcttaatttaagtgtatcagacaagaaaccagggaaacnccctaagcctcngtacttcttgctgctactcgtagtttcgactaaacgggttcgggtaccccccttagaaggttcgaggtggcaggtgatcgaggacagtactttcacttcncacagtcngcagtcncgtactaacgtagtaattagtttcaaccttaacttactactacggtaacaaacgtacgtaagttaacccaacgttaccccgtagtaccgttaccgttaccggttacggggaacgggtaacgggtaaccggttaaagggacggtaacgaaacgtaccgtaaaagtacccgtacggtacggcttaccgacacgttac

SEQ ID NO: 412293 - DNA, 635 bp, Homo sapiens
  misc_feature: GZ8MTXP02HCTEZ.17.26.C04.1.454.CMB.2.raw
  modified_base (200)..(200): a, c, t, g, unknown or other
  modified_base (271)..(271): a, c, t, g, unknown or other
  modified_base (298)..(298): a, c, t, g, unknown or other
  modified_base (418)..(418): a, c, t, g, unknown or other
  modified_base (432)..(432): a, c, t, g, unknown or other
  modified_base (440)..(440): a, c, t, g, unknown or other
tcagcgtagactagcacgaccggtgctcgatttagtctagcgactttggggtttgggggagtcagtctcagtcaggacacagcatggacatgagggtccccgctcagctcctggggctcctgctactctggctccgaggtgccagatgtgacatccagatgacccagtctccatccctccctgtctgcatctgtaagganacagagtcaccatcacttggccgggacaagtcgagagctaattacgcagtacttaatttaaagttggtacncgagacaaacgaaaccgaaggaaaccncccctaaagcctttcctgtacttccgtttgctgactagttccgtagtttacgacgtaaagggttccgggttaccccctagtaacggttcaggtcgtcgaggtgagttcggaggatacgtntttaccaccttacncctaactntaccagtctaagttcgaacacgtaacgtagtaagtttacttacgtaactaaactttagaccttagtaaccaaagtaatacttaacctacttacccgtcgtctacgtaccggttacgggacggtaacggtaaccggagggtacgaaacgtaacgaaacgtaacgtacgtacggcgtaactccgaacctacggtttc

SEQ ID NO: 412294 - DNA, 591 bp, Homo sapiens
  misc_feature: GZ8MTXP02FKARA.17.26.C04.1.454.CMB.2.raw
  modified_base (196)..(196): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacttgccggcaagtcagagcatagcagctaatttaaatgtatcagcaagaaaccagggaaacgcccctaagcctcctgtatctttgctgcatcctagttgacgtaaaggttcgggtcccccttagaagttcgagtggcaggtggatcgtgggactagtatttcactctcaccatcagctacgtctagacctaactagtaagttatttacgaacttaaacttactacttacgtaacaaacgtaagtaacgtttaaccaaccttaccccgtacgtacgtccgttaccgtttcgggggacggtaacggggaaaccaaagggggttacgaacgtaactaaacgaaaaccgtaacgtcggtacgggtctcggaacctacccgtaag

SEQ ID NO: 412295 - DNA, 656 bp, Homo sapiens
  misc_feature: GZ8MTXP02JD8J9.17.26.C04.1.454.CMB.2.raw
  modified_base (235)..(235): a, c, t, g, unknown or other
  modified_base (373)..(373): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctggtaggagacagagtccaccatctacgtggccgggacaagtcagngctatagcagtcttaattaaagtggtatcgagacaacgaaaccgagggaaaccaccctaagctactgtattctttgctgctactcgtagtttgacgtaaacggttccgggtaccccttacgtaggttccaggtgacgnggttcgggactcggtagggactagtactttccacgtctacgtacctatcgagctagtctactaccgtaacgtagtaagttactttacgtacttaaccttacgtaacgttacgtaactaactaacggtaacttaaccctaaccgttacccccgtacgtaccgttacgtaccggtttaccgggacgggtaaacgggtaacccggtaaagggtacgtaaacgtaaccgttaaaccgaaacggttacggttacggttacggacctacggtaaccctacgttaacccg

SEQ ID NO: 412296 - DNA, 640 bp, Homo sapiens
  misc_feature: GZ8MTXP02GHU1F.17.26.C04.1.454.CMB.2.raw
  modified_base (482)..(482): a, c, t, g, unknown or other
tcagcgtagactagcacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctcgccccgattaaccgttggacaggaacccttggtccttccggcgagcgggtcttttcgacccgtctttatcgtttacttactgtcagcacttcgctacttctagactacctcagcatcgcctcacacgcacaccttcactcggactacaacgaaccncctaccccctacccaaacaccgactaacgtaaacgccgttcgttcgccgacgacgtccgttcgggtctacgtacgtttcgggtttaccgtccccgtttacgtacctttcccgttacccgaaccgtacttacgttacgtacgttacgtccgtacgtacg

SEQ ID NO: 412297 - DNA, 608 bp, Homo sapiens
  misc_feature: GZ8MTXP02G43WS.17.26.C04.1.454.CMB.2.raw
  modified_base (352)..(352): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatcgacccagtctccatcctccctgtctgcatctgtaggagacagagtcaccatcacgttggccggcaagtcagagctattagcagtcttaatttaaattggtatcagacaagaaaccgagggaacacccctaagctctgtattcttgctgctactctagttgacgtaaggtcggtacctagagttcagtgcagtgntcgtgggactagtacttcactccacacagtcagactagtctacgacctaaacgtgtaaacgttcgttttacgaaccttaaactttactaacgtacgttaacaaacgtacggttaacttaacctaaaccgtcccccgttagtacccgtacgttaccgggtttacgggaccggggtacggaaccgtaaggggtacggtaaacgtacgtaaaccgaaaacgtaacggtagtacggtacgacgtacctacttacgttccg

SEQ ID NO: 412298 - DNA, 643 bp, Homo sapiens
  misc_feature: GZ8MTXP02HM3NW.17.26.C04.1.454.CMB.2.raw
  modified_base (195)..(195): a, c, t, g, unknown or other
  modified_base (200)..(200): a, c, t, g, unknown or other
  modified_base (308)..(308): a, c, t, g, unknown or other
  modified_base (314)..(314): a, c, t, g, unknown or other
  modified_base (419)..(419): a, c, t, g, unknown or other
tcagcgtagactagcacgaccggtgctcgatttagtctagcgactttgggtttgggggagtcagtctcagtcaggacacagcatggacatgagggtcccccgctcagctcctggggctcctgctactctggctccgaggtgccagatgtgacatccagatgacccagtctccatcctcctgtctgcatctgaganacagntcacatcactcgccggacaagtcagacgactattagcaagtcttaatttaaagtgatcgagacaaacgaaacgaggaacctacccctaagcctacgagtacttcgttnacgttnacctatcgtagttcgacgtaaaggttccggtaccccttagaagttcaggttcgagtagtcgggtattccgaagggtactaagttcttacaactctacgaacctanacgatacgtacgtctacgtacaagttagtaaagtttacttaaccgtaaacttaacgtttaactactagtaaacctaaacgtaacggttaaacttaaccctaaccgttacccgtacgtaccgttaccgttacgggtaccgggaacggaacgggtaaacgtacgggtacgtaacgtaacgaaaaccggtaacgtacggtacggtacggaccgtactaccgtacgtc

SEQ ID NO: 412299 - DNA, 699 bp, Homo sapiens
  misc_feature: GZ8MTXP02IKH0T.17.26.C04.1.454.CMB.2.raw
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccactcctcctgtctgccatctgtaggagacagagtccaccatcacttggccgggacaagtcagagcattagcagtacttaatttaaatggtatcagacaagaaaccgagggaaaccgcccctaaagcctaccgtagtactttctttgctgactacttcctaggtttacgacgtaaagggttccggggttacccccttagtaacggttcgaaggtcggacgaagggttgggtacttcgggtaggggaacctaggttaactttcacttccctacaccctatcgaagcccgtagttccgtacaacccgtaaacgtaggtaaacgttagttttacggaaaccttaaactttacgtacgttacggtaaacccaaacgtaacgtaacgttaaacctaacccgttaccccgttacgggtaccttacccgttaaccggtttaccggggacgggtaaaccgggtaaacccggtaagggtacggaaacgtaaccgttaaacgaaaacggtacgttggacggtaccgacgtacacgtacg

SEQ ID NO: 412300 - DNA, 640 bp, Homo sapiens
  misc_feature: GZ8MTXP02HN77P.17.26.C04.1.454.CMB.2.raw
  modified_base (196)..(196): a, c, t, g, unknown or other
  modified_base (220)..(220): a, c, t, g, unknown or other
  modified_base (285)..(285): a, c, t, g, unknown or other
tcagcgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatccctccctgtctgcatctgtagganacagagtcacatcacttggccggnaagtcagagcattgcagtacttaatttaaagtggtatcgagacgaacgaaaccgtagggaaaccncccctaagcctccgtagtacttctttgctcgactacttaccgtagtttacgaaccgttaaagggttccgggttaccccttagggtaaagttctaggttcggagtaggtgtacgttcgagggaactagttacctttcaacttccactacatcgaactcgtagttccacgtaacctaactagggttaaacttacgtttaccaactttaaaccgtttacttacgtactaaacgaaacgtgttaaaccttacctaaccctcccgttcgcccttacggtaccggttacggggacggttaggacctaaggggtacacggaaactaacgaacgtcgtgacgactacgacctacgtacgtccg

SEQ ID NO: 412301 - DNA, 588 bp, Homo sapiens
  misc_feature: GZ8MTXP02IWKBD.17.26.C04.1.454.CMB.2.raw
  modified_base (279)..(279): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcatagcagtctaatttaaattggtatcagacaagaaaccagggaaacncccctaagctcctgatctttgctgcatccagtttgacgaaaggtcggggtcccccttagaagttcagtggcagtggatcgtagggacagtatttcactctcaccatcaagcagtctgactaactgaatagtttcactaaacttacatcgtaccaaacgagtaactttaccaaacttacccccgtcggtaccttccgtaacgtttccggggacgggacgggaaacccgttaaaggggacggaacgtaacgtaaccggtaaaaccggaaaacgtttcggtacgggaaccttcggaacccgtaaccctaacg

SEQ ID NO: 412302 - DNA, 547 bp, Homo sapiens
  misc_feature: GZ8MTXP02HZMPI.17.26.C04.1.454.CMB.2.raw
  modified_base (198)..(198): a, c, t, g, unknown or other
  modified_base (223)..(223): a, c, t, g, unknown or other
  modified_base (276)..(276): a, c, t, g, unknown or other
  modified_base (288)..(288): a, c, t, g, unknown or other
  modified_base (327)..(327): a, c, t, g, unknown or other
  modified_base (347)..(347): a, c, t, g, unknown or other
tcagcgtagactagcacgaccggtgctcgatttagtctagcgactttgggtttgggggagtcagtctcagtcaggacacagcatggacatgagggtcccccgctcagctcctggggctcctgctactctggctccgaggtgccagatgtgacatccagatgacccagtctccatcctccctgtctgcatctgtagganacagagtcaccatcacttgccgggnaagtcagagcattagcagctattaaattggtatcagcagaaaccagggaaacnccctaagctccngatcttgctgcatccagttgctaaaggtcggtccccctnaagttcagtgcagtgatcgngggacagtattcactctcaccatcagctagtctagacaaccgtgaaagtattttacgactaacttactactagtacaaatagtaacttaacaacttacccctcgtactacgtacgtttaccggacggtaaacggaaccgaagggtaggaactaacgtaacaaaacggtacttaggtacggcttacggactaacccgtacg

SEQ ID NO: 412303 - DNA, 532 bp, Homo sapiens
  misc_feature: GZ8MTXP02FIQ20.17.26.C04.1.454.CMB.2.raw
  modified_base (256)..(256): a, c, t, g, unknown or other
  modified_base (272)..(272): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggcaagtcagagcattagcagctattaaatggtatcancagaaaccagggaaancccctaagctcctgatctttgctgcatccagtttgcaaaggtggggtcccccttcgaaggttcagtggcagtggatctgggacagtatttcactctcaccatcagcagtctagcaacctgaagtattttgactaacttactactagtacaaacaggtaacttaacaactaccccctcggtacttcaacgtttcgggacggtacggggaaccaaacgggtggaacgataaccgaaaacgaactggtacggctgacactacg

SEQ ID NO: 412304 - DNA, 672 bp, Homo sapiens
  misc_feature: GZ8MTXP02HXJ3V.17.26.C04.1.454.CMB.2.raw
  modified_base (169)..(169): a, c, t, g, unknown or other
  modified_base (196)..(196): a, c, t, g, unknown or other
  modified_base (222)..(222): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtcnccatcctcctgtctgcatctgtagganacagacgtcaccatcacgttgccggnaagtcagagacattagcagtacttaatttaaattggtatcagacaacgaaaccgagggaaacgacccccgtaaagccttaccgtagtacttcctttagtccttacgacctacttcccgttaaggtttacgaaccgtaaaggggttccggggttaccccccttaacggtaacgggtttaccgagggtttggaccgtaggttgggtacgttccgtagggggtaacctaggtacttttacaaccgtttcaccaacctatccgagactagtccgtacgtacctaaccgttagtaagttaattttcgaaaccttaaacctttactacgttacgtaactaaacgagttaaacgttaacaaccgttacccgtacgtacttacgtacgttacgggacgggacgtaacgaaggtcgaacgtactaacgaaacgtacgtagacgactacgacctacgtac

SEQ ID NO: 412305 - DNA, 798 bp, Homo sapiens
  misc_feature: GZ8MTXP02G82YX.17.26.C04.1.454.CMB.2.raw
  modified_base (200)..(200): a, c, t, g, unknown or other
  modified_base (229)..(229): a, c, t, g, unknown or other
  modified_base (292)..(292): a, c, t, g, unknown or other
  modified_base (299)..(299): a, c, t, g, unknown or other
tcagcgtagactagcacgaccggtgctcgatttagtctagcgactttggggtttgggggagtcagtctcagtcaggacacagcatggacatgagggtccccgctcagctcctggggctcctgctactctggctccgaggtgccagatgtgacatccagatgacccagtcctccatccctccctgtctgcatctgtagganacagactcaccatcacgttcggccggganaagtcagacgctattagctaagtcttaatttaaagttgtatcagcaagaaaccgaggaaaccncccctanccttccagtacttcgtttagctgacctacttccgtagtttacgacggtaacgggttcggtcccccctttaagacggttctaggtcggacgaggtggtattcgggaggtaactagtactttaccgactacctactaaccctgacccaaggtcccttaaggtcccgtaactacccgtaaaaccgttagggtaaaggttttaccgttttaccgtaaaccctttaaaccgttttaaccttaacccgtttaacgggtaaaaccttaaaaccggtaaacgggtttaaaacccttaacccccgttaaaacccggtaacccccccgtttcgggttaaccccgtttaaccccggggtttaccgggttttaccccgggggaaacggggttaaacccgggggaaaacccggttaaacgggggttagggaaaacgttaacccgttaaaaccggaaaaccggtcgtttaacgggttccggtaaccggttaccggtaaccctacggtttaacg

SEQ ID NO: 412306 - DNA, 590 bp, Homo sapiens
  misc_feature: GZ8MTXP02FPGDY.17.26.C04.1.454.CMB.2.raw
  modified_base (277)..(277): a, c, t, g, unknown or other
tcagcgtagactagcacgaccggtgctcgatttagtctagcgactttggggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggccgggcaagtcagagcattagcagctaatttaaatggtatcagcaagaaaccaggaaancccctaagctcctgatctttgctgcatcctagtttgacgtaaaggtcggggtacccccctttacgaaaggttcaggttggctaggtggatcgtgggacagtatttcactctcaaccatcagcagtctgacaactagaagtatttgactaacttactactagtacaacgtagtacgttaactaacctaccccgtacggtaccttacgtaccgtttccgggacgggtaacggggtaacccgtaaaggggttacggaacgtaacgttaaccgaaaacggtacgtacggtacggacgttacgaccgtaaccttaacg

SEQ ID NO: 412307 - DNA, 624 bp, Homo sapiens
  misc_feature: GZ8MTXP02FY0BL.17.26.C04.1.454.CMB.2.raw
  modified_base (223)..(223): a, c, t, g, unknown or other
  modified_base (275)..(275): a, c, t, g, unknown or other
  modified_base (353)..(353): a, c, t, g, unknown or other
  modified_base (427)..(427): a, c, t, g, unknown or other
tcagcgtagactagcacgaccggtgctcgatttagtctagcgactttggggtttgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcacatcacttgccgggnaagtcagagcattagcagctaatttaatgtatcagcaagaaaccagggaacncccctaagctcctgattctttgctgctactcctagtttcgacgtaaaggtcggggtcccccttagaaggttcaggtgngtaggtggatcgtgggactagtatttcactctacaccatacacgtctacgtctagacctaacctaggtaaattntttacaacttaaacttaactacttagtaaccaacgtaaggtaacttaactaaacctacccccgttcggacctttaccgtaccggttttaccggggaccgggtaaacggggaaacccggtaaaggggttcgggaaaacgaacgttaaaccggaaaaccgtaacggttggtacggtaccgttacggacctacccttaag

SEQ ID NO: 412308 - DNA, 617 bp, Homo sapiens
  misc_feature: GZ8MTXP02JDOQ7.17.26.C04.1.454.CMB.2.raw
  modified_base (197)..(197): a, c, t, g, unknown or other
  modified_base (274)..(274): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagctaattaatggtatcagcaagaaaccaggaaacncccctaagctctgatcttgctgctatcctagtttcgactaaacggttcggggtaccccccttagaaacggtttcaggttggactaggtggatcgtaggggactagtactttcactctacaccatcagctatctagacctaaccgtagtaagttatttcgactaaactttactactacgtacaaacgtagtacgttaaccaacttaccccgtacggtaccttaccgttaccggtttacggggaccgggtaaaccggggtaaccgtaaaggggtacgggtaaacgtaacgttaaccggaaaaccgtaaacggttggtacgggactacggaccctaaccgttaacg

SEQ ID NO: 412309 - DNA, 644 bp, Homo sapiens
  misc_feature: GZ8MTXP02GTN7Z.17.26.C04.1.454.CMB.2.raw
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatccctccctgtctgcatctggtaggagacagacgtcaccatctacttcggccgggacaagtcagagctattagctagtcttaatttaaagtggtatcgaagacaaacggaaaccgagggaaacctcccctaaagcccttccgagtactttcgtttagccttcacgtacttcctaggtttacgaacggtaaagggttccggggttaccccccttagaagggttcaggttgacgtaggtgggtatccggtagggactagtactttaccacctactaccgaaccataccgaagcccgtattccgacgaacctaacgtagtaaagtttactttacgaaaccttaaactttactactacgtaacctaaacgtagtaaacctactaaacccgtcccgtacgctacgtacgttcggacggaacggtacgaaggtaggaactacaaacgaaccgtagttcggacgtcacgtacacgttac

SEQ ID NO: 412310 - DNA, 684 bp, Homo sapiens
  misc_feature: GZ8MTXP02HGKSF.17.26.C04.1.454.CMB.2.raw
  modified_base (194)..(194): a, c, t, g, unknown or other
  modified_base (290)..(290): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgaccagtctccatcctcctgtctgcatctgtaganacagagtcaccatcacgttcggccgggacaaagtcagacgctaattagcagtacttaatttaagttggtatcaagacaagaaaaccgagggaaacnccccgtaagccttaccgtgtacttcgttcgctcgactacttccgtagttacgacgtaaacgggttcgggttacccccttacgtaaggttcgaggttcgggacgtagggttcggtacgtcggtaacggggtaactaggttactttaccacttcctaccaacgtactcacgactacgtctacgactaacgttagtaaacgtttagtttacgaacttaaccgtttaataccttacgaactaaacgtaacggtaacttaaaccgtaaccgtaccccggttacgtaccgttaaccgtaccggtttacggggaacggggtaaccggaacgtaacgggtacgacgtaaacgtaacgtaaaacggtacgtacggtacggtacgtacggaacctaaccggtac

SEQ ID NO: 412311 - DNA, 615 bp, Homo sapiens
  misc_feature: GZ8MTXP02I2F58.17.26.C04.1.454.CMB.2.raw
  modified_base (197)..(197): a, c, t, g, unknown or other
  modified_base (221)..(221): a, c, t, g, unknown or other
  modified_base (276)..(276): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagatcaccatcacttgccgggnaagtcagagcattagcagtctaatttaaatgtatcagcaagaaaccgaggaaacncccctaagcctacctgatctttgctgcatccagtttgacgtaaaggtcggggtacccccttagaacggttcaggtcggacgtaggtgggtactcggtaggactagttacttcactctacactcacacgctacgtctacacctaacgtagtattacgttacgtaaccttaacttactactactaacaacgtagtaacttaacctaacccttacccgtacgtaccgttaccgttaccggttacgggggaccgggtaaacgggtaaacggtaacgggtacgaaacgttacgaaaaccgtaaaacgttacggtacggtccgtacgtaccgacctacgttaccg

SEQ ID NO: 412312 - DNA, 682 bp, Homo sapiens
  misc_feature: GZ8MTXP02GQ2FH.17.26.C04.1.454.CMB.2.raw
  modified_base (199)..(199): a, c, t, g, unknown or other
  modified_base (223)..(223): a, c, t, g, unknown or other
  modified_base (287)..(287): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatcgacccagtctccatcctccctgtctgcatctggtagganacagatcaccatcacttgccgggnaagtcagagctaattagcagtctaatttaaagttggtatcgagacaagaaaccgagggaaaccncccctaagccttccgtagtacttcgtttgctgacctacgtaccgtagtttagacgtaaacgggttcggggttacccccctttaggaaacggtttcgaggttaggcgtaaggtcgggtatcggtaggggtacagtactttaccgacttaccactaccatcgagcctagtccgtagtaccgtaaccgtagtaagttagtttcaaccttaaacgtttactacgtactaacgaacgtaaggttacttaacctaaccgttaccccgtacggtaccttaccgttaaccgggtttacccggggacgggtaaaccggggtaaaccgtaaggggttaacggggaactaacgtaaaccgtaaaaccgtacggttagtacgggtacctacggaccctactttaccg

SEQ ID NO: 412313 - DNA, 596 bp, Homo sapiens
  misc_feature: GZ8MTXP02JC741.17.26.C04.1.454.CMB.2.raw
  modified_base (198)..(198): a, c, t, g, unknown or other
  modified_base (223)..(223): a, c, t, g, unknown or other
  modified_base (232)..(232): a, c, t, g, unknown or other
  modified_base (275)..(275): a, c, t, g, unknown or other
  modified_base (405)..(405): a, c, t, g, unknown or other
  modified_base (414)..(414): a, c, t, g, unknown or other
  modified_base (435)..(435): a, c, t, g, unknown or other
tcagcgtagactagcacgaccggtgctcgatttagtctagcgactttgggtttgggggagtcagtctcagtcaggacacagcatggacatgagggtcccccgctcagctcctggggctcctgctactctggctccgaggtgccagatgtgacatccagatgacccagtctccatcctccctgtctgcatctgtagganacagactcacatcacttggccgganaagtcagancatagcagtctaattaatgatcagacaagaaaccgaggaaacncccctaagcctacctagattctttgacttgactagtcctagtttacgacgtaaaggttcggtaccccttagaaggttcaggtgactaggtggactcggtaggaactagtaacttcactactacacatcanctatcgtanacctaactgtaaattacgttnaacttaaacgttactactacggtaaccaaagtacgtaaacgtttaacaaccgttaccccgtacgtacttacgtacggtttaccgggaggtaaaccgggtaaacgtaagggtacgaacgtaagtaaaccgaaacgtacgtggtacggcctacgacctactag

SEQ ID NO: 412314 - DNA, 547 bp, Homo sapiens
  misc_feature: GZ8MTXP02HYB1B.17.26.C04.1.454.CMB.2.raw
  modified_base (197)..(197): a, c, t, g, unknown or other
  modified_base (221)..(221): a, c, t, g, unknown or other
  modified_base (275)..(275): a, c, t, g, unknown or other
  modified_base (288)..(288): a, c, t, g, unknown or other
  modified_base (374)..(374): a, c, t, g, unknown or other
  modified_base (385)..(385): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccggnaagtcagagcattagcagactattaaatggtatcagacagaaaccagggaaacncccctaagctccngatctttgctgcatccagtttgacgtaaaggtggggtaccccttacgaaaggttcagttgcgagtgggatcgtggactagtcttcnctactcaccanctagcagtctgacactaggaatatttgactaactttactacctagtactaacgtaagactttaacaaacttacccctgtacctaccggtactttacgggcggaaacggaccgaaaggtcgacgtaacgtacaaaacgtagtagtacgcacggacaacctacg

SEQ ID NO: 412315 - DNA, 626 bp, Homo sapiens
  misc_feature: GZ8MTXP02FNRHK.17.26.C04.1.454.CMB.2.raw
  modified_base (196)..(196): a, c, t, g, unknown or other
  modified_base (224)..(224): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgcagatgtgacatccagatgaacccagtctccatcctccctgtctgcatctgtaganacagagtcaaccatcacttggccggtanaaggtcagagtcatagcagacttaattaaatggaatcagacaagaaacgaggaaacgtcccctaaagcctctgtatcttcgctgacactccgtaagtttgacgtaaacggttcgggtaccccttagtaaagttcaaggttcggcgtagttggggaacttcgtaggggtacctagttaactttcacccgttactaccaaccctatccgaagtcctagtcgtaacgtaccaaacgttagaaacttattttcaaacttaacttacttacggttataacctaaagaagtaacgttaactaaacgttaccccgtaggaccttacgtaacgtttccggggaaagggtaacggaaacttaacggggagaacgtatacgaaaacgtgtacgacggtcctagacccatacg

SEQ ID NO: 412316 - DNA, 596 bp, Homo sapiens
  misc_feature: GZ8MTXP02F0K2O.17.26.C04.1.454.CMB.2.raw
  modified_base (376)..(376): a, c, t, g, unknown or other
  modified_base (403)..(403): a, c, t, g, unknown or other
  modified_base (408)..(408): a, c, t, g, unknown or other
  modified_base (426)..(426): a, c, t, g, unknown or other
  modified_base (436)..(436): a, c, t, g, unknown or other
  modified_base (508)..(508): a, c, t, g, unknown or other
tcagcgtagactagcacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatacttaacctgtttcccatcgactacgcctttcggcctcgccttaggggtccactcaccctgccccataacgtgacaggacctggcttccggcgagcggctttcacccgtnttatcgttacttatgtcagcattcgcncttcngactacctcaagtcatcncctcacgacncactacctcacgacgactacgacaaccgccctacccaacccaacaaccgacaagtaacgcgtcgctcgccgnacgtcgttcggtcgacttacggttcggtttacccgtcccgtttactacttcccgttcccgcctacgtcctacgtacttacgtactacg

SEQ ID NO: 412317 - DNA, 658 bp, Homo sapiens
  misc_feature: GZ8MTXP02GVWVY.17.26.C04.1.454.CMB.2.raw
  modified_base (227)..(227): a, c, t, g, unknown or other
  modified_base (236)..(236): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtcctgcatctgtaggagacagacgtcaccatcacgttggccggganaagtcaganctattagctagtacttaatttaaattggtaatcgagtacaacggaaaccgtaagggaaacgcccccgtaaagccttacccgtagtacttacgttgctggactatccgtagtttacgacgtaaacgggttccggggtaccccctttagtaacggttcacgggttcggacgtagggtcggtaactcggttacggggactacggtatttaccacttacctacaacgtactcgaacgtcgtaacgtcgtacgtacctaaaccgtgtaaacgtttatttaccgaacttactttaacgtacttagtaccaaacgtagtaaccgtaactaacgtcccctagtcctacgtacggtttcgggaggtaccgggtacaagggtcgaaacgtacgtaacgaacggtacgtggacggtctaacggacacccttag

SEQ ID NO: 412318 - DNA, 651 bp, Homo sapiens
  misc_feature: GZ8MTXP02HRLGC.17.26.C04.1.454.CMB.2.raw
  modified_base (235)..(235): a, c, t, g, unknown or other
  modified_base (390)..(390): a, c, t, g, unknown or other
  modified_base (421)..(421): a, c, t, g, unknown or other
  modified_base (436)..(436): a, c, t, g, unknown or other
  modified_base (456)..(456): a, c, t, g, unknown or other
tcagcgtagactagcacgaccggtgctcgatttagtctagcgactttggggtttgggggagtcagtctcagtcaggacacagcatggacatgagggtcccccgctcagctcctggggctcctgctactctggctccgaggtgccagatgtgacatccagatcgacccagtctcccatccctccctgtctgcatctggtaggagacagagtaccaccatcctagttcggccggganaagtcgagagctaattgacagtacttaattaaagttggaatcagacaagaaaccgaggaaccacccctaacgtctcctagtatctttagctcactacgtcttagttacgacggtaaacggttccggttcccccttagtaaggtgaacggtgacgnggtcggagtcggagccgttaagtacttaccncctactaccaactanacgacgtaacgtcgttaccngtaaccaacgtagtaaagttgtttaccaactttaaacccgttacttgtaacgtacaaacgtacggtaacttaaccgacccgttacccccgtaggtccttaaccgtcgggtttacgggacgggttacccggaaagtacgggtaacgaccgtaacaaacggttaacgacggtcgtacggacttcgacctttaatccg

SEQ ID NO: 412319 - DNA, 677 bp, Homo sapiens
  misc_feature: GZ8MTXP02H8V8O.17.26.C04.1.454.CMB.2.raw
  modified_base (199)..(199): a, c, t, g, unknown or other
  modified_base (225)..(225): a, c, t, g, unknown or other
  modified_base (233)..(233): a, c, t, g, unknown or other
  modified_base (289)..(289): a, c, t, g, unknown or other
tcagcgtagactagcacgaccggtgctcgatttagtctagcgactttggggtttgggggagtcagtctcagtcaggacacagcatggacatgagggtcccccgctcagctcctggggctcctgctactctggctccgaggtgccagatgtgacatccagatgacccagtctccatcctccctgtctgcatctgtagganacagagtcacatcacttggccggganaagtcagngctattagcagtacttaatttaaagttggtatcagacaacgaaacgaagggaaacnccccaagcctctagacttctttgcttgctacttccgtagtttagaccgtaaagggttccggggttacccccttacggtaaagggtttccgaggggtacggacgtaagggtgggtaaacgttcggtacggggactagttactttccaacctcctacacctactacacgtactacgtctacgtaccaaccgttagtaagttacgtttacgaaccttaaactttacgtactacgtaactaaacgtagtaacgttaaccaacccgttaccccgtacgtccttaaccgtacggtttaccgggacggggtaaacggaaacggtaaacgggtacggtaaacgtaaccgtaacgtaaaacggtcgtaaggtcggtactaccgacctaacgttaccg

SEQ ID NO: 412320 - DNA, 684 bp, Homo sapiens
  misc_feature: GZ8MTXP02HDQGO.17.26.C04.1.454.CMB.2.raw
  modified_base (229)..(229): a, c, t, g, unknown or other
  modified_base (290)..(290): a, c, t, g, unknown or other
  modified_base (311)..(311): a, c, t, g, unknown or other
  modified_base (414)..(414): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatcgacccagtcctccatcctccctgtctgcatctggtaggagacagagtcaccatcacgttcggccggganaagtcagagctattagcagtacttaattaaagttggatacagacaagaaaccgaggaaacncccctaagcctcgtagacttntttgctgactactctagttgacgtaagggttccggtacccctagtaggttcaggtggcgtaggtggatcggtagggactagttacttcactacctacacctanacgagctagtcctacgaaccgtaacgtagtaagtttacgtttacgtaaaccttaacgtttactaccgttacgttaaaccgaaacgttaacgttaacgttaaaccctaaaccgttacccccggttacggtaccctttaccgggttaacccggtttaccgggggaaccgggtaaacggggtaaaccggtaaacggggtacgggttaaaacgacgtaaaaccgtaaacggtaccgttaggtccggttaacgtccggaaccttaccggttaacg

SEQ ID NO: 412321 - DNA, 685 bp, Homo sapiens
  misc_feature: GZ8MTXP02IHZWO.17.26.C04.1.454.CMB.2.raw
  modified_base (226)..(226): a, c, t, g, unknown or other
tcagcgtagactagcacgaccggtgctcgatttagtctagcgactttggggtttgggggagtcagtctcagtcaggacacagcatggacatgagggtccccgctcagctcctggggctcctgctactctggctccgaggtgccagatgtgacatccagatcgacccagtctccatcctccctgtctgcatctgtaggagacagagtccaccatcacttggccgganaagtcagagcattagcagtacttaatttaaattggtatcgaagacaacggaaaaccgaagggaaaccgaccccgtaagccttacccgtagtacttctttagactacgtacctagttcctagtttacgacgtaaaggttccgggttacccccttacgtaaggttcaggtggtactaggtggattacggaggtactagtcttacactactacactatacgagactacgtcgtacgtactaacgtagtaacgttattttacgaactttaaaccgtttacttaccgttacgttaaccaaacgtaaggttaaccttaaacccgtaacccgttaccccgtaccggtaccgttaccggtttaaccggttacggggtaccggggaaacgggtacccggaaaggggttacggaaacgttaacaacggtaaaacgtacgttacgtacggacgtcggaacctacttaacg

SEQ ID NO: 412322 - DNA, 562 bp, Homo sapiens
  misc_feature: GZ8MTXP02JE0G4.17.26.C04.1.454.CMB.2.raw
  modified_base (196)..(196): a, c, t, g, unknown or other
  modified_base (201)..(201): a, c, t, g, unknown or other
  modified_base (223)..(223): a, c, t, g, unknown or other
  modified_base (235)..(235): a, c, t, g, unknown or other
  modified_base (282)..(282): a, c, t, g, unknown or other
  modified_base (305)..(305): a, c, t, g, unknown or other
  modified_base (333)..(333): a, c, t, g, unknown or other
  modified_base (346)..(346): a, c, t, g, unknown or other
  modified_base (354)..(354): a, c, t, g, unknown or other
  modified_base (363)..(363): a, c, t, g, unknown or other
  modified_base (372)..(372): a, c, t, g, unknown or other
  modified_base (376)..(376): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctcctgtctgcatctggtaganacagngtcaccatccacgttgcccggntaagtcagacgntattagcagtcttaattaagtgactcagactaagaaaccgaggaacnccctactctgattctgactgacntctgttgactaaaggtcggtccccctanaggttcagtgacnggtcgtancgtaggacngtacttccnctcncactgacagtctacgtcgacgtacgtaacgtatacgttagttactacttacttacgtactacgtaacaagtacgttacgtacctaccgttccgtacgtacgtacgtacggttacggacgggaaacgttacgaacggtcgaaacgtacgtaacgtaacgtacgtcgtacgacgtacgaccgtactcg

SEQ ID NO: 412323 - DNA, 674 bp, Homo sapiens
  misc_feature: GZ8MTXP02JJ63X.17.26.C04.1.454.CMB.2.raw
  modified_base (202)..(202): a, c, t, g, unknown or other
  modified_base (312)..(312): a, c, t, g, unknown or other
  modified_base (437)..(437): a, c, t, g, unknown or other
tcagcgtagactagcacgaccggtgctcgatttagtctagcgactttggggtttgggggagtcagtctcagtcaggacacagcatggacatgaggatccccgctcagctcctggggctcctgctactctggctccgaggtgccagatgtgacatccagatgacccagtcctccactccccccctgtctgcatctggtagganacagagtcaccatcacgttcggccgggacaagtcagagctagttagcagtacttaatttaaagttggtatcaagacaacggaaacccgaaggggaaacctccccgtaaanccttaccgtgtacttctttaggctcgactacgttccgtagtttcgacgtaaacggttcgggtcccccttagtaggtcaggtgactaggtggactcgtagggactgttactttcacttctacaccntcagcagttcagacctaacgtagtaagttactttcgaaaccttaactttacgtacttacggtaacaaacgtaagtaaccttaactaacccgtccccgtacgtaccctacggttacccggttacggggaacgggggtaaaccgggtaaaccgtaagggggttacggaaacgtaacgtaaaaccgtaaaacccggtaggtttacggggaccgtaacgtcggtaacccgtaactttaccg

SEQ ID NO: 412324 - DNA, 567 bp, Homo sapiens
  misc_feature: GZ8MTXP02HZWBN.17.26.C04.1.454.CMB.2.raw
  modified_base (198)..(198): a, c, t, g, unknown or other
  modified_base (224)..(224): a, c, t, g, unknown or other
  modified_base (273)..(273): a, c, t, g, unknown or other
  modified_base (286)..(286): a, c, t, g, unknown or other
  modified_base (294)..(294): a, c, t, g, unknown or other
  modified_base (390)..(390): a, c, t, g, unknown or other
  modified_base (410)..(410): a, c, t, g, unknown or other
tcagcgtagactagcacgaccggtgctcgatttagtctagcgactttgggtttgggggagtcagtctcagtcaggacacagcatggacatgagggtcccccgctcagctcctggggctcctgctactctggctccgaggtgccagatgtgacatccagatgacccagtctccatcctccctgtctgcatctgtagganacagagtcaccatcacttggccgggnaagtcagagcattagcagctattaaattgatcagcagaaaccaggaacncccctaagctccngatctttnctgcatccagtttgacgaaagtggggtaccccttacgaaggttcaggttggcagttgaatcgtggacagtatttcaactctacacatcagctagtntcgacaacctgaaaacgttntttacgacttaacttactactagacaacgtaagtaacgttaactaactaaccccgtcgtactacgttacgttacggggacggtaacggtaccgtaaaggtacgaacgtaaacgtaaccgaaaacggtacgttaggtacgtactacgaccgtaactag

SEQ ID NO: 412325 - DNA, 551 bp, Homo sapiens
  misc_feature: GZ8MTXP02FVHFV.17.26.C04.1.454.CMB.2.raw
  modified_base (197)..(197): a, c, t, g, unknown or other
  modified_base (276)..(276): a, c, t, g, unknown or other
  modified_base (340)..(340): a, c, t, g, unknown or other
  modified_base (352)..(352): a, c, t, g, unknown or other
  modified_base (363)..(363): a, c, t, g, unknown or other
  modified_base (515)..(515): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgcgggcaagtcagagcattagcagtctatttaaatggtatcagcaagaaaccagggaaacncccctaagctcctgatctttgctgcatcctagtttgataaaggtcggggtaccccttgaggtcnggtggcaggtgntcgtagggacngtaactttcactctcaccctatcagactagtctgacaacctaggaaacgttatttacgacttaaacttactaacgtagtacaaactagtacttaacaactacccctggtacctctacgtttacgggacggaacggtaaccgaaggtacgganacgtaacgaaaagtacgtggtacgctacgacactac

SEQ ID NO: 412326 - DNA, 616 bp, Homo sapiens
  misc_feature: GZ8MTXP02HL5F6.17.26.C04.1.454.CMB.2.raw
  modified_base (222)..(222): a, c, t, g, unknown or other
  modified_base (280)..(280): a, c, t, g, unknown or other
  modified_base (424)..(424): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatcaccatcacttgccggganaagtcagagcattagcagcttaatttaaagttggtatcagcaagaaaccagggaaacncccctaagctcctgattctttgctgctattcctagttcgacgtaaacgggtcggggtaccccccttagtaaaggttcaggttcggcgtaagggtgggaacttcgtaggggacctaggtactttcactcgtcaaccatacgagtnagttctagacctaaccgttagaaagttatttacgaccttaaactttactactacgtaacaacgaaggtacttaactaacctacccccgtagtacctacttacggtttaccgggacgggtaacggtaaccgtaaacgggtgaacgtaactaacgaaaaccgtacgtaggtacggcgtaccgtactaacccgtg

SEQ ID NO: 412327 - DNA, 680 bp, Homo sapiens
  misc_feature: GZ8MTXP02G5PV7.17.26.C04.1.454.CMB.2.raw
  modified_base (198)..(198): a, c, t, g, unknown or other
  modified_base (437)..(437): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatcgacccagtctccatcctccctgtctgcatctgtagganacagagtcacctatctagttcggccgggacaagtcagagctagttagcagtacttaatttaaacgtggtactcgacgacgaaacggtaaaccgagggaaacctcccgtaagcctactgtacttcttagctgacctatccgttagttacgacgtaacggttcggtaccccttagaggttcgaggtgacgtagtggtactacgtacgggatacgttcttacgaccttactaccgaacctancgacgtctacggttccacgtaaccgtaacgttagtaagtttactttacgaaaccgtttaacctttataaccttaggtaaccaaaacgttacggtaaccttaaacccgtaccgttacccccggttaggtaccttaccggttaacggggttaccgggaacggggtaacggtaaccggtaagggtaacgtacgtacctaaacgaaaacggttcgtacgggtctaccggttacacctaccggtttaa

SEQ ID NO: 412328 - DNA, 655 bp, Homo sapiens
  misc_feature: GZ8MTXP02JG61E.17.26.C04.1.454.CMB.2.raw
  modified_base (199)..(199): a, c, t, g, unknown or other
tcagcgtagactagcacgaccggtgctcgatttagtctagcgactttggggtttgggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacgttcggccgggacaagtcgagagctattagcagtacttaatttaagtggtatcagacaagaaaccgaggaaacacccctaagctcgtagtacttcttagctgactacgttccgttagtttacgaacgtaaacgggttccgggttacccccttacggtaacggttccaggttgggactagggtggtatcggtagggactagttactttccactctacctaaccactacagtacctacgttcgtacgtaacctaaccgtagtaacgtttatttacgaaccttaaaccttacttacgtacgtaactaaacgtaacgtaacgttaaccaaccttaccccgtacgtacctaccgttaccgttacgggacgggtaaccgggaaccgtaaggttacggaactaacgtaacgaaacgtacgtacggtacggactacgacctacgtacg

SEQ ID NO: 412329 - DNA, 612 bp, Homo sapiens
  misc_feature: GZ8MTXP02FRK78.17.26.C04.1.454.CMB.2.raw
  modified_base (199)..(199): a, c, t, g, unknown or other
  modified_base (226)..(226): a, c, t, g, unknown or other
  modified_base (500)..(500): a, c, t, g, unknown or other
tcagcgtagactagcacgaccggtgctcgatttagtctagcgacttttggggtttgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatcacgttggccggganaagtcagaagctagtagctagtcttaatttaaagtgtatacagacaaacgaaaccgaaggaaacgcccctaagcctcctagtattcttcgctcgactactactagttcaggttaaaacggtcgggtaccccccttagtaacggttcgaggtaggcgtaggtggggattacggtagggaccttagtacttttccactttacctacgtaacccattacctaagaacgtactctaacgactaaaccgtgtaaagtttatttacgaattaacccgttntaacttataaccgaaattagtaaacttaccaccgttaacccgtcgtacttacgtacgttcgggacggtacggactaggtacgacagtacaagctaggtcgatacgccagtac

SEQ ID NO: 412330 - DNA, 674 bp, Homo sapiens
  misc_feature: GZ8MTXP02GHLYQ.17.26.C04.1.454.CMB.2.raw
  modified_base (244)..(244): a, c, t, g, unknown or other
  modified_base (304)..(304): a, c, t, g, unknown or other
  modified_base (320)..(320): a, c, t, g, unknown or other
  modified_base (436)..(436): a, c, t, g, unknown or other
  modified_base (449)..(449): a, c, t, g, unknown or other
tcagcgtagactagcacgaccggtgctcgatttagtctagcgactttgggtttggggggagtcagtctcagtcaggacacagcatggacatgagggtccccgctcagctcctggggctcctgctactctggctccgaggtgccagatgtgacatccagatcgacccagtcctccatccctccctgtctgccatctaggtaggagacagacgtccaccagtcacgttcggccgggacaagtcagngactaattagcagtcttaaatttaaatgtatacgagcgaaacgaaaccgacgggaaaccncccctaaagccttccngtacttctttcgctgactactccgttaggtttacgacgtaaacgggttccggggtacccccttagaacggtttcaggtcggactagggtcgagtcggtagggactagttctttacnctcctacaacctncgaacgctaacgtcagtaacctacgtagtacttagtttcaacgttacttactactacgtaacaagtacgttaacgttaaccgtaacccttccccggtggtacctttacccggtacgggtttacccggggacgggggaaacgggttaaaccggaaggggttacgggaaaacgtacctaaaccggtaaaagtcccggttgacgggtaccacgtactaaaccgttccg

SEQ ID NO: 412331 - DNA, 698 bp, Homo sapiens
  misc_feature: GZ8MTXP02JC8PC.17.26.C04.1.454.CMB.2.raw
  modified_base (197)..(197): a, c, t, g, unknown or other
  modified_base (227)..(227): a, c, t, g, unknown or other
  modified_base (291)..(291): a, c, t, g, unknown or other
  modified_base (306)..(306): a, c, t, g, unknown or other
  modified_base (652)..(652): a, c, t, g, unknown or other
tcagcgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctcctgtctgcatcgtgtagganacagacgtcaccatcacttcggccgggtanaagtcaagcgctattagactaagcttaagtttaatggtatacagacaagaaaccgacggaaacncccctaagccttcgngtaattccgtttagccgttagaccgttactccgttaaagtttcggaaacgttaaacggggttccggggtttaacccccttacggtaaacggggtttccaaagggttcggtaacggtaaggttcggggaatttccgggtaaagggggtactagggttaactttacccaactttaccaccgtaaacctaacgtacacgtacgacttacgtacgtacctaacgtagtaagtttactttcgaaacgttaacctttactacgtcgttaaacgaaagtaacggtaacttaaacccgtaactaccccgagtaccgtcgttaacgtccgggaaacggtacggaaccaaggggtntaaacggtaataccaaaacgtcgtagtcggactaccgtacaccgtc

SEQ ID NO: 412332 - DNA, 624 bp, Homo sapiens
  misc_feature: GZ8MTXP01A2UBK.39.36.D03.1.454.CMB.2.raw
  modified_base (273)..(273): a, c, t, g, unknown or other
  modified_base (362)..(362): a, c, t, g, unknown or other
tcagtcgcactagtcacgaccggtgctcgatttagctgcgtcacgatctctcttggggtctgagagaggagcccagccctgggattttcaggtgttttcatttggtgatcaggactgaacagagagaactcaccatggagtttgggctgagcgtgtcgttttctaggtggctaattttaaaaggtgtccagtgtgaggtgcagctgttggagtcgtgggggagggttggtacgagggccggggggtccctggagactctcctgtatagccctntggattcacctttagcaactatgccagtgaggttcggcccgcaggctccgaggggaaggggctgcgaggtgggtctcgagtcgttaggnggaagtggtaggtaggacctagttaaacacgcgacgtaaccgttccggtacggaacggggtcccggttacaacccggttcacccgaagacgactaaacttaccaaagaaccacaaccgttgtaaactcgtagaaacaaacgtaacgaacgacgacgacgagacgacggacgacgtacgtacgtatataacgtgttagacgaagtagtagttagttgttagttaagtttggttaagtggttagttaggtaagttaacgttaag

SEQ ID NO: 412333 - DNA, 608 bp, Homo sapiens
  misc_feature: GZ8MTXP01C2114.39.36.D03.1.454.CMB.2.raw
  modified_base (406)..(406): a, c, t, g, unknown or other
  modified_base (466)..(466): a, c, t, g, unknown or other
  modified_base (525)..(525): a, c, t, g, unknown or other
  modified_base (552)..(552): a, c, t, g, unknown or other
tcagtcgcactagtcacgaccggtgctcgatttagctgcgtcacgatctctcttggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggagggttggtacgaggccgggggggtccctgagactctcctgtatagcctcgtggattcattcttagcaactatgcatgagttggccgcgagctcgaggggagggctgcagtgggtctcgaggtcttaggtggaaggtgggtggaggacaatactaagcagactcgagaacgggcccgttcaccgttcnccgagacgacaaacttccaaagaacacgactagtactctacgaacaaaagtcggaaaccncggaccctaggaaggaccgtacccggaaggtaccgacgggtaccttaataacgtttacnggttagacggtaaaagtgttagggttntttcgggcgtttagtttttggacgttacgggttaatttggggaactttttaaccgg

SEQ ID NO: 412334 - DNA, 574 bp, Homo sapiens
  misc_feature: GZ8MTXP01EINJV.39.36.D03.1.454.CMB.2.raw
  modified_base (309)..(309): a, c, t, g, unknown or other
  modified_base (335)..(335): a, c, t, g, unknown or other
  modified_base (352)..(352): a, c, t, g, unknown or other
  modified_base (460)..(461): a, c, t, g, unknown or other
  modified_base (463)..(463): a, c, t, g, unknown or other
  modified_base (468)..(468): a, c, t, g, unknown or other
  modified_base (471)..(471): a, c, t, g, unknown or other
tcagtcgcactagtcacgaccggtgctcgatttagctgcgtcacgatctctcttggggtctgagagaggagcccagccctgggattttcaggtgttttcatttggtgatcaggactgaacagagagaactcaccatggagtttgggctgagcgtggtcgttttctagtggctaattttaaaggtgtcagtgtgaggtgcagctgttggagtcgtgggggaggttggtacgaggccgggggggtccctgagactcgtcctgtatagcctcgtggattcacctttagcaactatgccagtgagttggtccnccgaggcctcgaggggaagggctgcnggtgggtctcgaggttntaggtggaaggttggtgggtaggactataactaacgcaggtacctcccggtagaacggggtcccggttcacccgtctaccagagaccaattccaaagacacactgatnnanaaganaanagcgagagacgacgacgacgacgacgtactataactgttgagaagtagtgttagttgttacgttaagtttagttaagttgttagttaggttaagttaacgttg

SEQ ID NO: 412335 - DNA, 608 bp, Homo sapiens
  misc_feature: GZ8MTXP01DYF0Q.39.36.D03.1.454.CMB.2.raw
  modified_base (308)..(308): a, c, t, g, unknown or other
tcagtcgcactagtcacgaccggtgctcgatttagctgcgtcacgatctctcttggggtctgagagaggagcccagccctgggattttcaggtgttttcatttggtgatcaggactgaacagagagaactcaccatggagtttgggctgagcgtggtctttttctgtggcttaattttaaaaggtgtccagtgtgaggtgcagctgttggagtcgtgggggagggttggtacgagggccggggggtcctggagactctcctgtatagcctctggattcacctttagcaactatgccatgagtggtccncaggctccgagggaacgggctgctaggtggtctcgaggtctaggtggaagtgggtaggaggacataaactacgcgagaccgtcccggtaggaaccggggtcccggtttacacccggtctacccgaagacgaactaagttacccgaaaaagaacacacgttagtaactcgtaagaacgaaacgtaacgaacgaacgacgacgagacgacgacgacgtacgtacgtacgtataacgtgagagaagtagtagttagttgttagttaagtttagtaagttggtagttagtaagttaacgttaag

SEQ ID NO: 412336 - DNA, 825 bp, Homo sapiens
  misc_feature: GZ8MTXP01AD9JO.39.36.D03.1.454.CMB.2.raw
tcagtcgcactagtcacgaccggtgctcgatttagctgcgtcacgatctctcttggggtctgagagaggagcccagccctgggattttcaggtgttttcatttggtgatcaggactgaacagagagaactcaccatggagtttgggctgagctggtctttttctgtggctaatttaaaggtgtccagtgtgaggtgcagctgttggagtcgtgggggagggttggacgaggccgggggtcctggacgactctcctgtatagtcctgtggacttcacctttagactaactatcgcctagtcgaggttcgggtccccgcgacgggtcctaccggagggggaacgggggcttacggcgtaagggttcggggtccttaccggtagggttacgtttaggggtaggggtaaacccgggttgggggtacgggttaaggaaccgtagttaaacccgttaaccggcgacggtaaacccgttcccgggtagggtaaaccgggggtcccgttaccccgtacccggttacccgtacccgaaaggtaacgaacctaaatttacccgaaacgaaccaacctacgtagtacttacacgtaacctaaaggtacggtaaacgacgtacccggtaaggacgggaaccgacccggtaaaggggacccgtaacccgggggtaccttaaacggttaacttaacccggtaggttaaacccgggaaaggttaaaaggtcgtttaaaggggtttaacgtttggggttaccggttttaaggtttttagggaaccggttttacggggttaaacggttttcgggggtaaagtttttaacccggtttaacggg

SEQ ID NO: 412337 - DNA, 565 bp, Homo sapiens
  misc_feature: GZ8MTXP02HFM1Z.39.36.D03.1.454.CMB.2.raw
  modified_base (156)..(156): a, c, t, g, unknown or other
  modified_base (166)..(166): a, c, t, g, unknown or other
  modified_base (180)..(180): a, c, t, g, unknown or other
  modified_base (259)..(259): a, c, t, g, unknown or other
  modified_base (266)..(266): a, c, t, g, unknown or other
  modified_base (272)..(272): a, c, t, g, unknown or other
  modified_base (277)..(278): a, c, t, g, unknown or other
  modified_base (280)..(280): a, c, t, g, unknown or other
  modified_base (283)..(283): a, c, t, g, unknown or other
  modified_base (293)..(293): a, c, t, g, unknown or other
tcagtcgcactagtcacgaccggtgctcgatttagctgcgtcacgatctctcttggggtctgagagaggagcccagccctgggattttcaggtgttttcatttggtgatcaggactgaacagagagaactcaccatggagtttgggctgagcgtgngtttctaggnggctatttaaaggngtcagtgtgaggtgcagctgttggagtcgtgggggaggttggtacaggccggggggtcctgagctctcctgtatgcctntggatcnccttancatanncntgngtggtcgcgngcgtcgaggaggcgtgcgaggtggtcgtcgtagtcgtaggtaggtaggtggtaggtagacgtagtacgtacgcgacgtacgtcgtacgacgggtaccggtccgtaccgtctacgacgacgactaactacgaacgaacaacactagtactacgtacactaaagtacgaacgacgacgagagacgacgacgacgacgacgtatagtacgtagtagacgaagagtagtagtagtagttaagtttagtacgtacgttagtaggtacgttacgttag

SEQ ID NO: 412338 - DNA, 564 bp, Homo sapiens
  misc_feature: GZ8MTXP02JT792.39.36.D03.1.454.CMB.2.raw
  modified_base (465)..(465): a, c, t, g, unknown or other
tcagtcgcactagtcacgaccggtgctcgatttagctgcgtcacgatctctcttggggtctgagagaggagcccagccctgggattttcaggtgttttcatttggtgatcaggactgaacagagagaactcaccatggagtttgggctgagcgtggtcgttttctaggtggctaattttaaaaggtgtccagtgtgaggtgcagctgttggagtcgtgggggaggttggtacgaggccggggggtccctgagactctcctgtatagcctctggattcacctttagcaaactatgccatgagttggccgccaggctccgagggaaggggctgcagtgggtctcaggtctaggtggaagtggtagtaggacagtacacgcgaagactccgtagaacggggccggttcaccggtctaccgaagacgaactaacttacccaaaagaacactaactgtatcagaacaaanagaacacgacgagagacgacgacgacgacgacgtatatacgtagagacgaagagtagtagtagtagtaagttagtagtagtagtagtacgttacgttag

SEQ ID NO: 412339 - DNA, 354 bp, Homo sapiens
  misc_feature: GZ8MTXP02JM4QY.39.36.D03.1.454.CMB.2.raw
  modified_base (344)..(344): a, c, t, g, unknown or other
  modified_base (350)..(354): a, c, t, g, unknown or other
tcagtcgcactagtcacgaccggtgctcgatttagctgcgtcacgatctctcttggggacctgcagaagccagggcagtctccacaactcctgatcctatttgggttctaatcgggcctccggggtccctgacaggttcagtggcagtggatcaggcacagactttacactgaaaatcagcagagtggaggctgaggatgttgggttattactgcatgcaagctctacaaactccgctcacttcggcggaggaccaaggtggagatcaagcgaactgtgctgcaccatctgtcttcatcttcccgcctatctgaactagtgcgactgagcgggctggcaaggcncatagnnnnn

SEQ ID NO: 412340 - DNA, 585 bp, Homo sapiens
  misc_feature: GZ8MTXP02IEJGF.39.36.D03.1.454.CMB.2.raw
  modified_base (303)..(303): a, c, t, g, unknown or other
  modified_base (334)..(334): a, c, t, g, unknown or other
tcagtcgcactagtcacgaccggtgctcgatttagctgcgtcacgatctctcttgggtctgagagaggagcccagccctgggattttcaggtgttttcatttggtgatcaggactgaacagagagaactcaccatggagtttgggctgagcgtgtgtttctaggtggctattttaaaaggtgtcagtgtgaggtgcagctgttggagtgtggggagggttggtacgaggccgggggtcccgtgagactctcctgtatagcctctggattcacctttagcaactaatgccatgagtggtcgccngctccaggagggcgtgcagtggtctcgagtnttagtggaagtggtggtaggacatactacgcacgaactccgtagaacggggcgggttccgaccgtcctccgacgagacaacttaccgaaacgaacaacacctacgtaacttacgtagaacaaacgtaagaacgacgacgtacgagacgacggacggacgacggtacgtacgtagttacgtagtagacgaaagtagtagtagttagtacgttaagtttagttacgttacgttagttaggtacgttacgttag

SEQ ID NO: 412341 - DNA, 572 bp, Homo sapiens
  misc_feature: GZ8MTXP02FYMO2.39.36.D03.1.454.CMB.2.raw
tcagtcgcactagtcacgaccggtgctcgatttagctgcgtcacgatctctcttggggtctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggagggttggtacaggccggggggtccctggagactctcctgtatagcctctggattcacctttagcaactatgccatgagttggccgcaggctccgaggggaaggggctggcaggtgggtctcgaggtcttaggtggaagtggtggtaggacatactcgcagactccggagaacggggtccggttcaccgtctccgagagaacaacttccaaagaccacacgtgtaatctagacaaatggaaacagcctagacgacggaccgaggacgacggaccgtatactactgtagacgaaagtatggtattggtacgttaagttttggagttcgggttagttacgggtatttacgtttagg

SEQ ID NO: 412342 - DNA, 728 bp, Homo sapiens
  misc_feature: GZ8MTXP02FO7GZ.39.36.D03.1.454.CMB.2.raw
tcagtcgcactagtcacgaccggtgctcgatttagctgcgtcacgatctctcttggggtctgagagaggagcccagccctgggattttcaggtgttttcatttggtgatcaggactgaacagagagaactcaccatggagtttgggctgagctggcttttcttgtggctatgttaaaaggtgtccagtgtgaggtgcagctgttggagtctgggggaggcttggtacaggcggggggtccctgagactctcctgtacagtctctggattcagctttagccacctatgccatgagctgggtccgccaggctccgaggggaacggggctgggagtggggtctcgactccccgattaggtggtggccgtaggttgggtgggtaaatacgtaattatttagtcgtagggactcccggttaggaaacggggtcccgggttacaaccctaagtccgtacccaaggtaacgaacctaaaacttaccccgaaaaggtaaaaccctacttaccgtagttaaacttccgttaggaaccctaaaaattacggaaaacctaaacggccccttaagggaacggaccccggtaaccccgggaaacgggaaacccgaaaccccggggtacccctttaaacgttacgtttaaacccgtggtttaacgggaaacccgtaaaaacttccccgtaacccccggttaaccgttttacgggttaacgggtttttacggtaaaccccccg

SEQ ID NO: 412343 - DNA, 645 bp, Homo sapiens
  misc_feature: GZ8MTXP02F5T3Y.39.36.D03.1.454.CMB.2.raw
  modified_base (269)..(269): a, c, t, g, unknown or other
  modified_base (556)..(556): a, c, t, g, unknown or other
tcagtcgcactagtcacgaccggtgctcgatttagctgcgtcacgatctctcttggggtctgagagaggagcccagccctgggattttcaggtgttttcatttggtgatcaggactgaacagagagaactcaccatggagtttgggctgagctggtctttttctgtggctattttaaaaggtgtccagtgtgaggtgcagctgttggagtcgtgggggagggttggtacgacggccggggggtccctggagactctcctgtatagcctntggattcacctttagacaactatgccagtggagttcgggtccgccgaggcctaccgaggggacgggctgcgaggtgggtctcgtaggtgtaggtggaaggtgggtggtagactatactacgcagacgtccgaggaacggggtccgttcacccgtctaccgaagacgaacaaacttaccgaaaagaaccgtacaccgttagtaactcgtagaacctaaagacgtaaaacgcgtaccgaggaacggacggacccgagggtaaccgccggtaccgtaaagttacttacgnggtacggaacgtaaaaggtcgttaggttactggtacgtttaaggttttacggacgtttcgggttaagttgggtaactttacggtttacg

SEQ ID NO: 412344 - DNA, 737 bp, Homo sapiens
  misc_feature: GZ8MTXP02IRM5K.39.36.D03.1.454.CMB.2.raw
  modified_base (264)..(264): a, c, t, g, unknown or other
tcagtcgcactagtcacgaccggtgctcgatttagctgcgtcacgatctctcttggggtctgagagaggagcccagccctgggattttcaggtgttttcatttggtgatcaggactgaacagagagaactcaccatggagtttgggctgagctggtctttttctgtggcttattttaaaaggtgtccagtgtgaggtgcagctgttggagtcgtgggggaggttggtacgaggccggggggtcctgagctctctgtatagcctntggattcacctttagactaactatcgaccagtgtaggttcgggtcccgccagggcctacccggaaggggaacggggcgtggccgtagggttcgggtcctacggtacgggttcgttaagggtaggggtaaggtggggtaggtacgactaagtaccgtacgcgtagtaccgtccggtagggaaccggggtcccggttactacccggtccgtacccgaaggaacgaacctaaacttacccgaaaagaaccaactacgttagtactcgttacaactaaaatacgaaacacggtacccgtaggaacggacgaccgggaacggaacccgtaccgggtaacccttagtaaacgtttacggacggttacggaaacgtaaaaaggtggtttaacggttagtttacggtacggttttaaagtttttcggggaagtttaccggggtttaagtttccggggttaaattttaccggtttaaacggg

SEQ ID NO: 412345 - DNA, 592 bp, Homo sapiens
  misc_feature: GZ8MTXP02HDOL5.39.36.D03.1.454.CMB.2.raw
  modified_base (181)..(181): a, c, t, g, unknown or other
  modified_base (198)..(198): a, c, t, g, unknown or other
  modified_base (203)..(203): a, c, t, g, unknown or other
  modified_base (221)..(221): a, c, t, g, unknown or other
  modified_base (256)..(256): a, c, t, g, unknown or other
tcagtcgcactagtcacgaccggtgctcgatttagctgcgtcacgatctctcttggggtctgagagaggagcccagccctgggattttcaggtgttttcatttggtgatcaggactgaacagagagaactcaccatggagtttgggctgagcgtgtgtttctaggtggctaatttaaaggngtcagtgtgagtgcagntgtgngtgtgggaggtggtacgngcggggtccgtgagactctcctgtatgctcgtgtntctacttagtactactatcgcagtgtgtcggtccgcgacgcgtacgagggaggcgtgacgtggtcggtcgtcgtagtagtaggtaggtacggtaggtaggtaggtacgtacgtacgtacgcgacgtacgtaccggtacggacgggtaccgtaccgtaccgtaccgtacgacgacgaacgtaactaacgaaacgaactaacgtaacgtacgtactacgacgaagtaaagaacgtacgacgacgagagacgacgacgacgacgacgtacgtatacgtagtagacgtaagtagtagtacgtagtagtaagttagtagtagtagtagtacgttacgtacg

SEQ ID NO: 412346 - DNA, 615 bp, Homo sapiens
  misc_feature: GZ8MTXP02GTP3I.39.36.D03.1.454.CMB.2.raw
  modified_base (455)..(455): a, c, t, g, unknown or other
  modified_base (494)..(494): a, c, t, g, unknown or other
  modified_base (499)..(499): a, c, t, g, unknown or other
  modified_base (510)..(510): a, c, t, g, unknown or other
tcagtcgcactagtcacgaccggtgctcgatttagctgcgtcacgatctctcttggggtctgagagaggagcccagccctgggattttcaggtgttttcatttggtgatcaggactgaacagagagaactcaccatggagtttgggctgagctggtctttttctgtggcttattttaaaaggtgtccagtgtgaggtgcagctgtggagtcgtgggggaggttggtacgagggccggggggtcctgagtactctcctgtatagcctcgtggtattcacctttagactaacgtatcgacctatggtagttcggtccgcaggtcctaccggaaggggagggctggcgagggttcggtactcggtagttcgttaggtaggaacgggttgggtaggtaggactacgtacgtacgcgaacgtaccgtccggtaggaccggggtccgttccacccgttacnccgaagaacgaactaacgtccaaaagaccatactgtacnctaanactaagcaacncgcgagaacgcgacgtacgacgacgtatatacgtacgagagaacgtaagtgttacgtactggttattaaggttagacgttacggttagtacgttacttacgtacg

SEQ ID NO: 412347 - DNA, 738 bp, Homo sapiens
  misc_feature: GZ8MTXP02FL1TG.39.36.D03.1.454.CMB.2.raw
tcagtcgcactagtcacgaccggtgctcgatttagctgcgtcacgatctctcttggggtctgagagaggagcccagccctgggattttcaggtgttttcatttggtgatcaggactgaacagagagaactcaccatggagtttgggctgagctggtctttttcttgtggctattttaaaaggtgtccagtgtgaggtgcagctggttggagtcggtgggggagggttggtacgacgggcccggggggtccctggagtactctccgtgtatacgcctcgtggtacttcctacctttagactaactatcgcctagtggtaggttcggggtccccgccgacggccgtaccggaggggaacggggtcgtggcgtagggtcgggtctcgtacggttcgttaagggtgggaaggttgggtaggtaacggactaacgtaacgtacgcgaacgtaccgtccggtagggaaccggggtcccggttaccgaacccggtcctaccgaaggaacgtaactaaacttacccgaaaacgaaacctactaacttggtaacttcgtagaaaccgtaaaagtaccgaaaccgtacgtacccgtagggaacgaacggaccccgggaaaggaacccgtaccgggtaccgttaagttaacttaacgtagggtacgaaacggtaaaggagttacggttaagttcggtagtttaaggttttacgacggttacggttaggtacggtactttacgtttacgg

SEQ ID NO: 412348 - DNA, 492 bp, Homo sapiens
  misc_feature: GZ8MTXP01DN93M.11.73.G07.1.454.CMB.2.raw
  modified_base (342)..(342): a, c, t, g, unknown or other
  modified_base (360)..(360): a, c, t, g, unknown or other
  modified_base (390)..(390): a, c, t, g, unknown or other
  modified_base (458)..(458): a, c, t, g, unknown or other
  modified_base (468)..(468): a, c, t, g, unknown or other
  modified_base (479)..(479): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcagtcaggacattaagaactatttaaatggtatcggcagcgaccagggaaagcccctgagctcctgatctacgatgcgtccaatttggaaacagaggtcccccacgagttcagtggaaagtggntctgggacagactttacnctcaccatcagcagcctgcagcctgaaagntaattgacaaacattaattactgtcaacagtaatgatcgtctcctcaatttcggcccttggggaaccngagttggacntagaacgaacngttggcttgaacc

SEQ ID NO: 412349 - DNA, 556 bp, Homo sapiens
  misc_feature: GZ8MTXP01B3JBF.11.73.G07.1.454.CMB.2.raw
  modified_base (265)..(265): a, c, t, g, unknown or other
  modified_base (365)..(365): a, c, t, g, unknown or other
  modified_base (386)..(386): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcagacattaagaactattaatggtatcggcagcgacaggaancccctgagctcctgatctacgatgcgtaccaatttaggaaacagacggtcccccaccggaggttcagtggaaagtggaatcgtggggacagtactttacnctcaccatcagcacgcccganacgcctagaagatattgacaaacgattaattactagtacaacagtatagatcgtctcctctaaacgtttccggcccgttcggggaaccctaaggtacgttaggggaccttaaagtaacggtaaaaccggtaaaccttggggtacggttccgttcgggaacccgtaacccg

SEQ ID NO: 412350 - DNA, 506 bp, Homo sapiens
  misc_feature: GZ8MTXP01DPDU4.11.73.G07.1.454.CMB.2.raw
  modified_base (254)..(254): a, c, t, g, unknown or other
  modified_base (267)..(267): a, c, t, g, unknown or other
  modified_base (280)..(280): a, c, t, g, unknown or other
  modified_base (368)..(368): a, c, t, g, unknown or other
  modified_base (395)..(395): a, c, t, g, unknown or other
  modified_base (426)..(426): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatgtatcggnagcgacaggaaancccctgagctccngatctacgatgcgtaccaaatttggaaacaggacggtcccccaccgtaggttcagtggaaagtggaatcgtggggacagtactttacnctcacatcagcagcctgcagctagaanatattgacaaactattaattactatacaaanagtaatgtatcgtctctaactaatttcggcccttgggaccagagttggaactaatagaaacgactgttagaacttgaacc

SEQ ID NO: 412351 - DNA, 480 bp, Homo sapiens
  misc_feature: GZ8MTXP01BPHXU.11.73.G07.1.454.CMB.2.raw
  modified_base (360)..(360): a, c, t, g, unknown or other
tcagcgagagataccacgaccggtgctcgatttagctctacgctcaggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatggtatcggcagcgaccagggaaagcccctgagctcctgatctacgatgcgtccaatttggaaacagaggtcccccacgaggttcagtgaaagtggaatctgggacagactttacnctcaccatcagcagcctgcagcctgaagatattgcaaacatattactgtcaaacagtaatgatcgtctcctcaatttcggcccttgggaccagagttgacaatgaacgactgttgcttgc

SEQ ID NO: 412352 - DNA, 476 bp, Homo sapiens
  misc_feature: GZ8MTXP01ATDFN.11.73.G07.1.454.CMB.2.raw
  modified_base (445)..(445): a, c, t, g, unknown or other
  modified_base (447)..(447): a, c, t, g, unknown or other
tcagcgagagataccacgaccggtgctcgatttagctctacgctcaggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatggtaatcggcagcgagcagggaaagcccctgagctcctgatctacgatgcgtccaatttggaaacagacggtccacgaggttcagtggagtggatctgggacagactttactctcaccatcagcagcctgcagcctgaagatattggcaacatattactgtacaacagtatgatcgtctctcaatttcggcctgggaccngngttggaacagtgaaacgacttgtggctcg

SEQ ID NO: 412353 - DNA, 486 bp, Homo sapiens
  misc_feature: GZ8MTXP01DJRCF.11.73.G07.1.454.CMB.2.raw
  modified_base (416)..(416): a, c, t, g, unknown or other
tcagcgagagataccacgaccggtgctcgatttagctctacgctcaggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcagtcagacattaagaactattaaatgtatcggcagcgaccaggaaagcccctgacgctcctgatctacgatgcgtccaatttggaaacagacggtcccccaccgaggttcagtggaaagtggaatctgggacagactttactctcaccatcagcagcctgcagcctgaagatattgacaaacattattactgtccaaanagtaatgatcgtctcctcaattcggcccttgggaccagagttggacaatagaacaactgagtcttgaacc

SEQ ID NO: 412354 - DNA, 478 bp, Homo sapiens
  misc_feature: GZ8MTXP01C0KOX.11.73.G07.1.454.CMB.2.raw
  modified_base (357)..(357): a, c, t, g, unknown or other
  modified_base (412)..(412): a, c, t, g, unknown or other
  modified_base (449)..(449): a, c, t, g, unknown or other
tcagcgagagataccacgaccggtgctcgatttagctctacgctcagggggcagcagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaatataaatggtatcggcagcgaccaggaagcccctgagctcctgatctacgatgcgtcaatttaggaaacagacgtcccacgaggttcagtggaagtggatcgtagggacagtactttacnctcacatcagcagcctgcagcctgaagatattggacaactatattactgtacaanagtatgatcgtctctcaatttcggccctgggacaggngttaggaacagtgaaacgacttgtggctg

SEQ ID NO: 412355 - DNA, 500 bp, Homo sapiens
  misc_feature: GZ8MTXP01AF609.11.73.G07.1.454.CMB.2.raw
  modified_base (268)..(268): a, c, t, g, unknown or other
  modified_base (308)..(308): a, c, t, g, unknown or other
  modified_base (359)..(359): a, c, t, g, unknown or other
  modified_base (390)..(390): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaatggtatcggcagcgaccaggaaancccctgagctcctgatctacgatgcgtccaattggaaacngacgtccccacgagttcagtggaaagtggaatcgtgggacagtactttacnctcacatcagcagcctgcagcctagaacgtntattgactaaactattattacctgtacaacagtatgtatcgtctctcaacgtttccggccttgggacctaggacgttggacaagtagaaacgtactggttagcttgaacc

SEQ ID NO: 412356 - DNA, 557 bp, Homo sapiens
  misc_feature: GZ8MTXP01D23I4.11.73.G07.1.454.CMB.2.raw
  modified_base (270)..(270): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctccctgtctgcatctataggagacagagtcaccatcacttgccaggcgagtcaggacattaagaactattaaatgtatcggcagcgacagggaaacncccctagacgctcctgactctacgatcgcgtacctaaatttggaaacaggacggtcccccaccggtaggttcaggtaggaaagtggaatcgtggggacagtacctttactctcaccatcacgcagcctgcagcctagaacgatattcgacaactattattactagtaccaagtagtatgtacttaccgtccttcctaacgtaacgtttccgggaccccgttaggggaaccctaaggacgttcgggaacctaagtacgaaaacgtactaggttcggaacttcgaaccc

SEQ ID NO: 412357 - DNA, 569 bp, Homo sapiens
  misc_feature: GZ8MTXP01BM30J.11.73.G07.1.454.CMB.2.raw
  modified_base (297)..(297): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccatgtggcgtgcacctagtggagtcgtgggggagcttggtacagcctggacggtccctgagactctcctgtgcagcctctggatacatcttacaaaagtttcgaaatgagctgggtccncaggctcgtggggaagggcgagtggatttcatacatcagtagtagtggtaacaccttgactaatgacagtactcgtggtagaacgggccgtattcaccatctaccaagacgaacaaccgaccaaagtaattactaacttggtttactagtaccaaatagaaccagacctagagagacgaaggataacggtacttaatttacttagttgtgacgttcgaactcgaacgaaggaaaaacggtcggttacggtaaccgttaaggtttaacggggg

SEQ ID NO: 412358 - DNA, 538 bp, Homo sapiens
  misc_feature: GZ8MTXP01EN6MB.11.73.G07.1.454.CMB.2.raw
  modified_base (369)..(369): a, c, t, g, unknown or other
  modified_base (502)..(502): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagactctcctgtgcagcctctggatacatcttacaaaagtttcgaaatgagctgggtcccgccaggctccgtgggggaaggggccggagtggatttcatacatcagtagtagtggtaacaccttagtactntgacagactctggtagaacgggccgattcacatctcagagacaacgaccaagaattcacttggtttctagtacaaatgaaacagcctagagagacgaggataacggcttattacttagttgtgcgcgatcganaaggaaaagcgggttaggtccgttaaggttcggggg

SEQ ID NO: 412359 - DNA, 497 bp, Homo sapiens
  misc_feature: GZ8MTXP01EHRWF.11.73.G07.1.454.CMB.2.raw
  modified_base (268)..(268): a, c, t, g, unknown or other
  modified_base (362)..(362): a, c, t, g, unknown or other
  modified_base (388)..(388): a, c, t, g, unknown or other
  modified_base (406)..(406): a, c, t, g, unknown or other
  modified_base (466)..(466): a, c, t, g, unknown or other
  modified_base (483)..(483): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagatcaccatcacttgccaggcgagtcaggacattaagaactattaaatggtatcggcagcgacagggaaancccctgagctcctgatctacgatgcgtccaatttggaaacagacggtccccacgaggttcagtggaaagtggaatcgtgggacagtactttacnctcaccatcagcagctgcagctgaantattgacaacatattacngtacaatagtaatgtatcgtctctctaactttcggcccttgggacccaaggagttcgganaatagaaacgaactggnggtaacttgaaccc

SEQ ID NO: 412360 - DNA, 492 bp, Homo sapiens
  misc_feature: GZ8MTXP01BIUQA.11.73.G07.1.454.CMB.2.raw
  modified_base (362)..(362): a, c, t, g, unknown or other
  modified_base (478)..(478): a, c, t, g, unknown or other
tcagcgagagataccacgaccggtgctcgatttagctctacgctcaggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaatggtatcggcagcgacagggaaagcccctgagctcctgatctacgatgcgtccaatttggaaacagacggtcccccacgaggttcagtggaaagtggaatctgggacagactttacnctcaccatcagcagcctagcagcctgaagatattgcaactatattactgtcaacagtaatgaatcgtctcctctaatttcggccttgggaccagacgttggacaatgaacgtaacngttcggcttgaacc

SEQ ID NO: 412361 - DNA, 506 bp, Homo sapiens
  misc_feature: GZ8MTXP01DQW3M.11.73.G07.1.454.CMB.2.raw
  modified_base (307)..(307): a, c, t, g, unknown or other
  modified_base (422)..(422): a, c, t, g, unknown or other
  modified_base (478)..(478): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatggtatcgcagcgacaggaaagcccctgagctctgatctacgatgcgtacaatttggaaacngacggtcccccacgaggttcagtggaaagtggaatcgtagggacagtactttactctcacatcagcagcctgctagcctagaagtatattgacaactattaattactagtacaanagtatgtatcgtctcctaactaacttccggcccttagggacctagacgttggaacngtaagaaacgacgtgaggtcttcgaacc

SEQ ID NO: 412362 - DNA, 537 bp, Homo sapiens
  misc_feature: GZ8MTXP01CFXT7.11.73.G07.1.454.CMB.2.raw
  modified_base (313)..(313): a, c, t, g, unknown or other
  modified_base (374)..(374): a, c, t, g, unknown or other
tcagcgagagataccacgaccggtgctcgatttagctctacgctcaggggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcagtcaggacattaagaactatttaaatggtatcggcagcgaccagggaaacgcccctgagctctgatctacgatgcgtaccaatttggaaacngacggtccccccaccggaggttcaggtggaaagtgggaatcgtaggggacagtactttacnctcaccatcagcagcctgcagcctgaacgtatattgacaaatattattactgtacaacagtatgtatcgttctcctctaacgtttccgggcccttcggggaaccagggttacgttcgggactaagttacggaaaccgtagtgggttacggcgttcggtaaccc

SEQ ID NO: 412363 - DNA, 523 bp, Homo sapiens
  misc_feature: GZ8MTXP01DZ47Q.11.73.G07.1.454.CMB.2.raw
  modified_base (353)..(353): a, c, t, g, unknown or other
  modified_base (363)..(363): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggacggtccctgagactctcctgtgcagcctctggatacatcttcaaaagtttcgaaatgagctgggtccgccaggctccgtgggaaggggccggagtggatttcatacatcagtagtagtggtaacnccttgtactntgcagactctgtgaagggccattcacatctccagagacaacgccaagattcactggtttctgcaaatgaacagcctagagagacgaggataacggcttatttacttattgtgcgcgatcgaacgaagaaaaaggcgggttagggtcccgttgttcggggg

SEQ ID NO: 412364 - DNA, 557 bp, Homo sapiens
  misc_feature: GZ8MTXP01A3501.11.73.G07.1.454.CMB.2.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacattaagaactattaatggtatcggcagcgacaggaaacgcccctgacgctcctgatctacgatcgcgtaccaaagtttacggaaacacggacggtaccccccaaccggtaggttaccaagggtagggaaaagttgggaattcgtagggggaacctaggtaccttttactcttaccacccatcagcagccctggacacgcctagaagtatattcgactaactattatactgacccaatagtatgtatcgtcctcctctaacgtttccggcccttgggacctaggacgttggactaagtagaaaccgtacgtggttacggtcttggaaccc

SEQ ID NO: 412365 - DNA, 510 bp, Homo sapiens
  misc_feature: GZ8MTXP01EOHUW.11.73.G07.1.454.CMB.2.raw
  modified_base (369)..(369): a, c, t, g, unknown or other
  modified_base (422)..(422): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcagtcaggacattaagaactattaaatggtatcggcagcgacagggaaacgcccctgagctcctgatctacgatgcgtacaatttaggaaacagacggtcccccacggaggttcagtggaaagtgggaatcgtaggggacagtactttacnctcaccatcagcagccctagcagcctagaagatattgacaaactataattacngtacaacagtaatgtatcgtctcctcttaatttccggccttagggacctagagttggactaagtagaaacgtactgttgcgttgaacc

SEQ ID NO: 412366 - DNA, 513 bp, Homo sapiens
  misc_feature: GZ8MTXP01B6G9V.11.73.G07.1.454.CMB.2.raw
  modified_base (194)..(194): a, c, t, g, unknown or other
  modified_base (268)..(268): a, c, t, g, unknown or other
  modified_base (339)..(339): a, c, t, g, unknown or other
  modified_base (360)..(360): a, c, t, g, unknown or other
  modified_base (392)..(392): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaactattaaatggtatcggcagcgacaggaacncccctgagctctgatctacgatgcgtcaatttggaaacatacggtcccccacggagtcagtggaaagtggntcgtgggacagtacctttacnctcacctatcagcagcctgcagcctagaagtntaattcgactaaactattaacttactgtacaactagtatgtatccgtctcctaatacgtttccggccttgggaccgagttagttggactaagtacgaacgtacgtggttacgcgttgaacc

SEQ ID NO: 412367 - DNA, 497 bp, Homo sapiens
  misc_feature: GZ8MTXP01B24M7.11.73.G07.1.454.CMB.2.raw
  modified_base (193)..(193): a, c, t, g, unknown or other
  modified_base (251)..(251): a, c, t, g, unknown or other
  modified_base (264)..(264): a, c, t, g, unknown or other
  modified_base (303)..(303): a, c, t, g, unknown or other
  modified_base (354)..(354): a, c, t, g, unknown or other
  modified_base (411)..(411): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctatagganacagagtcaccatcacttgccaggcagtcaggacattaagaactattaatgtatcggnagcgacaggaacncccctgacgctctgatctacgatgcgtcaatttgaaacngacgtcccccacgagttcagtggaaagtgaatcgtgggacagtactttacnctacacatcagcagcctgcagcctagaagatattgacaactattattactgtacaanagtatgtatcgtctcctaactaacgtttccggcccttgggaccagaggttcgactaatacgaaacgactggttggccttggaaccc

SEQ ID NO: 412368 - DNA, 492 bp, Homo sapiens
  misc_feature: GZ8MTXP01B2QIW.11.73.G07.1.454.CMB.2.raw
  modified_base (345)..(345): a, c, t, g, unknown or other
  modified_base (364)..(364): a, c, t, g, unknown or other
  modified_base (398)..(398): a, c, t, g, unknown or other
  modified_base (415)..(415): a, c, t, g, unknown or other
  modified_base (433)..(433): a, c, t, g, unknown or other
  modified_base (480)..(480): a, c, t, g, unknown or other
  modified_base (483)..(483): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaatggtatcggcagcgaccagggaaagcccctgagcctcctgatctacgatgcgtccaatttggaaacagacgtccccaccggagttcagtggaaagtggntcgtgggacagactttacnctcacatcagcagctgcagcctagaagataattnataaactataattactntacaatagtatgtattcncttcctctaatttccggccttgggacctagacgttgacaatgaaacnagnggcttgaac

SEQ ID NO: 412369 - DNA, 484 bp, Homo sapiens
  misc_feature: GZ8MTXP01DTM44.11.73.G07.1.454.CMB.2.raw
  modified_base (268)..(268): a, c, t, g, unknown or other
  modified_base (309)..(309): a, c, t, g, unknown or other
  modified_base (337)..(337): a, c, t, g, unknown or other
  modified_base (355)..(355): a, c, t, g, unknown or other
  modified_base (448)..(448): a, c, t, g, unknown or other
tcagcgagagataccacgaccggtgctcgatttagctctacgctcaggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatggtatcggcagcgaccaggaaancccctgagctcctgatctacgatgcgtccaatttggaaacngacgtccccacgagttcagtgaaagtgntctgggacagactttacnctcaccatcagcagcctgcagcctgaagatattgcaacattatactgtacaacagtatgtatcgtctcctctaatttccggccttgggaaccngagttggacaatagaacgtaactgttggcttgaacc

SEQ ID NO: 412370 - DNA, 516 bp, Homo sapiens
  misc_feature: GZ8MTXP01EW3VB.11.73.G07.1.454.CMB.2.raw
  modified_base (340)..(340): a, c, t, g, unknown or other
  modified_base (359)..(359): a, c, t, g, unknown or other
  modified_base (385)..(385): a, c, t, g, unknown or other
  modified_base (406)..(406): a, c, t, g, unknown or other
  modified_base (414)..(414): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatggtatcggcagcgaccaggaaacgcccctgagctcctgatctacgatgcgtccaatttggaaacagacgtcccccacgagtcagtgaaagtggntctgggacagtactttacnctcacatcagcagctgcagctagaanatattgacaactatacttacngtacaacngtatgtatcgtctcctaactaacgtttccggcccttaggggaacccaggttaggttggaaccgaagttacgaaaacgtacgtggttcgggtaacttgaaccc

SEQ ID NO: 412371 - DNA, 485 bp, Homo sapiens
  misc_feature: GZ8MTXP01EMF4L.11.73.G07.1.454.CMB.2.raw
  modified_base (344)..(344): a, c, t, g, unknown or other
  modified_base (362)..(362): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaatggtatcggcagcgaccagggaaagcccctgagctcctgatctacgatgcgtccaatttggaaacagaggtcccccacgaggttcagtggaaagtggntctgggacagactttacnctcaccatcagcagccctgcagcctgaagatattgacaaactatattactgtacaacagtatgtatcgtctcttcaatttcggccttgggaccagagttggacaatgaacgactgttgcttgc

SEQ ID NO: 412372 - DNA, 540 bp, Homo sapiens
  misc_feature: GZ8MTXP01DC6FV.11.73.G07.1.454.CMB.2.raw
  modified_base (193)..(193): a, c, t, g, unknown or other
  modified_base (265)..(265): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctatagganacagatcaccatcacttgccaggcagtcaggacattaagaactattaaatgtatcggcagcgacgaggaacnccctgacgctctgatctacgatgacgtactaattacggaaacagacgtcccccacggtagttcgagtaggaaagtggaatcgtagggaactagtactttactctacacctatacagcagcctagctagcctagaatatatagactaataattacttactagtacaaatagttaactgtatccgttacctccttaactaacgtttcccggacccgttaggggaaaccctaggttacgttggactaagtagaaacgtacgtgttcggcttggaaccc

SEQ ID NO: 412373 - DNA, 528 bp, Homo sapiens
  misc_feature: GZ8MTXP01BX350.11.73.G07.1.454.CMB.2.raw
  modified_base (267)..(267): a, c, t, g, unknown or other
  modified_base (340)..(340): a, c, t, g, unknown or other
  modified_base (360)..(360): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcagtcagacattaagaactattaaatggtatcggcagcgacaggaaacncccctgagctcctgatctacgatgcgtccaatttggaaacagacggtcccccacgaggtcagtggaaagtggntcgtgggacagtactttacnctcacatcagcagcctgcagcctagaagatattgacaactatattactgtacaactagtatgtacttcgtcctccttaactaacgttttccggccccgttggggaacccaggttacggttgggaactaagttaggaaaaccgaacgttggttacgggccttggaaccc

SEQ ID NO: 412374 - DNA, 542 bp, Homo sapiens
  misc_feature: GZ8MTXP01BAXMZ.11.73.G07.1.454.CMB.2.raw
  modified_base (348)..(348): a, c, t, g, unknown or other
  modified_base (368)..(368): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatggtatcggcagcgacaggaacgcccctgacgctctgatctacgatcgcgtaccaagtttaggaaacagacggtccccccacggaggttcagtggaaagtggntcgtgggacagtactttacnctacacatcagcagcctgcagcctagaagatattgactaaactattacttactagtacaactagttatgtacttcgtccttcctctaacgtttccgggacccgttgggaaccctaggttacggttcgggacctaagttacggaaaacgtacgtggttacggtcgttcggaaccc

SEQ ID NO: 412375 - DNA, 536 bp, Homo sapiens
  misc_feature: GZ8MTXP01BEVL2.11.73.G07.1.454.CMB.2.raw
  modified_base (269)..(269): a, c, t, g, unknown or other
  modified_base (367)..(367): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatggtatcggcagcgacaggaaacncccctgagctcctgatctacgatgcgtaccaatttaggaaacagacggtcccccacggaggttcagtggaaagtggaatcgtgggacagtactttacnctcaccatcagcagcctgcagcctagaagatattgacaactattaattactgtacaaactagttaatgtaattccgtcctcctaactaacgttttccgggcccttaggggaccctaaggttacgttcgggaactaagtacgaaacgtacgtggttacggcttggaaccc

SEQ ID NO: 412376 - DNA, 557 bp, Homo sapiens
  misc_feature: GZ8MTXP01CPBQY.11.73.G07.1.454.CMB.2.raw
  modified_base (195)..(195): a, c, t, g, unknown or other
  modified_base (280)..(280): a, c, t, g, unknown or other
  modified_base (331)..(331): a, c, t, g, unknown or other
  modified_base (509)..(509): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatcctccctgtctgcatctatagganacagagtcaccatcacttgccaggcgagtcaaggactattaagaacttaatttaaatggtatcggcagacgaccgaagggaaacncccctgacgctccgtgactactacgatcgaccgtactaagtttaggaaacngacggtccccccacggtaggttcaggtaggaaagtggaatcgtagggaacagtacctttacgtctacacctatacagcacgcctgcagcgtagaagataagttcgacaaactattaattacgtataccaatagtatggtaactctactcctaacgtaacgtttccgccgttaggaccnggttacgttggaactaagtacggaaacgtcgtggcgtaacttcgaacc

SEQ ID NO: 412377 - DNA, 566 bp, Homo sapiens
  misc_feature: GZ8MTXP01DYJCR.11.73.G07.1.454.CMB.2.raw
  modified_base (255)..(255): a, c, t, g, unknown or other
  modified_base (267)..(267): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatggtatcggnagcgacaggaancccctgagctcctgatctacgatgcgtaccaatttaggaaacagacggtccccccaccggaggttcaggtggaaagtggaatcgtggggaactagtactttactctacaccatcagcagcctagcagcctagaagtatattgactaaactattaacttactagttacaaactagttatgtaacttccgttcttccttaactaaacgttttcccgggaccccgttaggggaacccgtaggttacggttcgggaacctaagttaacggaaaaccgtaacgtggttacgggcttcggaaccc

SEQ ID NO: 412378 - DNA, 493 bp, Homo sapiens
  misc_feature: GZ8MTXP01ES2QL.11.73.G07.1.454.CMB.2.raw
  modified_base (335)..(335): a, c, t, g, unknown or other
  modified_base (449)..(449): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatgtatcgcagcgacaggaaagcccctgagctctgatctacgatgcgtccaatttgaaacagacggtccccacgaggtcagtggaaagtgntcgtgggacagactttactctcaccatcagcagcctgctagcctagaagtatattgacaactatattactgtacaacagtatgtatcgtctcctctaattcggccttgggaccnggagttgggactaagtagaaacgacgtggttcggcttggaaccc

SEQ ID NO: 412379 - DNA, 609 bp, Homo sapiens
  misc_feature: GZ8MTXP01ELKQ9.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagctctcctgtgcagcctctggatacatcttacaaaagtttcgaaatgagcgtgggtcccgccgaggcctccggtagggggaacgggggccggtaggttggtatttcatacatcagtagtagtggtaactacctttagtactaagtcgactagtacttcgtagggtacggaaacgggtcccgtattaccaaccctacttcctaccgaagaacgaaaccaaaccgaccgaaacgtaacttactacttacgggtttctaggaactaaagtagaacacgctagagagacgaggagtaacggtattattacttagtgtcgcgcgacgtaacgaacaaggaaaacggtcggttacggtccgttaaggtttcggggg

SEQ ID NO: 412380 - DNA, 555 bp, Homo sapiens
  misc_feature: GZ8MTXP01AQZDU.11.73.G07.1.454.CMB.2.raw
  modified_base (194)..(194): a, c, t, g, unknown or other
  modified_base (262)..(262): a, c, t, g, unknown or other
  modified_base (373)..(373): a, c, t, g, unknown or other
  modified_base (394)..(394): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagatattaatgtatgcagcgacaggaacnccctgacgctcctgatctacgatcgcgtacctaagtttaggaaactacggacggtaccccccacggtaggttacaggtaggaaagtggaatcgtagggactagtacttacnctacacatcagcagctagcanctagaacgatatgacaatattattactagtaccaagtagtatggtaactcgttctccgttaactaacgtttcccggacccgttagggtaacccgagttacgggttcggaaccaagttaacggaaaaccgtaagtcggttacgggccttaacggtaaccccg

SEQ ID NO: 412381 - DNA, 723 bp, Homo sapiens
  misc_feature: GZ8MTXP01C8LX5.11.73.G07.1.454.CMB.2.raw
  modified_base (195)..(195): a, c, t, g, unknown or other
  modified_base (277)..(277): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccatcctcctgtctgcatctatagganacagagtcaccatcacttgccaggcgagtcaggacaattaagaacttaatttaaatggtatcggcagacgaacgaggaaacnccccgtagacgtcctacgtagtacttaccgtaacgacttcggtacccgttaaccgtaaaagttttaacgggaaaaccgtacggtaaccggtttaccccccccgaacgggttaacgggttttaccgaaagggttaggggaaaaacggttgggaacgttcgggtaacggggaaaccttaacggtttaacccttttaaccgtaccttaacccgaaaccctaagttaccgaaacggtccgaacggtccccgttaggacccgtaacgtacccgttaagaaacgtattaacgttagaacctaaattaattaactttaccgagttaacaaacgttgtaactcgtaacttccgtacctaccttaacgtaaaccgtttcggaccgttacggaacgtaacggttacgttaggaccgtaaagtacgtaaacgaacgtggttcgtcgttaacgtaacc

SEQ ID NO: 412382 - DNA, 596 bp, Homo sapiens
  misc_feature: GZ8MTXP01B6WBM.11.73.G07.1.454.CMB.2.raw
  modified_base (299)..(299): a, c, t, g, unknown or other
  modified_base (383)..(383): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactatttagaaggtgtccatgtggcgtgcacctagtggagtcgtgggggagcttggtacagcctggacgtccctgagactctcctgtgcagcctctggatacatcttactaaaagtttcgaaatgagcgtcgggtcccncgaggccgtccggtagggggaacgggggccggaggttggtatttcatacatcgaaggtagtagtagtaacctacgttagtactntgcagtactcgtgtaggacgggctattccactatcctacaagacgaacaacgaccaaagtaacttactacgttcggtttactagaacctaaagtacgaaacgacgccgtaggagtaaggacgaaggtataaccggtattaatttacttagttgtgcgcgagtaacgaaacgaaaggaaaacggtcgggttacggtcgttaacgggtttggggg

SEQ ID NO: 412383 - DNA, 499 bp, Homo sapiens
  misc_feature: GZ8MTXP01ATUIV.11.73.G07.1.454.CMB.2.raw
  modified_base (364)..(364): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacattaagaactattaaatggtatcggcagcgacaggaaagcccctgagctcctgatctacgatgcgtccaatttggaaacagacggtccccccacggaggttcagtggaaagtggaatcgtgggacagtactttacnctacaccatcagcagctgcagcctagagatattgacaactatattactgtacaacagtaatgtatcgtctcctctaacgtttccggccttgggaccagagttggacaagtagaaacgtactggacgtcttgaacc

SEQ ID NO: 412384 - DNA, 539 bp, Homo sapiens
  misc_feature: GZ8MTXP01D872Q.11.73.G07.1.454.CMB.2.raw
  modified_base (195)..(195): a, c, t, g, unknown or other
  modified_base (271)..(271): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctccctgtctgcatctatagganacagagtcaccatcacttgccaggcgagtcaggacattaagaactattaaatggtatcggcagcgacagggaaacncccctgacgctctgatctacgatcgcgtacctaaagtttggaaacagacggtacccccacggtaggtcaggtaggaaagtggaatcgtagggactagtactttactctcacatcagcagctgcagctagaatatattcgactaaactattaattactagtaacaaactagtatcgtacgttcctcctctaactaacgtttccgggcccgttacgggaccaaggaggttcgacctaagtacgaaacgtacgtggttacggtcttgaacc

SEQ ID NO: 412385 - DNA, 525 bp, Homo sapiens
  misc_feature: GZ8MTXP01BV7V6.11.73.G07.1.454.CMB.2.raw
  modified_base (194)..(194): a, c, t, g, unknown or other
  modified_base (270)..(270): a, c, t, g, unknown or other
  modified_base (352)..(352): a, c, t, g, unknown or other
  modified_base (372)..(372): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaactatttaaatggtatcggcagcgacagggaacncccctgagctcctgatctacgatcgcgtaccaagtttaggaaacaggacgtccccccacggtaggttcaggtggaaagtggntcgtgggacagtactttacnctacacatcagcagcctgcagcctagaagtatattcgacaactattattactagtacaactagtatgtatcgtctcctctaacgtttccggcccgttgggacctaggacggttcgactaagtacggaaacgtacgtggttacgtcgttgaacc

SEQ ID NO: 412386 - DNA, 537 bp, Homo sapiens
  misc_feature: GZ8MTXP01C2MZP.11.73.G07.1.454.CMB.2.raw
  modified_base (255)..(255): a, c, t, g, unknown or other
  modified_base (287)..(287): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacaataagaactattaaatggtatcggnagcgaaccgaggaaacgcccctgacgctcgtntatactacgatcgcgtacctaagttaggaaacaggacggtccccccacggtagttcgaggtaggaaagtggaactcgtagggactagtactttactctacacatcagcagcctgactacgactagaatattatagacaactaattacttacgatacaatagtatgtactccgtacctccttaactacgtttccggccgttgggaccaagagttcgaactaagtaacgaacgtaatggttaggcttcgaac

SEQ ID NO: 412387 - DNA, 570 bp, Homo sapiens
  misc_feature: GZ8MTXP01EYSTU.11.73.G07.1.454.CMB.2.raw
  modified_base (378)..(378): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagactctcctgtgcagcctctggatacatcttacaaaagtttcgaaatgagcgtcgggtcccgccaggcctccggtagggggaacgggggccggagtggtatttcatacatcagtagtagtaggtaacaccttagtactntgacagtactcgtggtggaaacgggccgtattccaccatctaccaagacgacaaccgaccaaagaacttacacttggtttctagacaaatcgaacacgcctagagagacggaaggataacggtcttatttacttagttgtgcgcgacgtaacgacgaagaaaacgcgggttacgtccgttaaggttcggggg

SEQ ID NO: 412388 - DNA, 498 bp, Homo sapiens
  misc_feature: GZ8MTXP01BGS01.11.73.G07.1.454.CMB.2.raw
  modified_base (260)..(260): a, c, t, g, unknown or other
  modified_base (299)..(299): a, c, t, g, unknown or other
  modified_base (345)..(345): a, c, t, g, unknown or other
  modified_base (406)..(406): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcagtcagacataagactattaatgtatcgcagcgacaggaanccctgagctcctgatctacgatgcgtcaatttggaaacngacgtccccacgagtcagtgaaagtgaatctgggacagtacttacnctcacatcagcagcctagcagcctagaagatattgacaaactattaattactataccaaanagtaatgtaatcgtctctctaaactttcggacccttggggaacctaggacgttggaacaatacggaaacgtacgttggacggtcttggaacc

SEQ ID NO: 412389 - DNA, 593 bp, Homo sapiens
  misc_feature: GZ8MTXP01E2J9E.11.73.G07.1.454.CMB.2.raw
  modified_base (286)..(286): a, c, t, g, unknown or other
  modified_base (414)..(414): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctccctgtctgcatctataggagacagagtcaccatcactgccaggcgagtcaaggactaattaaagaacttaatttaaagtggtaatcggacagacgaaccgaaggggaaacncccctagacgctcctagatactacgatcgacgtacctaaagtttaggaaaacacggacggtaccccccaaccggtaggttacgaggtagggaaaagtgggaatcgtaggggaactaggtacttttacnctacaccatcagcagcctgacagccgtagaagtatagttagaactaaactattaacttactagtacaaatagtatagtaacttcgtcctcctaactaacgtttccggccccgttaggggaacccaagggacgttgggaactaagtagtaaacgaacgtaggttggtaacgttgaacccg

SEQ ID NO: 412390 - DNA, 519 bp, Homo sapiens
  misc_feature: GZ8MTXP01BLSXP.11.73.G07.1.454.CMB.2.raw
  modified_base (194)..(194): a, c, t, g, unknown or other
  modified_base (251)..(251): a, c, t, g, unknown or other
  modified_base (266)..(266): a, c, t, g, unknown or other
  modified_base (307)..(307): a, c, t, g, unknown or other
  modified_base (338)..(338): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcagtcagacataagaactattaatggtatcggnagcgaccagggaaancccctgagctcctgatctacgatgcgtccaatttggaaacngacgtccccacgaggttcagtggaaagtggntcgtagggacagtactttactctacaccatcagcagcctgcagcctagaagatattgactaactattatactgtcaactagtatgtatcgtctcctctaactttccgggaccttggggaaccctaggacgttcgggaacaagttacggaaacgtaacgtggttacgggtccttcggaaccc

SEQ ID NO: 412391 - DNA, 575 bp, Homo sapiens
  misc_feature: GZ8MTXP01D0WKJ.11.73.G07.1.454.CMB.2.raw
  modified_base (282)..(282): a, c, t, g, unknown or other
  modified_base (287)..(287): a, c, t, g, unknown or other
  modified_base (328)..(328): a, c, t, g, unknown or other
  modified_base (368)..(368): a, c, t, g, unknown or other
  modified_base (393)..(393): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctccctgtctgcatctataggagacagatcaccatcactgccaggcgagtcaaggactaattaaagtaacttaatttaaagtggtatcggcagaccgacgaagggaaacnccccngacgctctgatctacgatcgacgtactaagttacggaaacnggacgtacccccgacgtaggttacgaggtaggaaagtggngtcgtaggggactacgtactttacnctacacatcagcacgctagcagctagaatatagtcaactaaactattaattacgtataaccaatagttaatcgtaattccttcctccttaacttaacgtttcccgggaccgttacgggaaaccgtaggttacggttggaactaaggtaacgtaaaccggtaagtggacggtcttcggaaccc

SEQ ID NO: 412392 - DNA, 518 bp, Homo sapiens
  misc_feature: GZ8MTXP01B3N1U.11.73.G07.1.454.CMB.2.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcagacattaagaactattaaatgtatcggcagcgaccagggaaacgcccctgacgctcctgactctacgatgcgtacctaatttggaaacaggacggtccccccacggtaggttcaggtggaaagtggaatcgtgggacagtactttactctcaccatcagcagcctgcagcctagaagattattagacaaactattaattactgtacaactagtatgtatcgtctcctctaacgtttccggccttgggaccagacggttcggacaagtagaacgtactggttcggtcttgaacc

SEQ ID NO: 412393 - DNA, 565 bp, Homo sapiens
  misc_feature: GZ8MTXP01BVTWL.11.73.G07.1.454.CMB.2.raw
  modified_base (365)..(365): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacgtccctgagactctcctgtgcagcctctggatacatcttacaaaagtttcgaaatgagctgggtccgcaggctccgtgggaagggggccgagtggatttcatacatcagtagtagtaggtaactccttagtactntgcagactcgtggtagaacgggccgtattcaccatctacagacgaacaacgaccaagaacttactacttggtttctagacaaatacgaacacgaccgtagagagacggaaggagtaacggtacttagtttaacttagtttagtgttcggcgactaacgacgaaggaaaacggcgggttacggtccgttaaggttcggggg

SEQ ID NO: 412394 - DNA, 513 bp, Homo sapiens
  misc_feature: GZ8MTXP01A6DFJ.11.73.G07.1.454.CMB.2.raw
  modified_base (267)..(267): a, c, t, g, unknown or other
  modified_base (355)..(355): a, c, t, g, unknown or other
  modified_base (376)..(376): a, c, t, g, unknown or other
  modified_base (405)..(405): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaatggtatcggcagcgacaggaacncccctgagctcctgatctacgatgcgtacctaagtttaggaaacaggtacggtaccccccaccggtaggttcgaggtggaaaagtggntcgtagggactagtacttacnctacacatcagcagctagcagcctagaanatatgacaactatatactgtacaatagtatgtatctactctctaacgttcggccgttggacctagagttcggaacaagtacgaaacgtactggttcggtcttgaaccc

SEQ ID NO: 412395 - DNA, 563 bp, Homo sapiens
  misc_feature: GZ8MTXP01EL19K.11.73.G07.1.454.CMB.2.raw
  modified_base (272)..(272): a, c, t, g, unknown or other
  modified_base (376)..(376): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaatggtatcggcagcgaccagggaaacncccctgagcctctgatctacgatgcgtccaaatttggaaacagacggtcccccaccggaggttcagtgggaaaagtgggaatcgtggggacagtaccttttacnctacaccatcaagcagcctaggcagcctagaagatattcgactaaatattaattactagtaccaaagtagttaaatcggtaacttcgttccttcctaactaacgttttcccgggcccgttaggggaaccctaggacgttgggaactaagtaggaaaaccgagtaggttcgggtaaccttggtaaccc

SEQ ID NO: 412396 - DNA, 550 bp, Homo sapiens
  misc_feature: GZ8MTXP01ATPQL.11.73.G07.1.454.CMB.2.raw
  modified_base (194)..(194): a, c, t, g, unknown or other
  modified_base (352)..(352): a, c, t, g, unknown or other
  modified_base (373)..(373): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcacatcacttgccaggcgagtcagacataagaactattaatgtatcgcagcgacaggaacgcccctgacgctcctgactctacgatgcgttaccaagtttaggaaactaggacggtacccccaccggtaggttacgaggtaggaaagtggntcgtagggacagtactttacnctcaccatcagcagcctgcagcctagaagtatattagactaaactattaacttactgtaaccaatagtaattgtacttcgtccttcctaacttaacgtttccgggcccgttacgggaacctaggttacggttcggacctaagtacggtaaacgtacgtgggacgtcgttcgtaaccc

SEQ ID NO: 412397 - DNA, 577 bp, Homo sapiens
  misc_feature: GZ8MTXP01DPN6D.11.73.G07.1.454.CMB.2.raw
  modified_base (256)..(256): a, c, t, g, unknown or other
  modified_base (272)..(272): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggactaattaagaactattaaatggtatcgnagcgaacgaggaaacnccctagacgctctgactctacgatcgacgtacctaaagtttacggaaaacaggtaccggtaccccccgaaccggtaggttaccgaaggtagggaaaacggttggaacgtcggtaggggaactaagtacctttactctacaccatcgagcagcctgacagcctagaagtatattgacaaactattaattactagtacaaagtagtaactgtactcgtctcctaacgtacgtttcccggccgttacgggaacctaggttacggttcgaactaagtaacggaaacgtacgtggttacggcttcgaacc

SEQ ID NO: 412398 - DNA, 565 bp, Homo sapiens
  misc_feature: GZ8MTXP01CN90U.11.73.G07.1.454.CMB.2.raw
  modified_base (194)..(194): a, c, t, g, unknown or other
  modified_base (386)..(386): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaacttaattaatggtatcggcagcgacaggaacgcccctgacgctcctgactctacgatcgacgtacctaaagtttacggaaacagaccggtccccccaaccggtaggttcaggtaggaaacgtggaatcgtagggactagtacttactcncacatcagcagctgcagcctagaagattagttgactaactattattactagtacaaacgtagttactgtacttccgttcttccctaacgtaacgtttccgggcccttaggggaacccaggttacggttgggttacctaagtaacggaaacgtaacgttgggttacggtcttcggaaccc

SEQ ID NO: 412399 - DNA, 538 bp, Homo sapiens
  misc_feature: GZ8MTXP01CBZ5D.11.73.G07.1.454.CMB.2.raw
  modified_base (263)..(263): a, c, t, g, unknown or other
  modified_base (281)..(281): a, c, t, g, unknown or other
  modified_base (361)..(361): a, c, t, g, unknown or other
  modified_base (397)..(397): a, c, t, g, unknown or other
  modified_base (478)..(478): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcagtcagacattaagaactattaatgtatcggcagcgacaggaancccctgagctcctgactntacgatgcgtccaaatttggaaacagacggtcccccacggagttcagtggaaagtggaatctaggggacagtactttacnctcaccatcagcagctgcagcctagaagatagttanacaactacttattactgttacaaacgtagttatgtaactcgtactccgtaactaatttccgggacccttgggggtaaaccnggttacggttcgaacgtaagtaacggtaaacgtacggtcggttacggtaacgttcgaacc

SEQ ID NO: 412400 - DNA, 530 bp, Homo sapiens
  misc_feature: GZ8MTXP01ANRTE.11.73.G07.1.454.CMB.2.raw
  modified_base (359)..(359): a, c, t, g, unknown or other
  modified_base (369)..(369): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagactctcctgtgcagcctctggatacatcttacaaaagtttcgaaatgagctgggtccgccaggctccgtgggggaacgggggccggagtggatttcatacatcagtagtagtggtaacnccttgtactntgcagctctgtgaacgggcgatcacatctcagacgacaacgaccaagaatcacttggttctgacaaatgaacagctagagagacgaggataacggcttatttacttagttgtgcgcgataacgacaagaaaacggtcggacggtccgttaaggttcggggg

SEQ ID NO: 412401 - DNA, 609 bp, Homo sapiens
  misc_feature: GZ8MTXP01A3JZY.11.73.G07.1.454.CMB.2.raw
  modified_base (388)..(388): a, c, t, g, unknown or other
  modified_base (422)..(422): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacgtcctgagactctcctgtgcagcctctggatacatcttacaaaagtttcgaaatgagcgtcgggtcccgcagggcctccggtagggggaacgggggccggagttggtatttcgaatacattcgaggtaggtagtacggtaactaccgtttagtaactntgcagactcgtggtagaacgggccctattcaccntcctacgaagacgaacaacgacaagtaactcgacttggttctgaaccaaagtcgaacgacgcctaggaagtaacggaacggaaggtaactaacgggtctttagtttaacttagttggtcgttacgcgacgtaacgaacgaaaggaaaacggtcgggttacgggtaacccgttaagggtttccggggg

SEQ ID NO: 412402 - DNA, 591 bp, Homo sapiens
  misc_feature: GZ8MTXP01CWSTM.11.73.G07.1.454.CMB.2.raw
  modified_base (193)..(193): a, c, t, g, unknown or other
  modified_base (271)..(271): a, c, t, g, unknown or other
  modified_base (290)..(290): a, c, t, g, unknown or other
  modified_base (315)..(315): a, c, t, g, unknown or other
  modified_base (356)..(356): a, c, t, g, unknown or other
  modified_base (381)..(381): a, c, t, g, unknown or other
  modified_base (416)..(416): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctatagganacagatcaccatcactgccaggcagtcaggactattaaagaacttattaaagtggtatcggcagcgaacgagggaacnccctgagctctgatctagntcgacgtactaagtttacggaaacngtacggtccccccacggtaggttcaaggtggtaaaagtggngtcgtaggggactagtacctttacnctacacctatcgagcacgcctagcagctagaagtnttaagtcaactaaactatttaacttaccgtagtaacaaacgtaggttaactcgtaacttccgtccttacccttaacgtaaaccgttttcccgggaacccgttggggaaaccctgggttaacgttcggaaactaagtaaacgtaacgtaacgtggttacggtaacttcggtaaccc

SEQ ID NO: 412403 - DNA, 542 bp, Homo sapiens
  misc_feature: GZ8MTXP01C9DO1.11.73.G07.1.454.CMB.2.raw
  modified_base (266)..(266): a, c, t, g, unknown or other
  modified_base (273)..(273): a, c, t, g, unknown or other
  modified_base (287)..(287): a, c, t, g, unknown or other
  modified_base (306)..(306): a, c, t, g, unknown or other
  modified_base (338)..(338): a, c, t, g, unknown or other
  modified_base (358)..(358): a, c, t, g, unknown or other
  modified_base (388)..(388): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcagtcaggacataagaactattaaatgtatcggcagcgacagggaacnccctganctcctgatctacgntgctacaatttaggaaacngacggtcccccacggagttcagtggaaagtgntcgtgggactagactttacnctacaccatcagcagcctgcagcctagaanatatgactaactattaattactagtacaacaggttaactgtacttccgtccttcccttaactaacgtttccgggacccgttggggaaccctaggttacggttggaacctaagttaacggaaaccgtaaggttggttacgggtcttaaggaaccc

SEQ ID NO: 412404 - DNA, 569 bp, Homo sapiens
  misc_feature: GZ8MTXP01EPTID.11.73.G07.1.454.CMB.2.raw
  modified_base (262)..(262): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagatcaccatcactgccaggcgagtcagacataagaactattaatgtatcggcagcgacagggaacncccctgacgctcctgatactacgatcgcgtacctaagtttaggaaacaggacggtcccccaccggtaggttacgaggtaggaaagtgggaatcgtagggactagtactttactctacaccatcagcagcctgacagcctagaacgtatagttcgactaaactattaattactagtacaaactagtaatgtacttcgtccttcctaactaacgtttccgggacccgttacggggaccctaagggttagttcgggaaactaagtaacggaaaacggtaacggtggttacgggtccgttaacggtaaccc

SEQ ID NO: 412405 - DNA, 554 bp, Homo sapiens
  misc_feature: GZ8MTXP01AJVO9.11.73.G07.1.454.CMB.2.raw
  modified_base (194)..(194): a, c, t, g, unknown or other
  modified_base (272)..(272): a, c, t, g, unknown or other
  modified_base (387)..(387): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctatcaggtgccagatgtgacatccagttgacccagtctccatcctccctgtctgcatctatagganacagagtcaccatcacttgccaggcgagtcaggacattaagaactatttaaatggtatcggcagcgaacagggaaacncccctagacgctcctgactctacgatcgcgtacctaagtttaggaaacaggacggtaccccccacggtaggttacaggtggaaaagtgggaatcgtaggggactagtactttacnctacactatcagcagcctgcagcctagaagtatattgacaactattaattactagtacaaactagttatgtacttccgtctcctaactaacgtttccgggccccttaggggaccctaggacggttcggaactaagtacgaaacgtacgtggttacggccttgaaccc

SEQ ID NO: 412406 - DNA, 536 bp, Homo sapiens
  misc_feature: GZ8MTXP01CDQD1.11.73.G07.1.454.CMB.2.raw
  modified_base (299)..(299): a, c, t, g, unknown or other
  modified_base (337)..(337): a, c, t, g, unknown or other
  modified_base (353)..(353): a, c, t, g, unknown or other
  modified_base (362)..(362): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtcactgtggcgtgcacctagtggagtctgggggagcttggtacagcctggacggtccctgagactctcctgtgcagcctctggatacatcttacaaaagtttcgaaatcccgagctgggtccnccaggctcgtagggggagggccgagtggatttcatacntcagtatagtgtaacncttagactngcagactcgtgtgaacgggcgtattcacatctcagagacaacgacaagaatcattggttctagacaaatagaacacgacctaggagtaggacgaggagtaacggacttatttacttagttgtgacgcgatcgaactaaggaaaagtcggttaggtaaccgttaaggttcggggg

SEQ ID NO: 412407 - DNA, 522 bp, Homo sapiens
  misc_feature: GZ8MTXP01DRU2K.11.73.G07.1.454.CMB.2.raw
  modified_base (356)..(356): a, c, t, g, unknown or other
  modified_base (480)..(480): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaaggacaattaaagaacttaatttaaatggtatcggcagcgaccagggaaacgcccctgacgctctgatctacgatgcgtactaatttaggaaacaggacggtcccccacggaggttcagtaggaaagtggntcgtagggacagtactttactctacacatcagcacgcctagcagcctagaacgtatattgacaactattaattactagtacaatagtatgtatacgtctcctctaacttcggccgttgggaccngaggttgactaagtagaaacgtacgtgttacggcttcgaacc

SEQ ID NO: 412408 - DNA, 553 bp, Homo sapiens
  misc_feature: GZ8MTXP01EXEAJ.11.73.G07.1.454.CMB.2.raw
  modified_base (195)..(195): a, c, t, g, unknown or other
  modified_base (255)..(255): a, c, t, g, unknown or other
  modified_base (270)..(270): a, c, t, g, unknown or other
  modified_base (493)..(493): a, c, t, g, unknown or other
tcagcgagagataccacgaccggtgctcgatttagctctacgctcaggggggcaggagtcagtcccaaccaggacacagcatggacatgagggtccctgctcagctcctggggctcctgctgctctgtctctcaggtgccagatgtgacatccagttgacccagtctccatccctcctgtctgcatctatagganacagagtcaccatcacttgccgaggcgagtcaggacattaagaactattaatgtatcggnagcgacgagggaacncccctgacgctctgatactacgatcgcgtacctaagtttaggaaacacggacggtcccccacggtaggttcaggtaggaaacgtggaatcgtaggggacagtactttactctacaccatcagcgacgcctgacacgcctagaagtaattattagactaaacttattaacttacgtatacaactagtaatgtattccttcctctaactaacgtttccggaccgngggtaccaggttaggttcggactaagtaacgaacgtaacgtgggttcgtcgttgtaaccc

SEQ ID NO: 412409 - DNA, 546 bp, Homo sapiens
  misc_feature: GZ8MTXP01ER75I.11.73.G07.1.454.CMB.2.raw
  modified_base (196)..(196): a, c, t, g, unknown or other
  modified_base (256)..(256): a, c, t, g, unknown or other
  modified_base (349)..(349): a, c, t, g, unknown or other
  modified_base (370)..(370): a, c, t, g, unknown or other
tcagcgagagataccacgaccggtgctcgatttagctctacgctcaggggggcaggagtcagtcccaaccaggacacagcatggacatgagggtccctgctcagctcctggggctcctgctgctctgtctctcaggtgccagatgtgacatccagttgacccagtctccatccctccctgtctgcatctatagganacagagtcaccatcacttgccaggcgagtcagacattaagaactattaaatggtatcggnagcgacaggaaacgcccctgagctctgatctacgatgcgtacctaatttaggaaacagacggtcccccaccggaggttcgagtggaaagtggntcgtagggacagtactttacnctacaccatcagcagcctagcagcctagaagatatgacaactattattactagtacaactagtatgtatcgtcttcctcttaacgtttccggcccgttagggacccgtaaggacggttcgggaaactaaggtaacggaaaacgtaacggttggttacggtaaccgttcggtaaccc

SEQ ID NO: 412410 - DNA, 505 bp, Homo sapiens
  misc_feature: GZ8MTXP01ASCUF.11.73.G07.1.454.CMB.2.raw
  modified_base (311)..(311): a, c, t, g, unknown or other
  modified_base (363)..(363): a, c, t, g, unknown or other
  modified_base (392)..(392): a, c, t, g, unknown or other
  modified_base (421)..(421): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatggtatcggcagcgaccagggaaagcccctgagctcctgatctacgatgcgtccaatttggaaacngacggtcccccacgaggttcagtggaaagtggaatctgggacagactttacnctcaccatcagcagcctgcagcctgaagntattgacaacattatactgtcaacagtangtatcgtctcctctaacgtttcggcccttggggacccaggacgttggacctaagtagaaacgtaacgtgttagggcttggaacc

SEQ ID NO: 412411 - DNA, 566 bp, Homo sapiens
  misc_feature: GZ8MTXP01AT6MB.11.73.G07.1.454.CMB.2.raw
  modified_base (265)..(265): a, c, t, g, unknown or other
  modified_base (363)..(363): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagatcaccatcacttgccaggcagtcaggacattaagaactattaatgtatcggcagcgacgagggaacncccctgacgctcctgactctacgatgtacgtacctaaagtttaggaaacacggacggtaccccccaccggtaggttaccgaggtcgggaaaagtgggnttcggtaggggtaactacggtacttttactcttaccaaccctatcaacgcaacggcctagcacgcctagaagattattcgactaactattattactagtaccaatagtatgattcgtctcctaactaacgtttccggacccgttgggaacctaggacgttcgggaactaagtacgaaacgtaacgtggacggtcttcggaacc

SEQ ID NO: 412412 - DNA, 563 bp, Homo sapiens
  misc_feature: GZ8MTXP01CFX2Q.11.73.G07.1.454.CMB.2.raw
  modified_base (364)..(364): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaggtgtccatgtggcgtgcacctagtggagtcgtgggggagcttggtacagcctggacggtccctgagctctcctgtgcagcctctggatacatcttacaaaagtttcgaaatgagtctgggtcccgcaggctccgtaggggagggggccggagtggatttcatacatcagtagtagtgtaacacttagtactntgacagtactcgtgtagaacgggccgtattcacctatcctacccaagaacgaaccgaaccgaccaaacgtaacttactacttggtttctagacaaatacgaacagcctagagagacgaggataacggtcttattacttagttgtcgcgttcgacgtaacgacgaagaaaaggtcgggttagtccgttaaggtttcgggg

SEQ ID NO: 412413 - DNA, 558 bp, Homo sapiens
  misc_feature: GZ8MTXP01AGTSQ.11.73.G07.1.454.CMB.2.raw
  modified_base (373)..(373): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaatgtatcggcagcgacgagggaaacgcccctgacgctcctgatctacgatgcgtactaagtttaggaaacaggacgtcccccacggaggttacaggtggaaagtggaatcgtagggactagtactttacnctacaccatcagcagcctagcagcctagaacgtatattcgactaactattattactagtacaaacgtagttatgtacttcgtccttccttcgtaacgtttcccgggacccgttacggggaaccctaggttacggttcgggaacctaagttacggaaacgtaacgtggttacgggcttcggaaccc

SEQ ID NO: 412414 - DNA, 599 bp, Homo sapiens
  misc_feature: GZ8MTXP01ET2UL.11.73.G07.1.454.CMB.2.raw
  modified_base (296)..(296): a, c, t, g, unknown or other
  modified_base (553)..(553): a, c, t, g, unknown or other
tcagcgagagataccacgaccggtgctcgatttagctctacgctcaggggatatcagagaggtgccttagccctggattccaaggcatttccacttggtgatcagcactgaacacagaggactcaccatggagttggggctgtgctgggtgctccttgttactattttagaggtgtccactgtggcgtgcacctagtggagtcgtgggggagcttggtacagcctggacggtccctgagctctcctgtgcagcctctgatacatcttacaaaagtttcgaaatgagcgtgggtccnccgaggcctccggtagggggaacgggggccggaagttggattttcgaattacgatcgaaggttagttagtaggtaaacctccgtttaagtaactaagtcgactagacttcgtaggtggaaacgggcgtattcacactctaccaagacgacaacgaccaaagtaacttactacttggtttactagaactaaagtagaaacacgacctaggagaagacggaggtaataacggtacttatttacgttagttgtgttacgngacgtcgaagaagaaaacggcgggttagtccgttaaggtttggggg

SEQ ID NO: 412415 - DNA, 643 bp, Homo sapiens
  misc_feature: GZ8MTXP01EQR5A.11.73.G07.1.454.CMB.2.raw
  modified_base (261)..(261): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatccctccctgtctgcatctataggagacagatcaccatcactgccaggcagtcagacattaagaatattaatgtatgcagcgacaggaacnccctgagctcctgatctagatcgcgtactaaagtttacggaaacacggacgtaccccccgaaccggtaggttacgaggtagggaaaagtgggtaacgttcgtagggggtaacctaggttaaccttttactaccttacccaacctattaccacgcaacggtccctacgaccgtacgtcccgttaagaaacgtacttaatttacggaactaaaacttaattaactttaactacgtaacaaactagttaagtgtaacttccgttaccttcccgttaactaacgttttccggaccccgttagggaaccctaagggttacgttacggggaacctaaggttaacgaaaaccggttaacgtcgggttacgggtaacctttcggaacccc

SEQ ID NO: 412416 - DNA, 524 bp, Homo sapiens
  misc_feature: GZ8MTXP01AXZRC.11.73.G07.1.454.CMB.2.raw
  modified_base (267)..(267): a, c, t, g, unknown or other
  modified_base (307)..(307): a, c, t, g, unknown or other
  modified_base (344)..(344): a, c, t, g, unknown or other
  modified_base (369)..(369): a, c, t, g, unknown or other
  modified_base (425)..(425): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagatcaccatcacttgcccaggcagtcaggacattaagaactattaaatggtatcggcagcgaccaggaaancccctgagctctgatctacgatgcgtacaatttggaaacnggacgtacccccacggaggttcaggtcggaaagtggngtcgtaggggactacgtactttacnctccacatacagcagcctgacagcctagaacgtatattgactaaactatacttacngtacaacagtatgtatcgtctctaactaagttccggccttagggaccagggttagttcggactaagtaggaaacgtaacgtggttacggtcttcgaacc

SEQ ID NO: 412417 - DNA, 632 bp, Homo sapiens
  misc_feature: GZ8MTXP01DVA6A.11.73.G07.1.454.CMB.2.raw
  modified_base (261)..(261): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctaggtggagtcgtggggggagcttgggtacagcctggacggtccctgagactctcctgtgcagcctnggatacatcttacaaaagtttcgaaatgagcgtgggtcccgcaggcctccggtagggggaacgggggccggagtggatttcatacatcagtaggtagtggtaactaccttagtactaatgacaagtactcgtaggtagggaaacgggtcccgtattccaacctatcctaccaagacgaacaacgaccaaagtaacttcacttggtttctagactaaagtgaaacacgtccgtaagaggtaacggacggtaagggtaacgtaacgtacttttaaacgtttacgttagttcggtcgttacggacgttaacggaaccgaaaagtaaacggtaaacgggtcgggttacggtaaccggtttaaggggtttcggggg

SEQ ID NO: 412418 - DNA, 553 bp, Homo sapiens
  misc_feature: GZ8MTXP01EM0HT.11.73.G07.1.454.CMB.2.raw
  modified_base (389)..(389): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcagtcagacattaagaactattaatgtatcggcagcgacagggaaacgcccctagagctcctgatctacgatcgacgtaccaaagtttaggaaacaggtacggtaccccccaccggtaggttacgaggtagggaaaacgtggaagtcgtaggggaactacgtacctttacnctacaccatcagcacgctagcagccgtagaaagtatagttagacctaaatattaacttactgtacaatagtatgtataccgtcctccgtaactaacgtttccggcccgttagggacctaaggagttggacctaagtacgaaacgtacgtggacgtcttgaaccc

SEQ ID NO: 412419 - DNA, 601 bp, Homo sapiens
  misc_feature: GZ8MTXP01CV0P9.11.73.G07.1.454.CMB.2.raw
  modified_base (250)..(250): a, c, t, g, unknown or other
  modified_base (264)..(264): a, c, t, g, unknown or other
  modified_base (311)..(311): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccatcctccctgtctgcatctataggagacagatcaccatcactgccaggcagtcagacattaagaatattaatgtatcggnagcgacgaggaacnccctgacgctctgactctacgatcgacgtactaagtttaggaaaacnggtacggtacccccgacggtagggttcgaaggtagggaaaagtggaattcgtagggtaacagtacctttactctaccacctatcaagccaacggccctaggacctagaccgtagtaaagattattacgaactaaactaatttaatacttacgtaacctaaagtagtaaatgtaacttccgtccttcccttaacgttaacgttcccgggtaccccgttaggggaacccgtaggttacggttagaacctaaggtaacgtaaaacggtacgtggttacgtcgttaacgtaacc

SEQ ID NO: 412420 - DNA, 521 bp, Homo sapiens
  misc_feature: GZ8MTXP01CUQE8.11.73.G07.1.454.CMB.2.raw
  modified_base (194)..(194): a, c, t, g, unknown or other
  modified_base (254)..(254): a, c, t, g, unknown or other
  modified_base (267)..(267): a, c, t, g, unknown or other
  modified_base (370)..(370): a, c, t, g, unknown or other
  modified_base (379)..(379): a, c, t, g, unknown or other
  modified_base (384)..(384): a, c, t, g, unknown or other
  modified_base (491)..(491): a, c, t, g, unknown or other
  modified_base (498)..(498): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcagggtgccagatgtgacatccagttgacccagtctccatcctcctgtctgcatctatagganacagagtcaccatcacttgccaggcagtcaaggacattaaagaactattaaatgtatcgnagcgacaggaacnccctgagctctagacactacgatgacgtacctaattacgaaacaggacgtacccccacggaggttcagtggaaagttgaatcgtagggactacgtactttacnctcacctanacgancagctagacagactaagaagtatatacaactaaactattactacgtagtaacaagtagtatcgtactcctcctctaactaacgttccggacgttaggacgtagacgngactaanagtaacgagtagttcgtcgcgtc

SEQ ID NO: 412421 - DNA, 565 bp, Homo sapiens
  misc_feature: GZ8MTXP01DX98H.11.73.G07.1.454.CMB.2.raw
  modified_base (195)..(195): a, c, t, g, unknown or other
tcagcgagagataccacgaccggtgctcgatttagctctacgctcaggggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagatcaccatcacttgccaggcgagtcaggactattaagaactaatttaaatggtatcggacagcgacgagggaaacgcccctagacgctcctgactctacgatcgacgtacctaaagtttacggaaacacggtacggtaccccccacggtaggtttcgaaggtagggaaaaggttgggaatcgtaggggaactagtacctttactctacacctatcacgcacgcctaggcagcctagaagtatatacgactaactattattactgtaacaatagtatgtactccgtctcctaactaacgtttccggaccgttggaacctggacgttggactaagtaacgaaacgtacgtggttacgtcgttcgaacc

SEQ ID NO: 412422 - DNA, 505 bp, Homo sapiens
  misc_feature: GZ8MTXP01BP2VQ.11.73.G07.1.454.CMB.2.raw
tcagcgagagataccacgaccggtgctcgatttagctctacgctcagggggcaggagtcagtcccaaccaggacacagcatggacatgagggtccctgctcagctcctggggctcctgctactctgtctctcaggtgccagatgtgacatccagttgacccagtctccatcctccctgtctgcatctataggagacagagtcaccatcacttgccaggcgagtcaggacattaagaactattaaattggatcggcagcgaccagggaaacgcccctgagctcctgatctacgatgcgtccaatttggaaacagacgtccaccgaggttcaggtggaagtggatcgtgggacagactttactctcaccatcagcagcctgacagcctagaagactattgacaacgtatattactgtacaacagtatgactcgtcctcctctaatttccggcccgtgggaccaggagttacgggcagtaagaaacgaacgtggcggctcgctaaccc

SEQ ID NO: 412423 - DNA, 518 bp, Homo sapiens
  misc_feature: GZ8MTXP01AW9AP.11.73.G07.1.454.CMB.2.raw
  modified_base (263)..(263): a, c, t, g, unknown or other
  modified_base (373)..(373): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcagacattaagactattaatggtatcggcagcgacaggaanccctgagctctgatctacgatgacgtcctaatttacggaaacagacggttaccccccaaccggtaggtttacaggtggaaaacgtggaatcgtagggacagtactttacnctcaccatacagcagcctgcagctgaagtatattgacaactatattactagtacaactagtactagtatcgtctctaactaacgtttccgaccgttgggaccaggagttcggacaatagaaacgacgtggttacggcttggaacc

SEQ ID NO: 412424 - DNA, 553 bp, Homo sapiens
  misc_feature: GZ8MTXP01DEXCT.11.73.G07.1.454.CMB.2.raw
  modified_base (296)..(296): a, c, t, g, unknown or other
  modified_base (534)..(534): a, c, t, g, unknown or other
tcagcgagagataccacgaccggtgctcgatttagctctacgctcaggggatctcagagaggtgccttagccctggattccaaggcattttccacttggtgatcagcactgaacacagaggactcaccatggagttgggctgtgctgggtgctccttgttactattttagaaggtgtccatgtggcgtgcactagtggagtcgtgggggagcgtggtccagccgtgggagtccctgagacctctcctgtacagcctctggcttcaccttcattacctatggcatgcactgggtccnccagactccgagggcgagggggctgggagtgggtgctagttatttcatatgataaggaaatgtgtacttcgtattcagtactcccgtagtaacggccgtattccgaccttcgtacccgagaacgacaaacttccaaggcaacacgggcttgtaatcgtagaccaaagttagaaacctagccgtagacgtgctaggaggaccaggcttgttagttattacgttgtagtaacgtaaagtntttataagttaagtaaggg

SEQ ID NO: 412425 - DNA, 699 bp, Homo sapiens
  misc_feature: GZ8MTXP01ESFYR.11.73.G07.1.454.CMB.2.raw
  modified_base (194)..(194): a, c, t, g, unknown or other
  modified_base (300)..(300): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgaccagtctccatcctccctgtctgcatctatagganacagagtcacatcacttgcgaggcgagtcgaggactaagttaaagtaactttaatttaaagtggtaacgtcggacgaacgaccggaaaccgaacggggaaaccccncccgtagaccgtcctacgtagtacttacgtacgtacgtaccggtaccgttaacgtaaagttaacggaaaacgtaccgggtaaccgtacccccgtaacgggtacggttacggtaagggtaggtaaacggttacggtaacgtacggtaacgggtaacttaacgttacctttacctacctaacctactacgtacgacgacgacgtcgtacgacgtacgtacgtaagtaaactattacgtacaactaacttaattacttaacgtacgtaaacaagtagttactcgttacgttaccgtccttaccttaacgttaaccgttcccgggaccgttacgggaacgtaaggttacggttagaaccgtaaggaacgtaaacgtcggtcggttacgtaacgttcgtaaccg

SEQ ID NO: 412426 - DNA, 572 bp, Homo sapiens
  misc_feature: GZ8MTXP01EEUM1.11.73.G07.1.454.CMB.2.raw
  modified_base (280)..(280): a, c, t, g, unknown or other
  modified_base (371)..(371): a, c, t, g, unknown or other
  modified_base (394)..(394): a, c, t, g, unknown or other
tcagcgagagataccacgaccggtgctcgatttagctctacgctcaggggggcaggagtcagtcccaaccaggacacagcatggacatgagggtccctgctcagctcctggggctcctgctgctctgtctctcaggtgccagatgtgacatccagttgacccagtctccatccctccctgtctgcatctagtaggagacagagtcaccatcacttgccaggcgagtcaaggactaattaagaacttaatttaaagtggtatcggcagcgacgagggaacnccctagacgctctgactctacgtatcgtacgtactaagttaggaaacgtaggaccggtaccccccacggtagtacgaggtaggaaagtggngtcgtagggactagtactttacnctacactatcgagcacgctagccagccgtagaaagtattacttagaactaaactatttaacttacgtagtacaaatagttatgtacttcgttcctcctaacttaacgtttccggaccgttagggaccaggttaggttgaaacgaagtaacgaaacggtcgtggttacgtcttgaaccc

SEQ ID NO: 412427 - DNA, 535 bp, Homo sapiens
  misc_feature: GZ8MTXP01EK9YH.11.73.G07.1.454.CMB.2.raw
  modified_base (194)..(194): a, c, t, g, unknown or other
  modified_base (252)..(252): a, c, t, g, unknown or other
  modified_base (264)..(264): a, c, t, g, unknown or other
  modified_base (359)..(359): a, c, t, g, unknown or other
  modified_base (374)..(374): a, c, t, g, unknown or other
  modified_base (390)..(390): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcagacattaagaactattaatgtatcggnagcgacaggaanccctgagctctgatctacgatgcgtccaatttcggaaacagacgtcccccacggagttcagtggaaaagtgaagtcgtagggacagtactttacnctacaccatcagcanctagctagcctagaanatattcgactaacagttattactagaacaactagtatgtactcgtctcctaacgtaactttccgggcccgttagggaccctaaggttaggttcggaactaagttacggaaaaccgtaagtcggttacggtccgttaagtaacccc

SEQ ID NO: 412428 - DNA, 570 bp, Homo sapiens
  misc_feature: GZ8MTXP01AOTBM.11.73.G07.1.454.CMB.2.raw
  modified_base (359)..(359): a, c, t, g, unknown or other
  modified_base (369)..(369): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttgggtacagcctggacggtccctgagactctcctgtgcagcctctggatacatcttacaaaagtttcgaaatgagcgtgggtccgcaggcctccgtaggggacggggccggagtggtatttcatacatcagtagtagtgtaacncttagtactntgcagtactcgtgtaggaacgggccgtattcacctactctaccaagacgaacaaccgaccaaagtaacttactacttcggtttactgaactaaagtacgaacagacctagagagacgaggagtaacggtcttatttacttagttgtgttcgcgactaacgagaacgaaaagtcgggttacggtccgttaagggtttcgggg

SEQ ID NO: 412429 - DNA, 571 bp, Homo sapiens
  misc_feature: GZ8MTXP01DLPEW.11.73.G07.1.454.CMB.2.raw
  modified_base (298)..(298): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagactctcctgtgcagcctctggatacatcttacaaaagtttcgaaatgagctgggtccncaggctccgtggggaagggccggagtggatttcatacatcagtagtagtggtaactaccgttagtactaagtgacagtactcgtggtaggaaacgggccgtattccacctatcctccagacgaacaacgaccaaagaattcacttggtttctagacaaatacgaacagacctagagagacgaggagtaacggtcttaatttacttagtttaggtgcgcgacgtaacgaacgaaaggaaaacggcgggttacggtaaccgttaaggttcggggg

SEQ ID NO: 412430 - DNA, 556 bp, Homo sapiens
  misc_feature: GZ8MTXP01CNKHW.11.73.G07.1.454.CMB.2.raw
  modified_base (194)..(194): a, c, t, g, unknown or other
  modified_base (251)..(251): a, c, t, g, unknown or other
  modified_base (264)..(264): a, c, t, g, unknown or other
  modified_base (305)..(305): a, c, t, g, unknown or other
  modified_base (340)..(340): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcagtcagacattaagaactattaatggtatcgnagcgacaggaacnccctgagctctgatctacgatgctaccaatttacggaaacngacgtcccccacggtagttcgaggtaggaaagtgngtcgtgggacagtacttactctcaccatcagcagcctgaccagcccgaagtactattgaactaacgtattaattactgtaacaaacgtagtatacgtacttccgtcctaccttactaaacgtttccggcccgttaggggaccctaagggcgttacggacttaacgttaacggaaaaccgtaaccgttggtacgggaccttaacggcccgttaaccg

SEQ ID NO: 412431 - DNA, 596 bp, Homo sapiens
  misc_feature: GZ8MTXP01CCE2W.11.73.G07.1.454.CMB.2.raw
  modified_base (383)..(383): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccatgtggcgtgcacctagtggagtcgtgggggagcttggtacagcctggacggtccctgagactctcctgtgcagcctctggatacatcttacaaaagtttcgaaatggagcgtgggtcccgccagggcctccggtagggggaacgggggccggaggttggtatttcatacatcaggttagtagtggtaacctaccttagtactngacagtactcgtaggtaggaacgggccgtacttacacctactcctaccgaagacgaacaaccgaccaaagtaacttactacgttggtttactagaactaaagtagaaacacgactagagaggacgaggagtaacggtcttaatttacttagttgtcgcgcgacgtaacgaacgaaaggaaaacggtcggttacggtccgttggttaacggggg

SEQ ID NO: 412432 - DNA, 548 bp, Homo sapiens
  misc_feature: GZ8MTXP01BI7W1.11.73.G07.1.454.CMB.2.raw
  modified_base (269)..(269): a, c, t, g, unknown or other
  modified_base (345)..(345): a, c, t, g, unknown or other
  modified_base (366)..(366): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatggtatcggcagcgacagggaaancccctgagctcctgatctacgatgcgtaccaatttggaaacagacggtcccccacggaggttcagtggaaagtggntcgtgggactagtactttacnctcacatcagcagctgcagcctagaacgatattagactaactattaacttactgtacaaactagtatgtacttccgtctccctctaaacgttttcccgggacccgttaggggaccctagggttacggttgggaacctaagttacggaaaaccgtaacgttcggttacgggtcttcggaaccc

SEQ ID NO: 412433 - DNA, 534 bp, Homo sapiens
  misc_feature: GZ8MTXP01EAK5O.11.73.G07.1.454.CMB.2.raw
  modified_base (295)..(295): a, c, t, g, unknown or other
  modified_base (347)..(347): a, c, t, g, unknown or other
  modified_base (357)..(357): a, c, t, g, unknown or other
  modified_base (366)..(366): a, c, t, g, unknown or other
  modified_base (394)..(394): a, c, t, g, unknown or other
  modified_base (433)..(433): a, c, t, g, unknown or other
  modified_base (440)..(440): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcactagtggagtctgggggagcttggtacagcctggacggtcctgagactctcctgtgcagcctctggatacatcttacaaaagtttcgaaatgagctgggtccncaggctcgtgggaagggcgagtggatttcatacatcagtagtagtggtaacnccttagactntgctagctntggtgacgggctattcacatctcaaganaacacgaccaaagaacttcacgtttgttctagaactaanacgaacncgacgtaggagaagacgagagtaacgtcttatttacttagttgtcgacgcgagtcgaaagaaggaaacgcggttcggtaacgttaaggttgggg

SEQ ID NO: 412434 - DNA, 527 bp, Homo sapiens
  misc_feature: GZ8MTXP01DMJUF.11.73.G07.1.454.CMB.2.raw
  modified_base (298)..(298): a, c, t, g, unknown or other
  modified_base (355)..(355): a, c, t, g, unknown or other
  modified_base (365)..(365): a, c, t, g, unknown or other
  modified_base (484)..(484): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagactctcctgtgcagcctctggatacatcttacaaaagtttcgaaatgagctgggtccncaggctccgtggggaaggggccggagtggatttcatacatcagtagtagtggtaacnccttagactntgcagactcgtgtgaacgggcgattcacatctccagagacaacgcaagaattacacttgtttctgacaaatgaacagcctagagagacgaggataacggcttattacttagttgtgcgngatcgaacaagaaaaggcggttacgtccgttaaggttcggggg

SEQ ID NO: 412435 - DNA, 507 bp, Homo sapiens
  misc_feature: GZ8MTXP01AG9YZ.11.73.G07.1.454.CMB.2.raw
  modified_base (368)..(368): a, c, t, g, unknown or other
  modified_base (432)..(432): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatggtatcggcagcgacgagggaaacgcccctgagctcctgatctacgatgcgtacaatttaggaaacagacggtcccccaccggaggtcagtggaaagtggaatcgtgggacagtactttacnctacaccatcagcagcctagcagctagaagtatattgacaatactattactgtacaatagtacngtactcgtctctctaacgttccggccttgggaccagagttcggactaagtacgaaacgactggttagcttgaacc

SEQ ID NO: 412436 - DNA, 531 bp, Homo sapiens
  misc_feature: GZ8MTXP01C32QT.11.73.G07.1.454.CMB.2.raw
  modified_base (194)..(194): a, c, t, g, unknown or other
  modified_base (248)..(248): a, c, t, g, unknown or other
  modified_base (260)..(260): a, c, t, g, unknown or other
  modified_base (299)..(299): a, c, t, g, unknown or other
  modified_base (328)..(328): a, c, t, g, unknown or other
  modified_base (346)..(346): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcagtcagacataagaatattaatgtatcgnagcgacaggaanccctgagctctgatctagatgcgtactaattaggaaacngacgtccccacggagttcagtgaaagtgntgtgggacagtacttacnctcacatcagcagcctagccagacctgaaatattatagacaaactaattaacttactgtaacaaatagtaatgtaattccgtctaccctcgtaaacgtttcccgggacccttaggggaaccctagggaacggttggaaacctaaggttaaacgaaaccgtaagttggaccgtaacgttcgaaccc

SEQ ID NO: 412437 - DNA, 705 bp, Homo sapiens
  misc_feature: GZ8MTXP01BTLNV.11.73.G07.1.454.CMB.2.raw
  modified_base (193)..(193): a, c, t, g, unknown or other
  modified_base (276)..(276): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctatagganacagatcacatcacttgccaggcagtcaggacaattaaagaacttatttaaagtggtatcggcagacgaaccgaagggaaacncccctagacgcctccgtagactacgtacgatcgacgttaccaaagtttacggaaaacacgacggttaccccccaacgggtaggtttcgaaggtggaaaaaggtggaattcgtaggggaactacggttaacctttactacttaccaacctagtaccaacgccgaacgtcccgttacgaccgaacgtacccgtaaggaaaacgttattaaatttacggaaaccctaaaactttaagtttaaaccttttaacccggtaagttaacccaaaaagtacggtttaaaactggtaaccgttaacccgtttccttacccctttaacgttaaaccggtttttccccggggacccgtttacgggggaaacccctaggaaggttcggaaaccttaaggtaacggaaaaccgtaagtccgggttaggcccgttaacgaacc

SEQ ID NO: 412438 - DNA, 736 bp, Homo sapiens
  misc_feature: GZ8MTXP01C7T5M.11.73.G07.1.454.CMB.2.raw
  modified_base (200)..(200): a, c, t, g, unknown or other
  modified_base (480)..(480): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccactccctccctgtctgcatctaagtagganacagacgtacaccatcacttgccgaggcgagtcgaaggtaactaattaaacgtaaactttaaagtttaaagtggtaagtcggacacggaccggaaaccgaaggggaaaccgccccgtaggacgtcctccgtagtacttacgtacgtagtacgtacgttaaccgtaaagtttacggaaaaccgtcggtaacccggttacccccccgaacgggtaggtttacgaagggttagggaaaaggtgggtaacgttacggtacggggaaactacgttaacctttacncctaaccacctatacgacgcacgtcctaggacacggtacctaagaaacgtattacgtacgaaacctaaattaacttaacgtttaactacgtaaacctaacgttaagttaacgttgtaccgtttaccgtcccttaccgttaaccgttaaccggttttccccggggacccgttaacggggtaaaccgtaaggttaacggttcgaaacgtaaggttaaaccgaaacgttacgtgggttacggtaaccttcgtaaccccg

SEQ ID NO: 412439 - DNA, 577 bp, Homo sapiens
  misc_feature: GZ8MTXP01DXM2W.11.73.G07.1.454.CMB.2.raw
  modified_base (196)..(196): a, c, t, g, unknown or other
  modified_base (292)..(292): a, c, t, g, unknown or other
  modified_base (432)..(432): a, c, t, g, unknown or other
  modified_base (449)..(449): a, c, t, g, unknown or other
  modified_base (466)..(466): a, c, t, g, unknown or other
  modified_base (471)..(471): a, c, t, g, unknown or other
  modified_base (486)..(486): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccactcctccctgtctgcatctatagganacagactcaccatcacttgaccgaggcgagtcaaggactaattaaagtaacttaatttaaagtggtatcggacaaggacgaaccgaagggaaaccnccccgtagacgtcctaccgtagtaacttcgtacgagttcgtaccgttacctaaagtttacggaaaacgcggaccgtaccccccgaccggtaggttacgaggttaggaaacgtggtcgtcgtagggactacgtactttacnctacacatcgacgcacnctagctacgctagaatntagtnactaatattactacntaacatagtatgtactcgtctctaatacgttccggccttaggacctagttaggttcgacaagtacgaacgacgtggcgtcgttaacgaacc

SEQ ID NO: 412440 - DNA, 572 bp, Homo sapiens
  misc_feature: GZ8MTXP01CEDFR.11.73.G07.1.454.CMB.2.raw
  modified_base (269)..(269): a, c, t, g, unknown or other
  modified_base (358)..(358): a, c, t, g, unknown or other
  modified_base (380)..(380): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggactattaagaacttattaatggtatcggcagcgacaggaacnccctgagctcctgactctacgatcgcgtacctaaatttacggaaacaggacggtaccccccacgggtaggttcgaggtaggaaagtggntcgtagggactagtactttacnctacaccatcagcagcctgcagcctagaagtattattacgactaaactatttaacttactgaacctaaagtagttactgtacttccgttcttcccgtaactaacgtttcccggacccgttaggggacctaggttacggttcggaactaacggtacgtaaaaccgggtatcggggttacgtcgttcggaaccc

SEQ ID NO: 412441 - DNA, 561 bp, Homo sapiens
  misc_feature: GZ8MTXP01CTXKI.11.73.G07.1.454.CMB.2.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacattaagaactattaaatggtatcggcagcgaccagggaaagcccctgagctcctgactcacgatgtcgtacctaagtttacggaaacaggtacggtaccccccgaccggtaggttcaaggtgggaaaaggttggaatcgtaggggactaggtactttactcacctacatcagcagcctgcacgcctagaacgatattgacaactagttattactagtacaactagtatgtatccgtctcctcgtaacgtttccggcccgttcgggaaccgtaggttacggttgttacgtaagtacggtaaaacgaacgttcggttacgggtccttcgtaaccc

SEQ ID NO: 412442 - DNA, 557 bp, Homo sapiens
  misc_feature: GZ8MTXP01B6NOX.11.73.G07.1.454.CMB.2.raw
  modified_base (253)..(253): a, c, t, g, unknown or other
  modified_base (267)..(267): a, c, t, g, unknown or other
  modified_base (355)..(355): a, c, t, g, unknown or other
  modified_base (372)..(372): a, c, t, g, unknown or other
  modified_base (382)..(382): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacattaagaactattaatggtatcggnagcgacagggaacnccctgagctcctgatctacgatgacgtcctaaagtttaggaaacaggacggtccccccaacggaggttcaggtggaaagtggaatcgngggacagtacttttacnctacactacncgacgcacgccgtagacgtacgacgtaagaatatacgtacaacgtaaacttaatttacttacgtacgtaactaagtagtactcgtacttccgtacctcgttaacgttacggttccggccgttaggacgaggttacgttcgactaagacgtaacgtcgtggttcgtcgttcgaacc

SEQ ID NO: 412443 - DNA, 590 bp, Homo sapiens
  misc_feature: GZ8MTXP01EJYJZ.11.73.G07.1.454.CMB.2.raw
  modified_base (299)..(299): a, c, t, g, unknown or other
  modified_base (374)..(374): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagctctcctgtgcagcctctggatacatcttacaaaagtttcgaaatggagcgtgggtccnccaggcctccggtagggggacggggccgagtggtatttcatacatcgagtagtagtagtaactccgttagtactntgacagtactcgttggtaggaacgggccgtattaccacctactcctaccaacggaacgaaccgaaccgacccaaagtaacttacctactttcgggtttactagtaactaaagtagaacacgctagagagacgagagtaacgtcttattacttagttgtgcgcgacgtcgaacgaaaggaaaaggcgggttacggtaaccgttaagggtttcggggg

SEQ ID NO: 412444 - DNA, 565 bp, Homo sapiens
  misc_feature: GZ8MTXP01EJMAK.11.73.G07.1.454.CMB.2.raw
  modified_base (194)..(194): a, c, t, g, unknown or other
  modified_base (253)..(253): a, c, t, g, unknown or other
  modified_base (267)..(267): a, c, t, g, unknown or other
  modified_base (354)..(354): a, c, t, g, unknown or other
  modified_base (376)..(376): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctcctgtctgcatctatagganacagagtcaccatcacttgccaggcgagtcaggacattaagaactattaatgtatcggnagcgacgaggaacnccctgacgctcctgatcgtacgatcgcgtacctaagtttacggaaacagacggtaccccccacggtaggttcaggtaggaaagtggntcgtagggactagtactttacnctacacatcacgcacgctagacagctagaatatagttacgactaaactattaacttactagtaaccaagtaggttatgtacgttccgtccttccgtaacttaacgtttcccgggacccgttagggaccctaaggttacggttcgaacctaagtaacggaaacgtacgtggttacgtcgttaacgaaccc

SEQ ID NO: 412445 - DNA, 649 bp, Homo sapiens
  misc_feature: GZ8MTXP01BWWJF.11.73.G07.1.454.CMB.2.raw
  modified_base (286)..(286): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccatccctccctgtctgcatctataggagacagagtcaccatcacttgccaggcgagtcaaggactaattaagtaacttaatttaaagtggtatcggcaggccgaccgaagggaaacnccccgtagacgtcctcctagtactacgtacgagtcgaccgttacctaagtttaacggaaaacgacggtaccggtacccccccgaccgggtaggttacgaagggtagggtaaaaggttgggtaacgttcggtaggggaacctacggttaaccttttactacttaccaacctagtaccaagtcgaacgtccctaggaccacgtccgtaggaaatattaagttacgactaaactattattaacgtgtaactaactagttatagtcttaccgtccttaccttaacgtaacgtttcccggacccgttagggaacctaggacgttcggaacctaagtacggaaaccgtagtggttacggtcgttgaacc

SEQ ID NO: 412446 - DNA, 587 bp, Homo sapiens
  misc_feature: GZ8MTXP01A1PNC.11.73.G07.1.454.CMB.2.raw
  modified_base (193)..(193): a, c, t, g, unknown or other
  modified_base (265)..(265): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctatagganacagagtcaccatcacttgccaggcagtcagacattaagaactattaatggtatcggcagcgacagggaacncccctgagctctgatctacgatcgcgtacctaagtttaggaaacagacggtaccccccgaccggtaggttcaggtacggaaaggttgggaacgttcgtagggggactacggtacttttacctcttaccacctattacacgcacgcctgccagacctagaagtatagttagactaactattattactagtacaactagttactgtacttccgtccttcctcgttaaacgtttcccgggacccgttcggggaaccctagggttacggttcggacctaagtaacggtaaacgtaaccgtgggttacggtccgttcggtaaccccg

SEQ ID NO: 412447 - DNA, 579 bp, Homo sapiens
  misc_feature: GZ8MTXP01B06OT.11.73.G07.1.454.CMB.2.raw
  modified_base (200)..(200): a, c, t, g, unknown or other
  modified_base (276)..(276): a, c, t, g, unknown or other
  modified_base (327)..(327): a, c, t, g, unknown or other
  modified_base (394)..(394): a, c, t, g, unknown or other
  modified_base (474)..(474): a, c, t, g, unknown or other
tcagcgagagataccacgaccggtgctcgatttagctctacgctcaggggggcaggagtcagtcccaaccaggacacagcatggacatgagggtccctgctcagctccgtggggctcctgctgctctgtctctcaggtgccagatgtgacatccagttcgacccagtcctccactccctccctgtctgcatctagagganacagatcacatcactgcaggcgagtcagactaataagtaacttattaagtggtatcgacacgacgaacgaggaacncccagacgctcgtgtactacgtacgatcgtacgtactaagttacggaaacnggaccgtacccccgacggtaggtacgagggtaggaaagtggcgtcggagggacctaagttacttacnctacactagcaagcacgctagacacgcgtaagaatatatagaacctaaatacgtttaatacgtagtaacaagtagttacngtaccttacctccttcctaacgttaacggtttcccgggaccgttaggacgtaggttacgttacgaactaaggaacgtaaacgtcgtgggacgtaaccttgaaccc

SEQ ID NO: 412448 - DNA, 535 bp, Homo sapiens
  misc_feature: GZ8MTXP01ARAUJ.11.73.G07.1.454.CMB.2.raw
  modified_base (195)..(195): a, c, t, g, unknown or other
  modified_base (359)..(359): a, c, t, g, unknown or other
  modified_base (379)..(379): a, c, t, g, unknown or other
tcagcgagagataccacgaccggtgctcgatttagctctacgctcaggggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaacttattaaatggtatcggcagcgaccgagggaacgcccctgacgctcctgatctacgatcgcgtacctaagtttaggaaacaggacggtcccccaccggtaggttcaggtaggaagtgggntcgtgggacagtactttacnctacacccatcagcagctgctagcctagagtatattcgactaactataacttactagtacaaacagtatgtactcgtctcctctaactttccggacccttgggaaccaggttagttcgggacaatacggaaacgtacgtggttcgtcgttaacgcc

SEQ ID NO: 412449 - DNA, 505 bp, Homo sapiens
  misc_feature: GZ8MTXP01BOESJ.11.73.G07.1.454.CMB.2.raw
  modified_base (338)..(338): a, c, t, g, unknown or other
  modified_base (348)..(348): a, c, t, g, unknown or other
  modified_base (358)..(358): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcagacattaagaactattaatggtatcggcagcgaccagggaagcccctgacgctcctgatctacgatgcgtaccaatttggaaacagacgtccccacgaggtcagtggaaagtgntcgtgggacngtactttacnctcaccatcagcagccagcagccgtagaacgtatattgactaaacattaattactagtcaaactagtatgtatcgtcctcctctaacttccgggcccgttgggaccctaggcgttcggactaagacgaacgatggttgcgttgaacc

SEQ ID NO: 412450 - DNA, 567 bp, Homo sapiens
  misc_feature: GZ8MTXP01BZ2O7.11.73.G07.1.454.CMB.2.raw
  modified_base (195)..(195): a, c, t, g, unknown or other
  modified_base (250)..(250): a, c, t, g, unknown or other
  modified_base (264)..(264): a, c, t, g, unknown or other
  modified_base (280)..(280): a, c, t, g, unknown or other
  modified_base (409)..(409): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatcctccctgtctgcatctatagganacagatcaccatcattgccaggcagtcagacattaagaattattaaatgatcggnagcgacgaggaacncccctgacgctccgtnatcacgatcgcgtacctaagttaggaaacaggacgtcccccaccggtagttcgaggtggaaaacgtggaacgtcgtacggggaactacgtactttactctacaccatcagctagctaggcacgctaganattatacactaactattacttaacgtcgtaccaaagtggttaactggtaaccttcgttcctcctaacgtttaacgtttccgggaccccgttaggggaaaccctaggacggttccgaagaacgttaaggaaaccgtagtggttacgtccttcgtaaccc

SEQ ID NO: 412451 - DNA, 502 bp, Homo sapiens
  misc_feature: GZ8MTXP01AQWTO.11.73.G07.1.454.CMB.2.raw
  modified_base (192)..(192): a, c, t, g, unknown or other
  modified_base (267)..(267): a, c, t, g, unknown or other
  modified_base (339)..(339): a, c, t, g, unknown or other
tcagcgagagataccacgaccggtgctcgatttagctctacgctcaggggcaggagtcagtcccaaccaggacacagcatggacatgagggtccctgctcagctcctggggctcctgctgctctgtctctcaggtgccagatgtgacatccagttgacccagtctccatcctcctgtctgcatctatagganacagagtcaccatcacttgccaggcagtcaggacattaagaactattaaatggtatcggcagcgaccagggaaancccctgacgctcctgatctacgatgcgtccaatttggaaacagagtccccacgaggttcagtggaaagtggntcgtagggacagactttactctcaccatcagcagctgcagcctagaagatattgacaactatacttactgtacaacagtatgtatcgtctcctctaagtttccggcccttgggacccagacggttggaccaagtagaaaccgatggttacggtcttggaaccc

SEQ ID NO: 412452 - DNA, 739 bp, Homo sapiens
  misc_feature: GZ8MTXP01C90C3.11.73.G07.1.454.CMB.2.raw
  modified_base (194)..(194): a, c, t, g, unknown or other
  modified_base (241)..(241): a, c, t, g, unknown or other
  modified_base (265)..(265): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatcctcctgtctgcatctatagganacagatcaccatcactgccaggcgagtcagacataagaactattaangtatcggcagacgacgaaggaacnccccgtgacgtctccgtagactacgtacgatcgaccgttaaccgtaaagtttaacggaaaacgacggtaaccggtacccccccgtaaccgggtaggtttacgaaagggtagggtaaaaggtgggtaagtccggtaaggggaactaacggttacctttaacctccttaccgaacctaactaccgaacgaccgtaaccgtcccgtacggaccgaaaccggtaaccccgggaaagtaagttaacgtttacgaaaccctaaaacgttaagtttaaacgtttaacctaggtaaacccgtaaaacttaacgggttaattaacggtaaccttccggttacccttaacccttaacgttaaacccgttttaacccgggccccggttaacggggttaacccgaaggttaacgggttaagaaccgttaagttaaccgggaaaaacgtaaccgttgggaccggttaccgttcgaaccgttaacccg

SEQ ID NO: 412453 - DNA, 537 bp, Homo sapiens
  misc_feature: GZ8MTXP01CZWFV.11.73.G07.1.454.CMB.2.raw
  modified_base (194)..(194): a, c, t, g, unknown or other
  modified_base (270)..(270): a, c, t, g, unknown or other
  modified_base (315)..(315): a, c, t, g, unknown or other
  modified_base (374)..(374): a, c, t, g, unknown or other
tcagcgagagataccacgaccggtgctcgatttagctctacgctcaaggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaactattaaatggtatcggcagcgacagggaaacncccctgagctctgactctacgatgcgtacctaagtttaggaaacngacggtccccccacggaggttcaggtggaaagtggaatcgtagggactagtactttacnctacacatcagcagctagcagcctagaacgatattacgactaactattacttactagttacaacgtagttatgtactcgtccttcctaactaacgtttccgggcccttgggaacctggttacgttcggactaagtacgaacgtacgtgttcggtcttcgaacc

SEQ ID NO: 412454 - DNA, 518 bp, Homo sapiens
  misc_feature: GZ8MTXP01D9S3E.11.73.G07.1.454.CMB.2.raw
  modified_base (246)..(246): a, c, t, g, unknown or other
  modified_base (259)..(259): a, c, t, g, unknown or other
  modified_base (438)..(438): a, c, t, g, unknown or other
  modified_base (496)..(496): a, c, t, g, unknown or other
  modified_base (509)..(509): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcacatcacttgccaggcagtcagacataagatattaatgtatcggnagcgacaggaacnccctgacgctctgatctacgatcgcggtacctaagtttacggaaacacggacggtaccccccaaccggtaggtttcgaaggtggaaaagttgggaatcgtaggggactagtactttactctacaccagtcagcacgctagcagcctagaacgtatattcgactaactattacgttactntacaatagtatgattcgtctcctaataacgttcgcccgttaggaccagagttcgaaanaagtaagaacgtntgctcgcgc

SEQ ID NO: 412455 - DNA, 616 bp, Homo sapiens
  misc_feature: GZ8MTXP01B2LAB.11.73.G07.1.454.CMB.2.raw
  modified_base (370)..(370): a, c, t, g, unknown or other
  modified_base (381)..(381): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagtcttggtacagccgtggacgtccctgagactctcctgtgcagcctctggatacatcttacaaaagtttcgaaatgagcgtgggtcccgccgaggcctccggtagggggaacgggggccggagtggtatttcatacatcgagttagtagtcggtaacncgttgtaactntgcagtactcgtggtaggaacgggcctattccactatcctaccaagacgaacaacgacctaaagtaacttctaacgttggtttactacggtaactaaacgtacgaaacctacggtaccgtaggaacggtagaaccggaggtaacgtaacggtactttagtttacttagttcggtcgcgacgactaacgaacgaaaggtaaaacggcgggttacggtccgttaagggtttcggggg

SEQ ID NO: 412456 - DNA, 539 bp, Homo sapiens
  misc_feature: GZ8MTXP01D5XO8.11.73.G07.1.454.CMB.2.raw
  modified_base (297)..(297): a, c, t, g, unknown or other
  modified_base (332)..(332): a, c, t, g, unknown or other
  modified_base (349)..(349): a, c, t, g, unknown or other
  modified_base (357)..(357): a, c, t, g, unknown or other
  modified_base (487)..(487): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggacggtccctgagactctcctgtgcagcctctggatacatcttacaaaagtttcgaaatgagctgggtccncaggctcgtggggaagggccgagtgatttcatacntcagtagtagtgtaacncttgactntgcagactcgtggtgaacgggcgtattcacatctaccaagacgacaacgaccaaagaacttactaacttgtttctagacaaatgaacacgtcagagagagaggataacgtcttattacttagttgtgcgngactcgaactaaggaaaacggcgggttacggtcgttaagggtttaacggggg

SEQ ID NO: 412457 - DNA, 525 bp, Homo sapiens
  misc_feature: GZ8MTXP01DGZ67.11.73.G07.1.454.CMB.2.raw
  modified_base (196)..(196): a, c, t, g, unknown or other
  modified_base (271)..(271): a, c, t, g, unknown or other
  modified_base (295)..(295): a, c, t, g, unknown or other
  modified_base (380)..(380): a, c, t, g, unknown or other
  modified_base (409)..(409): a, c, t, g, unknown or other
  modified_base (422)..(422): a, c, t, g, unknown or other
  modified_base (510)..(510): a, c, t, g, unknown or other
tcagcgagagataccacgaccggtgctcgatttagctctacgctcaggggggcaggagtcagtcccaaccaggacacagcatggacatgagggtccctgctcagctcctggggctcctgctgctctgtctctcaggtgccagatgtgacatccagttcgacccagtctccatcctccctgtctgcatctatagganacagagtcaccatcacttgccaggcgagtcaggactataagaattattaaatgtatcggcagcgaacgaggaacncccctgacgctcctgactctacgntcggtcgtactaagttaggaaacaggacggtacccccacggtaggttcaggtggaaagtggaatcgtagggatacgtactttacnctacaccatcagcagcctgcagcagaatntattgactaaacnttaactactagtacaatagtatcgtattccgtctccgtaactaagtttccggccttagggaccaggagttgaactaataagaaacgtntggttcgcttcgaac

SEQ ID NO: 412458 - DNA, 518 bp, Homo sapiens
  misc_feature: GZ8MTXP01CG1OV.11.73.G07.1.454.CMB.2.raw
  modified_base (197)..(197): a, c, t, g, unknown or other
  modified_base (251)..(251): a, c, t, g, unknown or other
  modified_base (265)..(265): a, c, t, g, unknown or other
  modified_base (277)..(277): a, c, t, g, unknown or other
  modified_base (307)..(307): a, c, t, g, unknown or other
  modified_base (366)..(366): a, c, t, g, unknown or other
  modified_base (373)..(373): a, c, t, g, unknown or other
tcagcgagagataccacgaccggtgctcgatttagctctacgctcaggggggcaggagtcagtcccaaccaggacacagcatggacatgagggtccctgctcagctcctggggctcctgctgctctgtctctcaggtgccagatgtgacatccagttcgacccagtctccatcctccctgtcctgcatctatagganacagagtcacatcactgccaggcgagtcaggacattaagaatattaatgatcgnagacgacaggaacnccctgacgctcngatcacgatcgactactaattacggaaacnggacgtacccccacggtagttcaggtaggaaagtggaatcgtagggacagtactttacncacacancagcacgtcagacacgctaagaatatatacgaacgtaaattattaacttacgtactaacaagtagtatgtactctactctaacgtacgttccggacgaggacgtagacgttcgaactaagacgtaacgtcgtcggactcgttcgc

SEQ ID NO: 412459 - DNA, 539 bp, Homo sapiens
  misc_feature: GZ8MTXP01D3XMP.11.73.G07.1.454.CMB.2.raw
  modified_base (375)..(375): a, c, t, g, unknown or other
  modified_base (445)..(445): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcactagtggagtcgtgggggagcttggtacagcctggacggtccctgagactctcctgtgcagcctctggatacatcttacaaaaagtttcgaaatgagcgtgggtcccgccagggcctccgtagggggaacgggggccggagtggatttcatacatcagtagtagtggtaacaccttagtactntgcagactctgtgaaggcgattcacatctcagagacaacgacaagattcacttgttctgacaaatgaacngctagagagacgaggataacggtcttatttacttagttgtgcgcgagtcgaactaaggaaaacgtcgggttacggtccgttaaggtttcggggg

SEQ ID NO: 412460 - DNA, 667 bp, Homo sapiens
  misc_feature: GZ8MTXP01D2VFI.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcactagtggagtcgtgggggagtcttggtacagccgtgggaccggtccctgacgtactctcctgtgcagcctctggatacatcttacaaaagtttcgaaatggagcgtgggtcccgccgagggcccttaccggtaggggggaacgggggtccggtaggttggtacttttacagttaacatcgtaaggttaggtagttacggtaaacctacccgtttagtaactaagtgacaagtactcgtaggaggtaacgggacgtattaccacactctacaagacaacacgaccaaagtaacttactacgttcggtttactacgaactaaatacgaacgacgtacgtagagtaagaacggaggtaagtaacggttactttaacgtttaacgttagttacggtcggacgttcgttaacgtaacggaaacgaaagggtaaaaacgggtccgggttacggtaacccggttaagggttttaacgggggg

SEQ ID NO: 412461 - DNA, 558 bp, Homo sapiens
  misc_feature: GZ8MTXP01BNNRK.11.73.G07.1.454.CMB.2.raw
  modified_base (184)..(184): a, c, t, g, unknown or other
  modified_base (305)..(305): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgnggcgtgcacctagtggagtctgggggagcttggtacagcctggacggtccctgagactctcctgtgcagcctctggatacatcttacaaaagtttcgaaatgagctgggccgcaggctcgnggggagggcgagtggatttcatacatcagtagtagtggtaacaccgttagtactgtgacagtaccttcgtggtagaacgggccgtattccaaccatcctaccaacgagaacaacgaccaaagaattcacttgggtttctagaccaaatgaacagcctagagagacgagataacggacttaatttacttagttgtggcgttcgataacggaacgaagaaaagggcggttacggtaaccgttaagggttcggggg

SEQ ID NO: 412462 - DNA, 504 bp, Homo sapiens
  misc_feature: GZ8MTXP01AW21Y.11.73.G07.1.454.CMB.2.raw
  modified_base (344)..(344): a, c, t, g, unknown or other
  modified_base (363)..(363): a, c, t, g, unknown or other
  modified_base (442)..(442): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatggtatcggcagcgacagggaaagcccctgagctcctgatctacgatgcgtaccaatttggaaacagacggtcccccacgaggttcagtggaaagtggntcgtgggacagactttacnctcacatcagcagcctgcagcctagaagatattgacaaactattaattactagtacaacagtaatgtatcgtactcctntaactttcgggcccttggggaccaggagttggacaagtagaaacgaatggttagcttgaacc

SEQ ID NO: 412463 - DNA, 547 bp, Homo sapiens
  misc_feature: GZ8MTXP01A572K.11.73.G07.1.454.CMB.2.raw
  modified_base (360)..(360): a, c, t, g, unknown or other
  modified_base (371)..(371): a, c, t, g, unknown or other
  modified_base (380)..(380): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagctctcctgtgcagcctctggatacatcttacaaaagtttcgaaatgagctgggtccgcaggctccgtggggacgggggccggagtggatttcatacatcgaagttagtaggtggtaaccnccttagtactntgcagactngtgaacgggcgattcacatctcagacgacaacgaccaagaattcaacttggtttactagacaaatagaacagacctgagagacgaggataacggtcttaatttacttagttgtgcgcgactaacgacgaaggaaaacggcgggttacggtcgttaaggtttcggggg

SEQ ID NO: 412464 - DNA, 643 bp, Homo sapiens
  misc_feature: GZ8MTXP01EU1LF.11.73.G07.1.454.CMB.2.raw
  modified_base (256)..(256): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcactagtggagtcgtgggggagcttggtacagcctggacgtcctgacgtctctcctgtgcagcctntggatacatcttacaaaagtttcgaaatgagcgtgggtacccgcaggctccggtagggggaacgggggtccgagttggtactttacattacatcaggttagtagtacggtaactcctttagaactgtcgcaagtcttacgtgggtagaaacggggccctattaccacctatcctacgaacgaacgaccaaacgaccaaagtacttactaccgtttaggtttcaggaacctaaagtacggaaaccacggtaccgtaaggacgaaggtacgaagggtactaaccgggttatttaacgtttaacgttgttagtagggacccgttcgttaacgtcgaaacgaaaggtaaaacggggcgggttacgtaacggtttaacggggtttaaggggg

SEQ ID NO: 412465 - DNA, 507 bp, Homo sapiens
  misc_feature: GZ8MTXP01ALZCH.11.73.G07.1.454.CMB.2.raw
  modified_base (349)..(349): a, c, t, g, unknown or other
  modified_base (368)..(368): a, c, t, g, unknown or other
tcagcgagagataccacgaccggtgctcgatttagctctacgctcaggggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcagacataagaactattaatggtatcggcagcgaccagggaacgcccctgacgctcctagatctacgatgcgtccaaagtttggaaacagacggtccccccacggaggttcaggtggaaagtggntgtgggacagtactttacnctcacatcagcagctgctagcctagaagtatattgacctaatatattactagtacaatgtatgtatcgtctcctaataacttcgggccttagggaccaggagttcggacaagtacgaacgacgtagttgcgttgaaccc

SEQ ID NO: 412466 - DNA, 627 bp, Homo sapiens
  misc_feature: GZ8MTXP01AIVTO.11.73.G07.1.454.CMB.2.raw
  modified_base (306)..(306): a, c, t, g, unknown or other
  modified_base (391)..(391): a, c, t, g, unknown or other
  modified_base (415)..(415): a, c, t, g, unknown or other
  modified_base (424)..(424): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccatcctccttgtctgcatctataggagacagagtcaccatcactgccaggcgagtcaggactaattaagaacttattaaagtgtatcggcaggccgaaccgaggaacgcccctgacgcgtacctgactaccgtacgntcggaccgttaacctaaagtttacggaaacacggtaaccggtacccccccgaccggtagggttacgaggtagggtaaaacgtggntcggtagggactagtacctttacnctacactancgagcacgcctagacctagtacctagggaactaattagttacgaaccgtaataattactttacttaacgtacaaacgtaggttactcggtaccttccgtaccttaccccgtaattaaacccggtttcccggaccgttaggggaacctagggacgttacgggacaacggtaacgaaaccgtacgtggttacgccttcgtaaccc

SEQ ID NO: 412467 - DNA, 632 bp, Homo sapiens
  misc_feature: GZ8MTXP01A0Q2K.11.73.G07.1.454.CMB.2.raw
  modified_base (329)..(329): a, c, t, g, unknown or other
  modified_base (403)..(403): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatcctcctgtctgcatctataggagacagagtcaccatcacttgccaggcgagtcaggacaattaagaacttatttaaatggtatcggacagacgacagggaaacgcccctagacgctccgtgactctaacgatcgaccgtacctaagtttcggaaaacnggacggtaccccccacggagttacgaggtggtaaaacgtgggctcgtacggggaactacggtaccttttaaccnctacctacctacgtacgacgacgacgccgtacgacgacgtacgtaagaaacgtattacgtacgaacgtaaataatttaacttacgttacgtaactaacgttagttaacgtctaccgttccgttaccgttacctaacgttaaccgtttcccgggaccgttacgggaaccgtaggttacggttacggttaactaacgtacggaaacgtcgtcggttacgtcgttcgaaccg

SEQ ID NO: 412468 - DNA, 589 bp, Homo sapiens
  misc_feature: GZ8MTXP01B02NT.11.73.G07.1.454.CMB.2.raw
  modified_base (194)..(194): a, c, t, g, unknown or other
  modified_base (274)..(274): a, c, t, g, unknown or other
  modified_base (288)..(288): a, c, t, g, unknown or other
  modified_base (323)..(323): a, c, t, g, unknown or other
  modified_base (363)..(363): a, c, t, g, unknown or other
  modified_base (382)..(382): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatcctcctgtctgcatctatagganacagagtcacatcacttcgccaggcgagtcaggactaattaagaattattaaatggtatcggcagcgaacgagggaaacnccctgacgcctccngactcgtacgatcgcgtacctaagtttaggaaacnggtacggtacccccacggtaggttcgaaggtggaaagtgntgtgggacagtactttacnctcaccatcagcacgctagacagccagaacgaattattacgactaaactattaacttactacgtaacaacgttagtaagttgtaaccgttccgttaccttaccttaacgttaaaccgtttccgggtacccgagggtaaaccgaagttacggttcggaaacctaagtaaccggtaaaacgtcgtcggttacggtccttaaggtaaccc

SEQ ID NO: 412469 - DNA, 633 bp, Homo sapiens
  misc_feature: GZ8MTXP01ENJFD.11.73.G07.1.454.CMB.2.raw
  modified_base (199)..(199): a, c, t, g, unknown or other
  modified_base (284)..(284): a, c, t, g, unknown or other
  modified_base (341)..(341): a, c, t, g, unknown or other
  modified_base (382)..(382): a, c, t, g, unknown or other
tcagcgagagataccacgaccggtgctcgatttagctctacgctcaggggggcaggagtcagtcccaaccaggacacagcatggacatgagggtccctgctcagctcctggggctcctgctgctctgtctctcaggtgccagatgtgacatccagttcgacccagtcctccactccctccctgtctgcatctatagganacagacgtcaccatcacttgccaggcgagtcaggactattaaagtaacttatttaaagtggtatcgacagacgaacgagggaacncccctagacgtctcctagactactacgagtcgaccgttactaaagtttacggaaacnggtaccggtaccccccacggtagtcgaggtaggaagtaggntcgtagggacagtacttactctcacatcagactagccctagccagcctagaagtattactacgaactaactaattacttactaggtaaccaacgttagtattacgtacttccgttaccttcccgttaacggtaaaccgttttcccggggaccccgttaacggggtaacccgaagggttacgggttacgggaaactaaggtaaccgtaaaacggttaacccgtggggttacgggtcccgttaacgtaacccg

SEQ ID NO: 412470 - DNA, 667 bp, Homo sapiens
  misc_feature: GZ8MTXP01CVXNF.11.73.G07.1.454.CMB.2.raw
  modified_base (258)..(258): a, c, t, g, unknown or other
  modified_base (273)..(273): a, c, t, g, unknown or other
  modified_base (287)..(287): a, c, t, g, unknown or other
  modified_base (297)..(297): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccatcctccctgtctgcatctagtaggagacagagtcaccatcactgcgaggcgagtcagactattaagaacttaatttaatgtatcggnagacgacgaggaacnccctgacgctccgngactctacgntcgtacgtaccgtaaagtttacggaaacgaggtaccggtccccccgaacggtaggttacgaaggtagggaaaaggttcgggaacgttcggtaaggggaactacggtacctttacgtctaccacctatccgaagcgaacgcctacgacgacgtccgtaagaaacgtattacgttacgaaccctaaattaaacgtttaacttaaccggttactaaaccgtaaagttaacgttagtacgtaactcccgtttaaccttcccttaacgttaaccgttcccgggttacccggagggtaaacccgtgggttaacgggttcgaaagtaacgtaaaggtaaaaccgttcggtggttaccgggtaaccttcggtaacccg

SEQ ID NO: 412471 - DNA, 531 bp, Homo sapiens
  misc_feature: GZ8MTXP01EKK3U.11.73.G07.1.454.CMB.2.raw
  modified_base (297)..(297): a, c, t, g, unknown or other
  modified_base (307)..(307): a, c, t, g, unknown or other
  modified_base (365)..(365): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggacggtccctgagactctcctgtgcagcctctggatacatcttacaaaagtttcgaaatgagctgggtccnccaggctcgnggggaacggggccggagtggatttcatacatcagtagtagtggtaacaccttgtactntgcagactcgtggtgaagggccgatcacatctcagagacaacgaccaagaattacacttcggtttctagactaaatagaaacagcctagagagacgaggataacggtcttatttacgttattgtgcgcgatcgacaagaaaagcggttacggtccgttgttcgggg

SEQ ID NO: 412472 - DNA, 721 bp, Homo sapiens
  misc_feature: GZ8MTXP01A6Y9A.11.73.G07.1.454.CMB.2.raw
  modified_base (202)..(202): a, c, t, g, unknown or other
  modified_base (311)..(311): a, c, t, g, unknown or other
tcagcgagagataccacgaccggtgctcgatttagctctacgctcagggggcaggagtcagtcccaaccaggacacagcatggacatgagggtccctgctcagctccgtggggctcctgctgctctgtctctcaggtgccagatgtgacatccagttcgacccagtcctccactccctccctgtcctgcatctaagtagganacagacgtcacctatcacttgaccgaggcgagtacgaaggaactaattaaacgtaacttaatttaaagtggtactcggtacgaacggccgaaaccgaacggggaaaccnccccgtagacgtcctcctagtactacgtacgtatcggaccgttaacctaaagtttacggaaacgtacggaaccggtaccccccgaaccggtaggttacgagggtaggtaaaaggttcgggtaacgttacggtacggggtaacctaacggttaccttttaccgaccgtacctaaccctataccgacggacctacggtacccgtaggaccgtacgtaccgttaagaaacgttacttaacgttacgaactaaactaactttaacttaccttagtaacctaacgtaagttatacggtacttccgtaccttcttaaccgtaacggtttcccgggtacccgttacgggtaacccgtaaggttaccggttgaaccgtaagtacggtaaaacgtcgtacgggacgtcgttcgtaaccg

SEQ ID NO: 412473 - DNA, 658 bp, Homo sapiens
  misc_feature: GZ8MTXP01EPTOT.11.73.G07.1.454.CMB.2.raw
  modified_base (195)..(195): a, c, t, g, unknown or other
tcagcgagagataccacgaccggtgctcgatttagctctacgctcaggggggcaggagtcagtcccaaccaggacacagcatggacatgagggtccctgctcagctcctggggctcctgctgctctgtctctcaggtgccagatgtgacatccagttgacccagtctccatccctcctgtctgcatctatagganacagagtcaccatcacttgccaggcgagtcaaggactaattaagtaacttaatttaaagtgtatcggacagacgaccgaagggaacgcccctagacgctcctgactactacgatcgacgttacctaaagtttagggaaacacggtacggtaccccccgaccggtaggttacgaaggtagggaaaagggttcggaagttaccggtagggggaaacctacgggttaaccttttaccacttaccacctatacgaacgcgaacggtccgttagaccgtacggaccttaggaaagtataaagtttacgaacctaaacttaatttaaacttacgtacgttaacaaactagttaaacgtgtaacttccgtaccttccgtaacgttaacgtttcccgggacccgttacggggacctagggttacgttggaaccgtaagtaagaaacgtacgtggttacggtcttcgaaccg

SEQ ID NO: 412474 - DNA, 500 bp, Homo sapiens
  misc_feature: GZ8MTXP01A1N4G.11.73.G07.1.454.CMB.2.raw
  modified_base (251)..(251): a, c, t, g, unknown or other
  modified_base (264)..(264): a, c, t, g, unknown or other
  modified_base (286)..(286): a, c, t, g, unknown or other
  modified_base (368)..(368): a, c, t, g, unknown or other
  modified_base (375)..(375): a, c, t, g, unknown or other
  modified_base (404)..(404): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagatcaccatcacttgccaggcgagtcaggacattaagaatattaaatggatcgnagcgacaggaacncccctgagctcctagatctagntgcgtaccaatttagggaaacagacggtaccccccacggtaggttcgagtggaaagtggaatcgtgggactagtactttacnctcaccntacagcagctacgcacgctgagatattanacgaacatatactagtacacagtatgtatctctctctacgttcgtccgttcggaccgagacgttgacgaatagaacgacgtagttgtcgttgaacc

SEQ ID NO: 412475 - DNA, 655 bp, Homo sapiens
  misc_feature: GZ8MTXP01AZ0NO.11.73.G07.1.454.CMB.2.raw
  modified_base (275)..(275): a, c, t, g, unknown or other
  modified_base (329)..(329): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggttgccagatgtgacatccagttgacccagtctccatcctccctgtctggcatctagtaggagacagagtcaccatcacttgccaggcagtcgaaggacattaagaacttatttaaatggatcgacgagcgacagggaacncccctgacgctccgtgactcgtacgatcgtaccgtactaaagtttaggaaacgnggaaccggtccccccggaccgtaggttacgaaggtaggaaaagttcgggaacgtacgtagggggaacctacggttacctttacctcttaccgaacctactaccgaacggcctaaacggccctacggactaacgtccttaggaaacgtattacgttacgaactaaacgtacgtttaactaccgttagtaaccaaagtagttaaacgtcgtacgtttaccttactcccgttaacgttaaacggttccgggtaccccgttaggggaacccaaggttacggttcgaacaacgttaagaaaaccgtcgtaggttacggaacttcggaaccg

SEQ ID NO: 412476 - DNA, 615 bp, Homo sapiens
  misc_feature: GZ8MTXP01CGQOZ.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcactagtggagtcgtgggggagcttggtacagcctggacgtcctgagctctcctgtgcagcctctggatacatcttactaaaagtttcgaaatggagtcgtgggtcccgcgaggccttccgtagggggacgggggccggtagttggtatttcgatacatcgagtaggtagtaggtaaccaccgttagtactaatgacagtactcgtagggagaacgggtccgtattccaacctatacctaccgaagaacgaaccaaccgaccgaaagtaacttaccacttcgggtttactagaactaaatagaacagacctagagagacgaggtaacgtaacggtactttattaacttagttggtgttcgcgttacgtaaccgaacggaaaggaaaacgggtcgggttacggtaaccgtttaagggtttcggggg

SEQ ID NO: 412477 - DNA, 587 bp, Homo sapiens
  misc_feature: GZ8MTXP01ASIM4.11.73.G07.1.454.CMB.2.raw
  modified_base (304)..(304): a, c, t, g, unknown or other
  modified_base (370)..(370): a, c, t, g, unknown or other
  modified_base (487)..(487): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgcttccttgttactattttagaaggtgtccactgtggcgtgcacctaggtggagtcgtgggggagcttggtacagcctggaccggtccctgagactctcctgtgcagcctctggatacatcttacaaaagtttcgaaatggagcgtgggtcccnccaggcctccggtgggggaacgggggccggtagtggtatttcatacatcgagtagtagtggtaacnccttagtactaatgacagacttcgtaggtaggaacgggccgtattccaaccatcctccaacggacgaacaaaccggaccaaagaacttcaacttgggtttactagacaaatagaacngcctagagtaggacgagacgtaacggtcttatttacttagttggtgcgcgagtcgaacgaaaggaaaacggcgggttacggtccgttaagggttcggggg

SEQ ID NO: 412478 - DNA, 552 bp, Homo sapiens
  misc_feature: GZ8MTXP01B72LU.11.73.G07.1.454.CMB.2.raw
  modified_base (194)..(194): a, c, t, g, unknown or other
  modified_base (311)..(311): a, c, t, g, unknown or other
  modified_base (351)..(351): a, c, t, g, unknown or other
  modified_base (373)..(373): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaactattaaatggtatcggcagcgacagggaacgcccctgagctcctgatctacgatgctccaagtttaggaaacngacggtacccccaccggtaggttacaggtaggaaagtggntcgtagggactagtactttacnctcacctatcagcagcctgcagcctaggaacgattattgactaactattacttactagtacaacgtacgtatagtacttccgtcttcctaacttaacgtttccggcccgttacgggaaccgtaggttacgttcgggaactaagtacggaaacgtacgtcggttagtccgttcgaacccg

SEQ ID NO: 412479 - DNA, 552 bp, Homo sapiens
  misc_feature: GZ8MTXP01DCUQH.11.73.G07.1.454.CMB.2.raw
  modified_base (260)..(260): a, c, t, g, unknown or other
  modified_base (300)..(300): a, c, t, g, unknown or other
  modified_base (357)..(357): a, c, t, g, unknown or other
  modified_base (412)..(412): a, c, t, g, unknown or other
tcagcgagagataccacgaccggtgctcgatttagctctacgctcaggggggcaggagtcagtcccaaccaggacacagcatggacatgagggtccctgctcagctccgtggggctcctgctgctctgtctctcaggtgccagatgtgacatccagttgacccagtctccatcctcctgtctgcatctataggagacagagtcaccatcacttgccaggcagtcagacataagactattaatgatcgcagcgacaggaanccctgagctctgatctacgatgcgtacaagtttagaaacngacggtcccccacggaggttcagtggaaagtggaatcgtagggactagtactttacnctcaccatcagcagctgcagacctagaatattattgacaaactaattaattactntactaaacgtagttaaatgtaacgttcgtaccttccgtaacgtaaacgttttccgggaccccgttagggggtaaacccagggttaacgttgggaacctaagttaaacggaaacgtaacgtggttacggcttcggtaaccc

SEQ ID NO: 412480 - DNA, 580 bp, Homo sapiens
  misc_feature: GZ8MTXP01AHW1K.11.73.G07.1.454.CMB.2.raw
  modified_base (196)..(196): a, c, t, g, unknown or other
  modified_base (275)..(275): a, c, t, g, unknown or other
  modified_base (288)..(288): a, c, t, g, unknown or other
  modified_base (324)..(324): a, c, t, g, unknown or other
  modified_base (365)..(365): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtcctccatcctccctgtctgcatctagtagganacagatcaccatcactgccaggcgagtcagacaattaagaacttatttaaagtggtatcggacagacgacgagggaacncccctgacgctcngactctagtatgtaccgtactaagtttacggaaacnggtaccgtacccccgacggtaggtacaggtaggaaagtggntcgtagggtacagttaccttacgctacaccatacagcagcctagctacgtctagaactatatacgacctaaatcttaattaccgtagtaaaccaagtagttaactcgtacttacgttcctccgttaactaacgtttccggacccgttagggtaaccgtagttacggttacggaactaaggtacgaaaccgtaggttcgacggtccttcgtaaccc

SEQ ID NO: 412481 - DNA, 856 bp, Homo sapiens
  misc_feature: GZ8MTXP01DTTSK.11.73.G07.1.454.CMB.2.raw
  modified_base (195)..(195): a, c, t, g, unknown or other
  modified_base (298)..(298): a, c, t, g, unknown or other
tcagcgagagataccacgaccggtgctcgatttagctctacgctcagggggcaggagtcagtcccaaccaggacacagcatggacatgagggtccctgctcagctccgtggggctcctgctgctctgtctctcaggtgccagatgtgacatccagttcgaccagtctccatccctcctgtctgcatctatagganacagacgtcacctatcacttcgccgaggcgagtcaaggactaattaaagtaacttaatttaaagtggtaactcggacaacggaccgaaccgaaggggaaaccnccccgtaggacgtcctctagtaacttcgtacgtattcggtaccgttaacctaaaggtttaacgggaaaaccgtacgggtaacccgggttacccccccaaaccggggttaagggttttaccgaaaggggttagggggtaaaaacggttcgggtaacgttcgggttaacgggggaaaccttaaacgggtttaacccttttaaccgtcctaaccctaacccgtacttaccgacggaccaaccggtcccgttacggacccgtaaggtaccccgtaagggtaaaacgttaatttaaacggttacgaaaccgttaaaaaccgtttaaagttttaaaaccttttaaccgggtaacgtttaaaccccgtaaaacgttaacgggttttaaaactccgggtttaaaccgtttcccgttaccccttttacccgttaaacggttttaaacccggttttccccgggggaccccgtttaagggggaaaccccgtagggttaaacgggttcgaaaaacgttaacgtaaaagggtaaaacccgttaggtcgggttaacgccgttaacgtaaccc

SEQ ID NO: 412482 - DNA, 523 bp, Homo sapiens
  misc_feature: GZ8MTXP01DO76E.11.73.G07.1.454.CMB.2.raw
  modified_base (449)..(449): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaaggacattaagaactatttaaatggtatcggcagcgacaggaaagcccctgagctcctgatctacgatcgcgtacctaaagtttacggaaacaggacggtaccccccaccggtaggtttcgaaggttgggaaaagtgggaagtcgtaggggaactacggtacctttactctacaccatcacgcagcctgcagcctagaagattatcgactaactattaatactntacaacagtatgtatcgtctctctacttcgccttggacagagttgacaatagaaacacgtgttaggtcttgaac

SEQ ID NO: 412483 - DNA, 655 bp, Homo sapiens
  misc_feature: GZ8MTXP01BQIHZ.11.73.G07.1.454.CMB.2.raw
  modified_base (197)..(197): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccatccctccctgtctgcatctatagganacagactcaccatcacttgccaggcgagtcagactaattaagaattattaaagtggtatcggcagaccgaacgaaggaaccgccccgtagacgtcctccgtgtactacgtacgatcgtaccgttacgtaaagtttacggaaacgacggtaccggtcccccgaaccggtaggttacgaggtacggggtaaagtcgggtaatcggtagggtacctagttacctttactcctacaacctagtaccaggccacgtccgtacgactacggtaccgtaagaaagttactaagttacgaacctaaacgttatttaactttaccgtaagttaaccaataacggttatagtacttccgtaccttccgtaacttacggtttccccggacggttacgggaaccctaaggggacgttacggaacgtaagtaaacggtaacgaaccggttgttacggtccgttcgaacccg

SEQ ID NO: 412484 - DNA, 613 bp, Homo sapiens
  misc_feature: GZ8MTXP01CIVWG.11.73.G07.1.454.CMB.2.raw
  modified_base (271)..(271): a, c, t, g, unknown or other
  modified_base (283)..(283): a, c, t, g, unknown or other
  modified_base (381)..(381): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctaataggagacagagtcaaccatcacttgccaggcgagtcaggacattaaagaactattaaatggatcggcagcgacgaaggaacnccctgagctccngatctacgatcgctaccaagtttaggaaacacggacggtacccccacggtaggtacgaggtaggaaagtggaatcgggtagggaactagtactttacnctaccaaccatcaagctacggccctagaccacgtacctagaaagtaacttagttacgaacgtaaacttaatttaacgttaactagtaacccaaagtaaggttaatacgtacttccttacctaccctttaacgtaaacgttttccccgggacccgttaggggaaaccctaaggacgttacgggacctaagtaacggtaaaaccgttaagtgggttacggtcttaacgtaaccc

SEQ ID NO: 412485 - DNA, 635 bp, Homo sapiens
  misc_feature: GZ8MTXP01BFLOR.11.73.G07.1.454.CMB.2.raw
  modified_base (196)..(196): a, c, t, g, unknown or other
  modified_base (284)..(284): a, c, t, g, unknown or other
  modified_base (409)..(409): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatccctccctgtctgcatctatagganacagatcacatcacttgccaggcgagtcaaggactaattaagaacttaatttaaagtggtatcggacaggccgaacgaggggaaaccncccctagacgcctctagtactctacgatcgcgtaacctaaagtttacggaaacacggaccggtacccccacgggtaggttacaggtaggaaagtggtaatcggtagggaacacgttacctttacnctaccactatccgaagcgacgccgtacgacgacgtcctaagaaagtacttaattacggaacctaaactaagtttaacttaaccgtagtaacctaaagtagttaagtcgtacttcccggtacttcccttaacgttaacggtttccccgggacggttacgggaacctaagggttacgttggaacctaaggtaaccgaaagttacgtggttacggtccgttaacgaacc

SEQ ID NO: 412486 - DNA, 539 bp, Homo sapiens
  misc_feature: GZ8MTXP01AFBWG.11.73.G07.1.454.CMB.2.raw
  modified_base (368)..(368): a, c, t, g, unknown or other
  modified_base (449)..(449): a, c, t, g, unknown or other
  modified_base (474)..(474): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccatgtggcgtgcacctagtggagtcgtggggggagcttgggtacagcctggacggtccctgagactctcctgtgcagcctctggatacatcttacaaaagtttcgaaatgagctgggtccgccaggctccgtgggggaaggggccggagtggatttcatacatcagtagtagtgtaacaccttagtactntgcagactctgtaggaacgggccgattcacatctcagagacaacgaccaagaattacacttggtttctagacaaatgaacngcctagagagacgaggataacggtnttagttacttagttgtgcgcgatcgacgaagaaaaggcgggttacggtccgttaaggttcggggg

SEQ ID NO: 412487 - DNA, 247 bp, Homo sapiens
  misc_feature: GZ8MTXP01DYFVR.11.73.G07.1.454.CMB.2.raw
  modified_base (246)..(247): a, c, t, g, unknown or other
tcagcgagagataccacgaccggtgctcgatttagctctacgctcagggtcttcgtggctcacgtccaccaccacgcatgtgacctcaggggtccgggagatcatgagggtgtccttgggttttgggggaagaggaagactgacggtccccccaggagttcaggtgctgggcacagcggccctgggctgcctggtcaaaggactacttccgtatctctcgctgagcgggctggcaaggcgcatagnn

SEQ ID NO: 412488 - DNA, 566 bp, Homo sapiens
  misc_feature: GZ8MTXP01COJ2K.11.73.G07.1.454.CMB.2.raw
  modified_base (254)..(254): a, c, t, g, unknown or other
  modified_base (315)..(315): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcagacattaagaactattaaatggtatcggnagcgaacaggaaacgcccctgacgctcctgactctacgatgtacgtacaaatttggaaacngacggtcccccacggaggttcaggtggaaagtggaatcgtagggactacgtactttacgtctacacccatcagcagccctagcagcctagaagtatattgactaaactattaattacttagtacctaaacgtagttatcggtacttccgttccttccctaactaaacgtttccggccccgttagggaaccgagttacgggttcgaaacgtaagtacggtaaacgacgttttggacggtcgttcggtaaccc

SEQ ID NO: 412489 - DNA, 647 bp, Homo sapiens
  misc_feature: GZ8MTXP01E0CTL.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagagactcaccatggagttggggctgtgctgggtgctccttgttactatttagaaggtgtccactgtggcgtgcactagtggagtcgtgggggagcttggtacagccgtggacggtccctgagctctctgtgcagcctctggatacatacttacaaaagtttcgaaatgagcgtcgggtccgccaggcctccggtagggggaacgggggccggagtggtatttcagtacatcgtaagtagtagtagtaacctacttagtactaagtgacagacttcgtggtagggaaacgggtccgtattaccacctactcctaccaagacgaacaaccgaccaagtaattactacgttggtttctagactaaagtacgaactacgaccgtaggaacgtaaggacggaacggtaacgtaacggtactttaacgtttaaacttagttacggtcggccggacggttaacgttaaccgaaacgtaaacgggtaaaaacgggtccggggttacgggtaaccggtttaaggggttttaaccgggggg

SEQ ID NO: 412490 - DNA, 682 bp, Homo sapiens
  misc_feature: GZ8MTXP01DC4I1.11.73.G07.1.454.CMB.2.raw
  modified_base (197)..(197): a, c, t, g, unknown or other
  modified_base (287)..(287): a, c, t, g, unknown or other
tcagcgagagataccacgaccggtgctcgatttagctctacgctcaggggggcaggagtcagtcccaaccaggacacagcatggacatgagggtccctgctcagctcctggggctcctgctgctctgtctctcaggtgccagatgtgacatccagttgacccagtcctccatcctccctgtctgcatctagtagganacagacgtcaccatcactgccgaggcgagtcaaggactaattaaagaacttatttaaatggtaataggacagacgaaccgaagggaaacnccccgtgacgtcctaccgtagtactacgtacgagtacggtaccgtaaccgtaaagtttacggaaaaccaggtaaccggtacccccccgtaaccggtagggtttacgaaaggggttacgggaaaaagggttgggtaacgttacggtaacgggggtaaactaacggttaacctttacgtcctaccgaacctacgtaccaacggcctaaacgcccgtaggacccaggtacctaagaacgtattagttacaacgttaaactattaaacttactagtaaccaagtaagttatacgtacttccgttcctaccttcgttaacgttcccgggaccgttagggtacccaggttacggttacgacgtaacgaagtaaaccgtacgtggttacgccgttgtaaccc

SEQ ID NO: 412491 - DNA, 591 bp, Homo sapiens
  misc_feature: GZ8MTXP01EY5ZM.11.73.G07.1.454.CMB.2.raw
  modified_base (195)..(195): a, c, t, g, unknown or other
  modified_base (279)..(279): a, c, t, g, unknown or other
  modified_base (413)..(413): a, c, t, g, unknown or other
tcagcgagagataccacgaccggtgctcgatttagctctacgctcaggggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcacatcacttgccaggcgagtcaaggactaattaagaacttaatttaaagtggtatcggcagccgacgagggaaacncccctagacgtctcctagatctaacgatcgtacgttacctaaagtttacggaaacacggacggtacccccccaaccggtaggtttacgaaggtgggaaaaaggtggtaactcgtaggggactagtacctttacnctaccactatcagacacgctaggcagcctagaacgtatacttagacaactattattacgtagtaccaatagtatgattccgtacttcccgtaactaacgtttccggacccgttagggaccctaagggaagttcggaactaagtacgtaaaccggtagtggttacggcttaagaacccg

SEQ ID NO: 412492 - DNA, 491 bp, Homo sapiens
  misc_feature: GZ8MTXP01CO5XR.11.73.G07.1.454.CMB.2.raw
  modified_base (261)..(261): a, c, t, g, unknown or other
  modified_base (332)..(332): a, c, t, g, unknown or other
  modified_base (410)..(410): a, c, t, g, unknown or other
  modified_base (417)..(417): a, c, t, g, unknown or other
  modified_base (472)..(472): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcagtcagacataagaactattaatgtatcgcagcgacaggaacnccctgacgctctgatctacgatgcgtaccaatttgaaacagacgtcccccacgaggttcagtggaaagtgntcgtagggacagactttactctacacatcagcagctgcagcctagaagatattagactaacattatactagtaccaanagtactnatcgtctcctaataacttcggcccttgggaccaggcgttgacgaatacgaaacgntggaggtaacttcggaacc

SEQ ID NO: 412493 - DNA, 526 bp, Homo sapiens
  misc_feature: GZ8MTXP01DPX64.11.73.G07.1.454.CMB.2.raw
  modified_base (300)..(300): a, c, t, g, unknown or other
  modified_base (369)..(369): a, c, t, g, unknown or other
  modified_base (489)..(489): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctgggacggtccctgagactctcctgtgcagcctctggatacatcttcaaaagttttcgaaatgagctggggtcccnccagggctccgtggggaagggggccggagtggatttcatacatcagtagtagtggtaacaccttgactntgcagactctgtgaagggcgattcacatctccagagacaacgcaagaatcactggtttctgcaaatgaacagcctagagagacgaggagtaacggcttatttacttagttagtgcgcgancgacaagaaaaggcggttaggtcgttaagttcggggg

SEQ ID NO: 412494 - DNA, 664 bp, Homo sapiens
  misc_feature: GZ8MTXP01BTK6M.11.73.G07.1.454.CMB.2.raw
  modified_base (258)..(258): a, c, t, g, unknown or other
  modified_base (303)..(303): a, c, t, g, unknown or other
  modified_base (383)..(383): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgcttccttgttactattttagaaggtgtccatgtggcgtgcacctagtggagtcgtgggggagcttggacagcctgggaccggtccctgagctctcctgtgcagcctntggatacattcttaacaaaagtttcgaaatgagcgtggggtcccncgaggcctccggtagggggaacgggggccgtagtggtatttcatacatcgagtaggtagtggtaacctaccttagtactntgacagtctcgtagggtagaacgggccgtattccaacctatcctaccgaagaacgaaccgaaccgaccaaagtaacttacgtaactttcggtttacgtacgtaacctaaagttacgaaaccgacgaccgtaggaacggaacggtaacggaacggtaacgttaaccggtaactttaacgtttaacgttagtttcggtacggaccggttcgttaagtaaccggaaacgaaacgggtaaaacgggtcgggttacgggtaaccggtttaacggggtttcgggggg

SEQ ID NO: 412495 - DNA, 558 bp, Homo sapiens
  misc_feature: GZ8MTXP01BB0SY.11.73.G07.1.454.CMB.2.raw
  modified_base (257)..(257): a, c, t, g, unknown or other
  modified_base (298)..(298): a, c, t, g, unknown or other
  modified_base (371)..(371): a, c, t, g, unknown or other
  modified_base (382)..(382): a, c, t, g, unknown or other
  modified_base (396)..(396): a, c, t, g, unknown or other
  modified_base (448)..(448): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagctctcctgtgcagcctntggatacatcttacaaaagtttcgaaatgagcgtgggtccncaggtctccggtagggggaacgggggccgtagtggtatttcattacatcagtagtagtgtaactcttagactntgcagctgtgngacggcgtatcacntctcagacgacaacgacaaagtatactacttggttactgacaagtacgaacngcctagagtagaacggaggtacgtaacggtacttatttacttagttcggtcgcgcgacgtaacgaacgaaggaaaacggtcgggttacggtcgttaacgggtttcggggg

SEQ ID NO: 412496 - DNA, 702 bp, Homo sapiens
  misc_feature: GZ8MTXP01BCM67.11.73.G07.1.454.CMB.2.raw
  modified_base (358)..(358): a, c, t, g, unknown or other
  modified_base (437)..(437): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatccctcctgtctgcatctataggagacagagtaccaccatcactcgccgaggcgagtacaggactaattaaagtaacttaatttaaagtggtatcggacacgaccgaaacggaacgggaaaccgccccgtagacgtcctaccgtagactcgtacgtagtcgtaccgtacctaaagtttacggaaaacncggtaccggtacccccccgtacggtaggttacgagggtaggaaacggtggtaatcggtagggactacgtacttttaccnctacacatcgaacgtcgacgtccgtagacctaacggtaccgtaaggtaaagtattaacgttacaacttaaacctaatttaactaacgttacgtaaactaaacgttagttaaacgtcgttaaccttcccgttaccttcccttaacgttaaccgggttttccccgggaacccggttacgggaaacccgtaggttaacggggttacggaacctaaacgggtaaccggtaaaaccggtacggtttggaccgggtaacttccggtaaccc

SEQ ID NO: 412497 - DNA, 791 bp, Homo sapiens
  misc_feature: GZ8MTXP01AJ58U.11.73.G07.1.454.CMB.2.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccactccctccctgtctgcatctataggagacagacgtccaacctatccacgttcgaccgagggcgagtacgaaggtactaagttaaacgtaacttaatttaaagtgggtaatccggggacaacgggacccggtaaacccggaagggggaaaacccgtcccccgtaggaaccgtcccttaccgtaggtaaccttacggttaccggagttacggtaccccggttaacctaaaggttttaacgggaaaaaccgtacggggtaacccgggtaccccccctaacgggggttaggttaccggtaaggggtacggtaaagggttacgggtaacttccgggtaacggggaacctacggttaacccttttacgacccttaccaaccctaagtacccgaacgccgtaacgtcccgtacgaaccgtacggtaccgtaaggtaaacgttaacttaagttaccgaacttaaacgttagtttaaacttaacgttaacgtaacctaaacgtaggttaaactcggttaacttcccggtaccttccgtaacgttaacgttcccggacccgttaggggaaccctagacgttacggaactaagtaacggtaaacgtacggtgttacggtcttccggaaccc

SEQ ID NO: 412498 - DNA, 709 bp, Homo sapiens
  misc_feature: GZ8MTXP01DOIUO.11.73.G07.1.454.CMB.2.raw
  modified_base (150)..(150): a, c, t, g, unknown or other
  modified_base (248)..(248): a, c, t, g, unknown or other
  modified_base (256)..(256): a, c, t, g, unknown or other
  modified_base (344)..(344): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttgggctgtgctgggtncttccttgttactattttagaaggtgtccactgtggcgtgcaccgtagtggagtcgtgggggagcttggacagcctggacggtcctgagctctcctgngcagcctnggatacatcttacaaaagtttcgaaatgagcgtgggtcccgccaggcctccgtagggggaacggggccggtaggtggactttcatacntacagtagtagtggtaactccgtttagactaatcgactagtaccttcgtacggtagggaaacgggtacccgtagtttaccaacctacttcctacccgaagaacggaaccaaaccgtacccgaaacgtaaactttacctaaccgtttacggggttttaccgtagtaaccctaaaagttacgaaaacccgacggtacccgtaagggaacggtaacgggaaaccggtaagggtaaccgttaacgggtacctttaaaggttttaacctttagtttagggttcggaccgttacggttaacgttaaccggaaaccgtaaaggtaaaaacgggtcggggttacgggtaacccgtttaagggttttcgggggg

SEQ ID NO: 412499 - DNA, 584 bp, Homo sapiens
  misc_feature: GZ8MTXP01A8G0Y.11.73.G07.1.454.CMB.2.raw
  modified_base (265)..(265): a, c, t, g, unknown or other
  modified_base (309)..(309): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatccctcccgtctgcatctataggagacagagtcaccatcacttgccaggcgagtcaggacataagaactattaatgatcgcagcgacgaggaacnccctgagctctgactctacgatgcgtactaagtttacggaaacnggacggtacccaccgtaggttacaggtaggaagtggatcgtagggacagtactttactctcaccatcagcacgcctgacagtccgtagaacgattacgtagacaaacgtattaactttactacgttaacaactagttactacggtaacttcccgttacctacccgttacgttaacgtttccgggccccgttaacggggacccaagggtaacgttcgggaacttagttaacggaaaacgtaaccgttggtaacgggccttcggttaacctaacccg

SEQ ID NO: 412500 - DNA, 681 bp, Homo sapiens
  misc_feature: GZ8MTXP01DWT4N.11.73.G07.1.454.CMB.2.raw
  modified_base (279)..(279): a, c, t, g, unknown or other
  modified_base (422)..(422): a, c, t, g, unknown or other
  modified_base (490)..(490): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatcctcctgtctgcatctataggagacagatcacatcactgccaggcgagtcaaggaactaattaaagaacttaatttaaagtggtatcggcagaccgaacgaggaaacnccccgtagacgtcctccgtgtaactactaacgtatcgtacgtacctaaagtttacggaaaacgtaggaccgtacccccgaacggtaggttacgaggtaggtaaaagtggtaactcgggtagggaacctaacgtaccttttacnccttaccacctatacgacgactacgcccgtagacacggtacctaaagggtaaagtattaaccgttaanaaacttaaactttaatttaaacgttaccgtaacgtaaaccgtaaacgttaagttacgttacgtacgttcccgtttaccgttaaccgttaaccgttaaccggttcccgggaccgttaacgggaaccgtaaggttacggttacgaacgtaaacgtaacgaaacggtagtcgggttaccgtcgttaaccgaacc

SEQ ID NO: 412501 - DNA, 697 bp, Homo sapiens
  misc_feature: GZ8MTXP01B3NI2.11.73.G07.1.454.CMB.2.raw
  modified_base (278)..(278): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatcctccctgtctgcatctataggagacagagtcacatcactgccaggcagtcagactaattaagtaacttaatttaaagtggtatcggcagacgaaccgaagggaacnccccgtagacgtctcctgtactaccgtacgtacgtcgtaccgttaccgtaaagtttacggaaaactacggaccggtacccccccgtaaccgggtaggtttaccgaaggggttacgggtaaaaggttacgggaacgtttacgggtaacggggaacttaacggttaacccttttaccgtacctaccctaacctacgttaccgaacgaccgtaacggtcctacggaccgacgtaccgtaagtaaacgtaattacgttacgaaactaactaatttaacttacttacgtaactaaacgttagttacgtgtacttacccgttacctccttaacgttaaccggttttcccgggacccgttagggaaccgtaggttacggttcggaactaaggtacgtaaacggtacgtggttacgtcgttcgaacc

SEQ ID NO: 412502 - DNA, 707 bp, Homo sapiens
  misc_feature: GZ8MTXP01C13ZJ.11.73.G07.1.454.CMB.2.raw
  modified_base (306)..(306): a, c, t, g, unknown or other
  modified_base (346)..(346): a, c, t, g, unknown or other
  modified_base (626)..(626): a, c, t, g, unknown or other
tcagcgagagataccacgaccggtgctcgatttagctctacgctcaggggatctcggagaggtgccttagccctggattccaaggcatttccacttggtgatcagcactgaacacagaggactcaccatggagttggggctgtgctgggtgctccttgttactattttagaaggtgtccatgtggcgtgcacctagtggagtcgtgggggagcttggtacagcctggacggtccctgacgactctcctgtgcacgcctctggataacatcttaactaaaagtttcgaaatgagcgtcggtccacgngccgtcgggagggaacgggcgtagtgtactttacgatacntacgagttaagtagtacgtaactacgttataactatcgactaaggtcctgtaggtaacgggacgggtacctacttaccaacctacgttaccgaccgaacggaaacgaaaccgaaaccgaacctaaaagttacttaaccgttacgtttacgtttaccaaggtaaacctaaagttaacgaaacgaccgtcgtaagggaaacggaccggaaacgggtaaagtaaccgttaaacggtttaaactttaaccgtttacttacgggttgtacggacggttaacccgnggttaaacccgaaggtaaaaaacggtaacggggtcggtaaccggggttaccgttaacgggggtttcgggggtttttaaggg

SEQ ID NO: 412503 - DNA, 532 bp, Homo sapiens
  misc_feature: GZ8MTXP01EZUN6.11.73.G07.1.454.CMB.2.raw
  modified_base (256)..(256): a, c, t, g, unknown or other
  modified_base (355)..(355): a, c, t, g, unknown or other
  modified_base (365)..(365): a, c, t, g, unknown or other
  modified_base (461)..(461): a, c, t, g, unknown or other
  modified_base (468)..(468): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacgtccctgagctctcctgtgcagcctntggatacatcttacaaaagtttcgaaatgagctgggtcccgcaggctcgtagggggaagggccgagtggatttcatacatcgagtaggtagtggtaacnccttagactntgcagactcgtggtagaaggcgatcacatctcagagacaacacaagaattacacttcggtttctagacaaagtagaacagcctagagagacgaganaacggtnttattacttagtgtgcgcgataacgaacgtaagaaaacgcggttacggtcgttcggttcggggg

SEQ ID NO: 412504 - DNA, 580 bp, Homo sapiens
  misc_feature: GZ8MTXP01APYAW.11.73.G07.1.454.CMB.2.raw
  modified_base (303)..(303): a, c, t, g, unknown or other
  modified_base (485)..(485): a, c, t, g, unknown or other
  modified_base (532)..(532): a, c, t, g, unknown or other
tcagcgagagataccacgaccggtgctcgatttagctctacgctcaggggatctcagagaggtgccttagccctggattccaaggcattttccacttggtgatcagcactgaacacagaggactcaccatggagttggggctgtgctgggtgctccttgttactattttagaaggtgtccactgtggcgtgcacctagtggagtcgtgggggagcttggtacagcctggaccggtccctgagactctcctgtgcagcctctggatacatcttacaaaagtttcgaaatgagcgtggggtcccncgaggcctaccggtagggggaacgggggccggaaggtggtattttcgaattacatacagtaggttagtggtaaactccttagtaactaatgacagtacctgtggtagaacgggcctattcgacactctaccagacgacaacgaccaaagacttcaacttgggttctagaccaaagtcgaacngacctagacgagacgaggataacggcttagttacttagttgtcgcgngactaacgaacgtaacgaaaacggcggttacggcgttaaggttcgggg

SEQ ID NO: 412505 - DNA, 514 bp, Homo sapiens
  misc_feature: GZ8MTXP01DH0OH.11.73.G07.1.454.CMB.2.raw
  modified_base (195)..(195): a, c, t, g, unknown or other
tcagcgagagataccacgaccggtgctcgatttagctctacgctcaggggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaactatttaaatggtatcgcagcgacaggaaagcccctgagctcctgatctacgatgcgtacctaatttaggaaacagacggtacccccacggaggttcagtaggaaagtgaagtctgggacagtacttactctacacatcagcagcctgctagcctagaagatattgacaactattaacttactagtaccaaagagtatgtaatcgtctcttaactaacgtttccgcccgttgggaccagagttggacaagtagaaacgactggttacgcttgaacc

SEQ ID NO: 412506 - DNA, 547 bp, Homo sapiens
  misc_feature: GZ8MTXP01BO8UU.11.73.G07.1.454.CMB.2.raw
  modified_base (194)..(194): a, c, t, g, unknown or other
  modified_base (337)..(337): a, c, t, g, unknown or other
  modified_base (365)..(365): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccttgtctgcatctatagganacagagtcaccatcacttgccaggcgagtcagacataagactattaatggtatcgcagcgacaggaacgcccctgagctctgatctacgatgcgtcaagtttaggaaacagacgtcccccacggaggttcagtggaaagtggntcgtagggacagtactttactctcaccntcagcagcctagctagcctagaagatattcgacaactattacttacgtagtacaacgtagtatcgtacttcgttctccctcgtaaacgtttcccgggacccgttcggggaaccctaaggacggttcgggaactaacggtaacgtaaaccgtacgttacggttcgggtccttcgggtaacccg

SEQ ID NO: 412507 - DNA, 596 bp, Homo sapiens
  misc_feature: GZ8MTXP01B833K.11.73.G07.1.454.CMB.2.raw
  modified_base (386)..(386): a, c, t, g, unknown or other
tcagcgagagataccacgaccggtgctcgatttagctctacgctcaggggatctcagagaggtgccttagccctggattccaaggcattttccacttggtgatcagcactgaacacagaggactcaccatggagttggggctgtgctgggtgctccttgttactattttagaaggtgtccactgtggcgtgcacctagtggagtcgtgggggaggcttggtcaaagcctggacggtccctgagactctcctgtgcagcctctggatacatcttacaaaagtttcgaaatgagcgtgggtcccgccgaggcgtccgtgggggaacgggggccggaggtggtagtttcattacatcgagttagtagtaggtaactacgtttagtactntgctagactctgtaggaacgggtcgtacttcacatctacgagagaacaacgaccaaagtacttacacttggtttctagaccaaatgaaacacgcgtaggagtaacgacggaaggtacgtaacggtactttaactttacttagttggtgacgttcgacgtaacgaacgaaaggaaaacggtcgggttacggtccgttaagggtttcggggg

SEQ ID NO: 412508 - DNA, 561 bp, Homo sapiens
  misc_feature: GZ8MTXP01ENORN.11.73.G07.1.454.CMB.2.raw
  modified_base (272)..(272): a, c, t, g, unknown or other
  modified_base (288)..(288): a, c, t, g, unknown or other
  modified_base (316)..(316): a, c, t, g, unknown or other
  modified_base (345)..(345): a, c, t, g, unknown or other
  modified_base (366)..(366): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctagtaggagacagagtcaccatcacttgccaggcagtcaggacaattaagaactattaaatggtatcggcagcgaacgagggaaacncccctagagtctctgntcgtacgatcgcgtactaagttgaaacngacgtcccccacgagttcagtggaatggntcgtagggacagacttttacnctacgacatcagactacgctacgacgacgtacgtagtaagtatatacgtacgtaactaattaacttacgtacgtaacgtaacgtagtagtagtactacgttccttcctaacttacgttccggtaccggttacggtaccgtacgacggttacgacgtaacgtacgtaacgtaacgtacgttacgtcgttcgtaacg

SEQ ID NO: 412509 - DNA, 556 bp, Homo sapiens
  misc_feature: GZ8MTXP01ACT2A.11.73.G07.1.454.CMB.2.raw
  modified_base (254)..(254): a, c, t, g, unknown or other
  modified_base (268)..(268): a, c, t, g, unknown or other
  modified_base (286)..(286): a, c, t, g, unknown or other
  modified_base (307)..(307): a, c, t, g, unknown or other
  modified_base (365)..(365): a, c, t, g, unknown or other
  modified_base (394)..(394): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcactgccaggcagtcaggactaattaagaactattaatgtatcgganagcgacgaggaacnccctgagctctgatcagntcgcgtacaagttaggaaacngaccgtccccacggtagtcgagtggaaagtggaatcgtagggactacgtacctttacnctacacctatacacgcacgcctgaccganaccgtagaacgtattattacaacctaaatatttaacgttactagtaactaacgtagtaactctacgttcctcttccttaaccgtaacgtttcccggacccggttagggacctaggttacgttaggactaagtagaaacgtacgtggttccgtcgttcgaacc

SEQ ID NO: 412510 - DNA, 646 bp, Homo sapiens
  misc_feature: GZ8MTXP01BZPYR.11.73.G07.1.454.CMB.2.raw
  modified_base (196)..(196): a, c, t, g, unknown or other
  modified_base (392)..(392): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccactcctccctgtctgcatctatagganacagatcacctatcacttgccgtaggcgagtcaaggactaattaagtaacttatttaaagtggtatcggacagcgaacgaagggaaaccgcccctgacgcctccgtgaacttcgtacgagtcgacgttacctaaagtttacggaaacaggtaccgtacccccgacggtaggttacgaggtacgggtaaaggtcggngttcgggtacgggtaactaacggttaaccctttttacaccttaccaaccctaacgtaccacgccgaacgtccctacggaccgtacggtccgtaagtaaagtaattatttacgactaaacttattaacttacgtacgtaactaacgtatacgtgtaccttcttcctctaactaacgtttccggacccgttaggaccgtgttacggttacgaacgtaagttacggaaacgttacgtagttacggtcttcgtaaccc

SEQ ID NO: 412511 - DNA, 633 bp, Homo sapiens
  misc_feature: GZ8MTXP01AI6L7.11.73.G07.1.454.CMB.2.raw
  modified_base (194)..(194): a, c, t, g, unknown or other
  modified_base (275)..(275): a, c, t, g, unknown or other
  modified_base (280)..(280): a, c, t, g, unknown or other
  modified_base (353)..(353): a, c, t, g, unknown or other
  modified_base (371)..(371): a, c, t, g, unknown or other
  modified_base (378)..(378): a, c, t, g, unknown or other
  modified_base (386)..(386): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagatcaccatcacttgccgaggcgagtcaagactaattaaagaacttatttaaatggtatcggcagcgacgagggaacnccccngacgctctgactctacgatcgcgtactaagtttaggaaacagacggtcccccacggtgtacgagtggaagtgntcgtggacagtacttacnctacacntcagcacncgtcgacagtacctagaaacgtattacgttacgaacctaaacgttattaacgtttaacgttacgtaaactaaacgtaggttaacgttacgtaacgttcccggttcccttacccgttaacccgtttaaccggttttcccggggaccccgttaacgggggtaacccctaagggttaacggttacgggaacctaaacggtaacgtaaaaccggtaaccgttggggttaccgtcgtttaaccggtaacccg

SEQ ID NO: 412512 - DNA, 542 bp, Homo sapiens
  misc_feature: GZ8MTXP01BPFMW.11.73.G07.1.454.CMB.2.raw
  modified_base (151)..(151): a, c, t, g, unknown or other
  modified_base (221)..(221): a, c, t, g, unknown or other
  modified_base (256)..(256): a, c, t, g, unknown or other
  modified_base (297)..(297): a, c, t, g, unknown or other
  modified_base (367)..(367): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtnctccttgttactattttagaaggtgtccatgtggcgtgcacctagtggagtcgtgggggagcttggtacngcctggacggtcctgacgctctcctgtgcagcctntggatacatcttacaaaagtttcgaaatgagcgtgggtccncaggcctccgtgggggaacgggggccgagtggatttcattacatcagtagtagtgtaactccttagactntgcagtactcgtggtaggaacgggccgtattcacatctcagagacaacgacaagatctacttggttctgacaatagaacagctagagagacgagataacgtcttagtttacttagttgtgcgcgagtaacgaacgaaggaaaacggcgggttacggtccgttaaggtttcggggg

SEQ ID NO: 412513 - DNA, 772 bp, Homo sapiens
  misc_feature: GZ8MTXP01E067K.11.73.G07.1.454.CMB.2.raw
tcagcgagagataccacgaccggtgctcgatttagctctacgctcaggggggcaggagtcagtcccaaccaggacacagcatggacatgagggtccctgctcagctcctggggctcctgctgctctgtctctcaggtgccagatgtgacatccagttcgacccagtctccatcctcctgtctgcatctataggagacagagtcaccatcactgccaggcgagtcaggactaattaaagaacttaatttaaagtggtatcggcagcggaccagggaacgcccctggacgctcctgactactacggatcgtaccgttacctaaagtttacgggaaacgaggtaaccgggtaccccccccgaaccggggtagggtttaccgaaagggttagggggtaaaaacggttcggggtaacgttaccgggttacgggggaaaccttacgggtaaacccttttttaacgtacccttacccgaaacccctaataccgaacggccgaaccggcccgttacggaccggaacctacccgttaggaaaagttactttaacgtttacggaaccgtaaaaccttaagtttaaaccttttaacccgtacgggtttaacccaaaaccttaacgggttaatacgggttaacctttaccccggtaccctttccccgttaacgttaaaccggtttttccccgggccccggttaacggggggaacccctaaggggttacggttacgggaacctaagacggtaaaaccgtacggtggttacgcgttaacgtaaccc

SEQ ID NO: 412514 - DNA, 609 bp, Homo sapiens
  misc_feature: GZ8MTXP01DHJRN.11.73.G07.1.454.CMB.2.raw
  modified_base (196)..(196): a, c, t, g, unknown or other
  modified_base (278)..(278): a, c, t, g, unknown or other
tcagcgagagataccacgaccggtgctcgatttagctctacgctcaggggggcagggagtcagtcccaaccaggacacagcatggacatgagggtccctgctcagctcctggggctcctgctgctctgtctctcaggtgccagatgtgacatccagttgacccagtctccatccctcctgtctgcatctatagganacagagtcaccatcacttgccaggcgagtcaaggactaattaagtaactaatttaatggtatcggacagcgacgagggaacncccctgagctctagatacgtacgatcggaccgtaccgtaaagtttacgggaaaacgtacggaccgggttaccccccaccgggtaggttccgtaaggggtgggaaaacggtggtaagtacgtaggggacctaggtaccttttactctacacctatcgactcacgctagctagaccgtagaacgatacttagaactaaactattaacttactgtaaccaagtagtatgtattccgtactcttaactaacgttccgggaccgttaggggaacctagggacgttaggaacctaagttaacgaacgtaacgtcggttaaggtccgttaagtaaccc

SEQ ID NO: 412515 - DNA, 559 bp, Homo sapiens
  misc_feature: GZ8MTXP01B6M8A.11.73.G07.1.454.CMB.2.raw
  modified_base (267)..(267): a, c, t, g, unknown or other
  modified_base (309)..(309): a, c, t, g, unknown or other
  modified_base (339)..(339): a, c, t, g, unknown or other
  modified_base (359)..(359): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcagacattaagaactattaaatggtatcggcagcgacgaggaacncccctgacgctctgatctacgatgcgtaccaatttggaaacngacgtccccacggagtcaggtggaaagtgntcgtgggacagtactttacnctacaccatcagcagcctagcagtcctagaagtatattcgactaactattacttactgtacaaacgtggttaatggtaacttccgttaccttcccttaacgtaaacgttttcccgggaccccgttgggggaaccctaggttaacggttcgggaacctaaggtaacgaaacggtaacgtgggttacgggcttcggtaaccc

SEQ ID NO: 412516 - DNA, 576 bp, Homo sapiens
  misc_feature: GZ8MTXP01DL5B5.11.73.G07.1.454.CMB.2.raw
  modified_base (282)..(282): a, c, t, g, unknown or other
  modified_base (330)..(330): a, c, t, g, unknown or other
  modified_base (367)..(367): a, c, t, g, unknown or other
tcagcgagagataccacgaccggtgctcgatttagctctacgctcaggggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagatcacatcacttgccaggcgagtcaaggactaataaagtaacttatttaaagtggtatcggacagcggaaccaaggggaaacnccccgtgacgcctcgtgactctagatgacgtactaagttacggaaacnggacggtcccccacggtaggtcaggtaggaaagtggntcgagggactagtacctttacctctacactatacagcagcctagactacgactaggaaatattaagtcaactaacttattaactttactagtaactaaacgtattagtctcttacccgttctacgttaacgttacgtttcccgggcccgttagggaccctagacggttggactaacgtaagaacgttaacgtggacgtcttaacgaacc

SEQ ID NO: 412517 - DNA, 678 bp, Homo sapiens
  misc_feature: GZ8MTXP01BM524.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcactagtggagtcgtgggggagcttggtacagccgtggaccggtccctgacgtacctctccgtgtcgcacgcctcgtggatacatacttactaaaagtttcgaaatggacgtcgtcgggtcccgaccgagggtcctccggtagggggaacgggggtccggtaggttggtactttacattacatacgtaaggttaggtagtcggtaaacctccttaagtactgtgcgtagactcgtaggtgggaacgggtccgtattccacctatcctacacggaacacaaccgaccaaagtaacttactacgttcgggtttactagaacaaacgttacgaaacgtacgaccgtagaggaacggaacggtaacggtaacgtaacggtcttttaaacgtttaccgttagttcggtacgttacgccgttaagttaaccggaaacgtaaaagggaaaacgggtccggggttacggtcccggtttaacggggttttcgggggg

SEQ ID NO: 412518 - DNA, 623 bp, Homo sapiens
  misc_feature: GZ8MTXP01A97AG.11.73.G07.1.454.CMB.2.raw
  modified_base (283)..(283): a, c, t, g, unknown or other
  modified_base (397)..(397): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatccctccctgtctgcatctagtaggagacagagtcaccatcacgttgccaggcgagtcaaggactaattaaagaacttaatttaaatggtatcggacagacgacgagggaacncccctgacgtcctctgactctacgatcgacgtacctaatttacggaaactcggaccggtaccccccacggtagtcttacgaggtaggaagtggatcgtagggacagtacttacnctacactatcagcacgctagacacgacctagaacgtattacgttacggaactaaacttattacgttacgtacgtaacgtaaacgtacgtagtgtacgttccgttccttaacccttaacgttaaccggttttcccgggcccgttaacggggtacccttaagggttacggttacggaaacgtacgttaaacggtaaaccggtaggttacggtaacggttcgtaaccgg

SEQ ID NO: 412519 - DNA, 654 bp, Homo sapiens
  misc_feature: GZ8MTXP01CI37F.11.73.G07.1.454.CMB.2.raw
  modified_base (137)..(137): a, c, t, g, unknown or other
  modified_base (198)..(198): a, c, t, g, unknown or other
  modified_base (436)..(436): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtnccagatgtgacatccagttcgacccagtcctccatccctccctgtctgcatctagtagganacagagtcaccatcactgaccgaggcgagtcgaaggactaagttaaagtaaacttaatttaaagtggtagtaccggacacggaccggaaccgaacgggaaaccgccccgtaggacgtcctaccgtagacttcgtacggtactcgtaccgtacctaaagttacggaaacacggtacggtacccccccgaccggtaggtcgaggtaggtaaagtggcgtgtacgggactacgtacttacnctcaccagtcacgtcacgtcccgtgaccgagtaccgaggtaaatagttacgtacgaacgtaaacttagtttacgtttaacctaggtaaccctaaagtacgttatacgtacttccgtcctaccgttcgtaacggtttcccggacccgttagggaaacctggggacgttaccggaagtaagaacggtaaacggtaccgttggcggtaaccttcggaaccc

SEQ ID NO: 412520 - DNA, 586 bp, Homo sapiens
  misc_feature: GZ8MTXP01A2663.11.73.G07.1.454.CMB.2.raw
  modified_base (194)..(194): a, c, t, g, unknown or other
  modified_base (279)..(279): a, c, t, g, unknown or other
  modified_base (364)..(364): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcactgccaggcgagtcaaggactaattaaagaacttaatttaaatggtatcgacagacgaacgaagggaacnccccgtgacgtctctgactctacgatcgcgtactaagttaggaaacagacggtacccccacggtagttcgaggtaggaaagtggngtcgtagggactacgtactttacgctacactagtacgacgcacgccgtagcctaacgccgtagaacgtatattacgaactaactagttacttacgtagtaaccaacgtagttatcgtaacttccgttacctccgttaacttaacggtttcccgggacccgttagggaaccgaggttacgttcggaactaagtacgaacgtacgtggttacgtcgttcgaacc

SEQ ID NO: 412521 - DNA, 641 bp, Homo sapiens
  misc_feature: GZ8MTXP01EI91U.11.73.G07.1.454.CMB.2.raw
  modified_base (197)..(197): a, c, t, g, unknown or other
  modified_base (457)..(457): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccactccctcctgtctgcatctataggganacagatcacctatcacttcgccgaggcaagtcgaaaggacttaaattaaggtaacttaagtttaaagtggtaatcggacaggaccgaacgaacggggaaactcccaggacgctaccgtagtactacgtacgtacgtcgtaccgttaactaagtttacggaaacgtacggaccgttaccccccgacgggtacggtttacgaagggtggaaaacgggtggtaacgtcggtaacgggaactacggtacctttacgctacaccngtacacggcacggcctaggacctagtaccgtagaaacgtattaagttacaactaaactatttactacgtataaccgaagtagtgtacgtattcctctcctaacgttcggttcccggacggttgggaacctaagggcggttacacgtaagtacgtaaaccgtaagtggttcgtaacttggaaccc

SEQ ID NO: 412522 - DNA, 666 bp, Homo sapiens
  misc_feature: GZ8MTXP01D2FD6.11.73.G07.1.454.CMB.2.raw
  modified_base (152)..(152): a, c, t, g, unknown or other
  modified_base (222)..(222): a, c, t, g, unknown or other
  modified_base (296)..(296): a, c, t, g, unknown or other
tcagcgagagataccacgaccggtgctcgatttagctctacgctcagggggatctcagagaggtgccttagccctggattccaaggcatttccacttggtgatcagcactgaacacagaggactcaccatggagttggggctgtgctgggtnctccttgttactattttagaaggtgtccactgtggcgtgcacctagtggagtcgtgggggagcttggacngcctgcacggtcctgagctctcctgtgcagcctctggatacattctactaaagttcgaaatgagcgtggggccnccgaggcctaccggtgggggaacgggccggtagtggtatttcgaatacataccgaggtagtaggtacgtaacctaaccttgtaactatcggacaagtactagtcggtagtaacggggacttacttcaaccgtattcctaacgaacgaacggaaccaaacgaaccaaggtaaacttcctaacggtttcgttttccaagtaccgtaaagtacgtaaacaggtacccgttgggaaaggaacggaacggtaagggtaaacgttaacgggttcttaaacgtttttacgtagttttgggacgttcggttacgaaaggttacccgaaacggaaaaggaaaaccgggggttcggttaacgggttcccgtttaaggggg

SEQ ID NO: 412523 - DNA, 683 bp, Homo sapiens
  misc_feature: GZ8MTXP01EYKJG.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactatttagaagtgtccactgtggctgcaccgtagtggagtcgtgggggaggcttggtacagtcctggaccggtccctgagaccttctcctgtgcagcctctggaatacatacttactaaaagtttcgaaatgagtcgtcgggtcccgccaggctccggagggggaacgggacgggtaccgggttaggtaggttactttacgactactataccgtaaggttaagttaaggtacgtaaacccttaactttaactaacttatcgactacgtacttacggtagggtacggaacggtaccttactaccaccgtacttcctaaccgaagaacgaaacccaaacggtacctaaaaggttactactaacggttcttacgaacgaactaaagtacaaccgagtaccgagaaacggaacggacggtaagtaacgttaacggttcttaagttttacgtaagttcgcgaccgttactaaggaccctaaagggaaaaaggtaacggggttccggttaacggttcgtttaaggggg

SEQ ID NO: 412524 - DNA, 596 bp, Homo sapiens
  misc_feature: GZ8MTXP01AID31.11.73.G07.1.454.CMB.2.raw
  modified_base (304)..(304): a, c, t, g, unknown or other
  modified_base (366)..(366): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccactccctccctgtctgcatctagtaggaggcagagtcacatcactgccgaggcgagtcaggactaattaaagtaacttaagttaatggtatcggacagcgaacgaggaacgccctgacgtctctgactctacgntcgacgtactaagttaggaaactcgacggtacccccacggtaggtacgaggtagaaagtggngtcgtagggactacgtacttacgtactacactacgtacacgtcgaccgtcgtacgacacgtacgtacgtaagtaacttagtacaactaaacttattaacgttacgtacgtaactaacgtagtatcgtaacttccgtacctcctaacgttaaccgttcccggtaccgttacggaccgtaagttacggagactaaggtaacgaacgtacgtggttcgtaacgttcgtaaccc

SEQ ID NO: 412525 - DNA, 706 bp, Homo sapiens
  misc_feature: GZ8MTXP01B7M05.11.73.G07.1.454.CMB.2.raw
  modified_base (277)..(277): a, c, t, g, unknown or other
  modified_base (300)..(300): a, c, t, g, unknown or other
  modified_base (383)..(383): a, c, t, g, unknown or other
  modified_base (414)..(414): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatcctcctgtctgcatctataggagacagacgtcactatcacttgccaggcagtacaggactaattaagaacttatttaaagtggtatcggcaagcgaccgaggaacnccctgagtcctctgatctacgtntgtcggtacctaagtttacggaaacacggtacggtacccccccgaacggttacgggttcaacgggttagggaaagttcggggnttcggacggggtaaccacggttacctttacncgtaccaaccgtagtaacggctacgaccttgacgaagtccgtaaggaaatattaacgttacgaactaaacgtaactttacgttaacgtctaaaccgtaaaccgtgttaaacgttacgtaaccgtttcccggttacccttaccccgtttccgtaaaacgggtttttcccccggaaaccccgggtttggggaaaccccttaagggggcggtttaaaccgggacttaaaacggggttccgaaaaacgggttcccgtggggtaaccgggttcccttaacggaaccctttaacccgg

SEQ ID NO: 412526 - DNA, 493 bp, Homo sapiens
  misc_feature: GZ8MTXP02IJSGQ.11.73.G07.1.454.CMB.2.raw
  modified_base (312)..(312): a, c, t, g, unknown or other
  modified_base (419)..(419): a, c, t, g, unknown or other
tcagcgagagataccacgaccggtgctcgatttagctctacgctcatggggcaggagtcagtcccaaccaggacacagcatggacatgagggtccctgctcagctcctggggctcctgctgctctgtctctcaggtgccagatgtgacatccagttgacccagtctccatccctcctgtctgcatctataggagacagagtcaccatcacttgccaggcgagtcaggacattaagaactatttaaatggtatcggcagcgaccagggaaagcccctgagctcctgatctacgatgcgtccaatttggaaacngacggtcccaccgaggttcagtggaagtgggatcgtggggacagtactttactctcatatcagcagcctgcagcctagaagatattgacaacatattactgtacaanagtaatgaatcgtctcctacaatttccggcctagggaccagcgtaggaacagtacgaaacgaactgtcggctcg

SEQ ID NO: 412527 - DNA, 244 bp, Homo sapiens
  misc_feature: GZ8MTXP02GY1HV.11.73.G07.1.454.CMB.2.raw
  modified_base (242)..(244): a, c, t, g, unknown or other
tcagcgagagataccacgaccggtgctcgatttagctctacgctcagggtcttcgtggctcacgtccaccaccacgcatgtgacctcaggggtccgggagatcatgagggtgtccttgggtttggggaagaggaagactgacggtcccccaggagttcaggtgctgggcacagcggccctgggctgcctggtcaaggactacttccgtatctctcgctgagcgggctggcaaggcgcatagnnn

SEQ ID NO: 412528 - DNA, 472 bp, Homo sapiens
  misc_feature: GZ8MTXP02IKT83.11.73.G07.1.454.CMB.2.raw
  modified_base (335)..(335): a, c, t, g, unknown or other
tcagcgagagataccacgaccggtgctcgatttagctctacgctcaggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcagtcaggacattaagaactattaaatggtatcggcagcgacaggaaagcccctgagctcctgatctacgatgcgtccaatttggaaacagaggtccccacgagttcagtgaagtggntctgggacagacttactctcacatcagcagcctgcagcctagaagatattgacaaacatattactagtcaacagtaatgatcgtctctcaatttcgcctgggaccagacgtgacaagtgaaacgactgtcggctgac

SEQ ID NO: 412529 - DNA, 492 bp, Homo sapiens
  misc_feature: GZ8MTXP02H6IR8.11.73.G07.1.454.CMB.2.raw
  modified_base (256)..(256): a, c, t, g, unknown or other
  modified_base (336)..(336): a, c, t, g, unknown or other
  modified_base (355)..(355): a, c, t, g, unknown or other
  modified_base (415)..(415): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattggtatcggnagcgacaggaagcccctgagctcctgatctacgatgcgtccaatttggaaacagacgtccccacgaggtcagtggagtgntctgggacagtactttacnctcaccatcagcagcctgcagcctagagatattgacaactatattactgtacaacagtangtactcgtctcctactaactttccggccctgggacctaggagtcggacaagtacgaaaacgtactggtcggctgacc

SEQ ID NO: 412530 - DNA, 487 bp, Homo sapiens
  misc_feature: GZ8MTXP02HLOPA.11.73.G07.1.454.CMB.2.raw
  modified_base (356)..(356): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattgtatcggcagcgaccagggaaagcccctgagctcctgatctacgatgcgtccaatttgaaacagacgtccccacgagttcagtggaagtgatctgggacagactttacnctcacatcagcagcctgcagcctagaagatattgacaaactatattactgtacaacagtatgatcgtctcctactaactttcggcccttagggaccagagtggacaagtagaaacgactgtacggctgacc

SEQ ID NO: 412531 - DNA, 497 bp, Homo sapiens
  misc_feature: GZ8MTXP02GOFZA.11.73.G07.1.454.CMB.2.raw
  modified_base (360)..(360): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattggtatcggcagcgaccagggaaagcccctgagctcctgatctacgatgcgtcaatttggaaacagagtccccacgagttcagtggaagtggatcgtggggacagtactttacnctcaccatcagcagcctgcagcctagaagatattgactaactatattactagtacaactagtatgatcgtctcctacatttccggccttagggaccaggacgtggactaagtacgaaacgtacgtgtcggactgacc

SEQ ID NO: 412532 - DNA, 481 bp, Homo sapiens
  misc_feature: GZ8MTXP02JXBYT.11.73.G07.1.454.CMB.2.raw
  modified_base (340)..(340): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattggtatcggcagcgaccagggaaagcccctgagctcctgatctacgatgcgtccaatttggaaacagaggtccccacgagtcagtggaagtggntctgggacagactttactctcaccatcagcagcctgcagcctgaagatattgcaacatattactgtcaacagtatgatcgtctcctcaatttcggccctgggaccagacgtggacaagtagaaacgactgtacggctgacc

SEQ ID NO: 412533 - DNA, 486 bp, Homo sapiens
  misc_feature: GZ8MTXP02IIKC2.11.73.G07.1.454.CMB.2.raw
  modified_base (325)..(325): a, c, t, g, unknown or other
  modified_base (358)..(358): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagagtccccacgngttcagtggaagtgatctgggacagactttacnctcaccatcagcagccctgcagcctgaagatattgacaacatattactgtacaaacagtatgatcgtctcctctaaatttcggccctagggaccagaacgtggacaagtgaaacgactgcggctgacc

SEQ ID NO: 412534 - DNA, 488 bp, Homo sapiens
  misc_feature: GZ8MTXP02JML6J.11.73.G07.1.454.CMB.2.raw
  modified_base (331)..(331): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacataagaactattaaatggtatcggcagcgaccaggaaagcccctgagctcctgatctacgatgcgtccaatttgaaacagagtccccacgagtcagtgagtgntctgggacagactttactctcaccatcagcagcctgcagcctgaagataattgacaacatattactgtacaaactagtatgtatcgtctcctactaactttccggcccgtagggaccacggagtggaactaagtacgaaacgaactgtacgctgacc

SEQ ID NO: 412535 - DNA, 487 bp, Homo sapiens
  misc_feature: GZ8MTXP02ING5Y.11.73.G07.1.454.CMB.2.raw
  modified_base (268)..(268): a, c, t, g, unknown or other
  modified_base (335)..(335): a, c, t, g, unknown or other
  modified_base (356)..(356): a, c, t, g, unknown or other
  modified_base (415)..(415): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctccctgtctgcatctataggagacagagtcaccatcacttgccaggcagtcaggacattaagaactattaaatgtatcggcagcgacagggaaancccctgagctcctgatctacgatgcgtccaatttgaaacagagtccccacgagttcagtggaagtgntctggggacagtacctttacnctcaccatcagcagcctgcagcctagaagatattgacaaactatattactagtccaaanagtatgattcgtctctcaatttcggccttgggaccagacgtggacaagtacgaaacgactagtcggctgacc

SEQ ID NO: 412536 - DNA, 511 bp, Homo sapiens
  misc_feature: GZ8MTXP02G25FD.11.73.G07.1.454.CMB.2.raw
  modified_base (284)..(284): a, c, t, g, unknown or other
  modified_base (428)..(428): a, c, t, g, unknown or other
tcagcgagagataccacgaccggtgctcgatttagctctacgctcagggggcagcagtcagtcccaaccaggacacagcatggacatgagggtccctgctcagctcctggggctcctgctgctctgtctctcaggtgccagatgtgacatccagttgacccggtctccatcctccctgtctgcatctataggagacagagtcaccatcacttgccaggcgagtcaggacataagaactattaaatgtatcggacagcgaccgagggaaacgcccctgagctccngactctacgatcgacgtacctaagttaggaaacaggacgtcccccacgtagttcaggtggaagtggatcgtagggacagtacttactctacacatcagcagctgcagctagaagtatatcgactaactattatactagtacaanagtatagattcgtactctactacgttccgacccgtggaaccagacgtagaactaagtacgaaacgtactggacgtctacgacc

SEQ ID NO: 412537 - DNA, 517 bp, Homo sapiens
  misc_feature: GZ8MTXP02INIPH.11.73.G07.1.454.CMB.2.raw
  modified_base (359)..(359): a, c, t, g, unknown or other
tcagcgagagataccacgaccggtgctcgatttagctctacgctcaggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatggtatcggcagcgaccagggaaagcccctgagctcctgatctacgatgcgtccaatttggaaacagagtcccccacgagttcagtggaagtggatcgtgggacagtactttacnctacaccatcagcagccctgcagcctagaagatattagacaaactataattacagtacaaactagtaatgtaattcgtacttccctctaaacttttccggacccgttaggggaccctaggacgtggaccaagtagaaaacgtactgtacggctagacc

SEQ ID NO: 412538 - DNA, 487 bp, Homo sapiens
  misc_feature: GZ8MTXP02IU0FG.11.73.G07.1.454.CMB.2.raw
  modified_base (337)..(337): a, c, t, g, unknown or other
  modified_base (355)..(355): a, c, t, g, unknown or other
tcagcgagagataccacgaccggtgctcgatttagctctacgctcaggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtcaatttgaaacagaggtccccacgagttcagtgaagtgntctgggacagactttacnctcaccatcagcagcctgccagcctgaagatattgcaaacattattactgtacaacagtatgatcgtctcctcaatttcggcccttgggacctagacgtggacaagtagaaacgaactgtacggctacgacc

SEQ ID NO: 412539 - DNA, 525 bp, Homo sapiens
  misc_feature: GZ8MTXP02FZWHG.11.73.G07.1.454.CMB.2.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatgtatcggcagcgaccagggaaagcccctgagctcctgatctacgatgcgtccaatttggaaacagagtcccccaccgagttcagtggaagtggagtcgtgggacagactttactctcaccatcagcagcctgcagcctgaagatatgacaacatatactgtacaacagtatagatcgtctcctactaagtttccggcccttcggggaacccaggtaaacgttcgggaaaccaaagttacggaaaaccgtaaaccgtggtttacgggcttacggaacccg

SEQ ID NO: 412540 - DNA, 507 bp, Homo sapiens
  misc_feature: GZ8MTXP02F819F.11.73.G07.1.454.CMB.2.raw
  modified_base (363)..(363): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattggtatcggcagcgaccagggaaagcccctgagctcctgatctacgatgcgtccaatttggaaacagaggtcccccacgaggttcagtggaagtggatctggggacagtactttacnctcaccatcagcagccctgcagccctgaaacgatattgcaaacattattactgtacaacagtatgatcgtactcctctaagtttccggcccttggggaccctaggacgtggacaagtacgaaaacgaactgtacggactggacc

SEQ ID NO: 412541 - DNA, 494 bp, Homo sapiens
  misc_feature: GZ8MTXP02HCS7K.11.73.G07.1.454.CMB.2.raw
  modified_base (352)..(352): a, c, t, g, unknown or other
tcagcgagagataccacgaccggtgctcgatttagctctacgctcaggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatgtatcggcagcgacaggaaagcccctgagctcctgatctacgatgcgtccaatttgaaacagagtccccacgagttcagtggaagtggatctgggacagactttacnctcaccatcagcagcctgcagcctgaagatattgacaaactatattactgtacaaacagtatgatcgtactcctactaagtttccggccctagggaccaggacgtggaacaagtagaaaaccgtaactggtacggctagacc

SEQ ID NO: 412542 - DNA, 516 bp, Homo sapiens
  misc_feature: GZ8MTXP02HAXIX.11.73.G07.1.454.CMB.2.raw
  modified_base (349)..(349): a, c, t, g, unknown or other
  modified_base (367)..(367): a, c, t, g, unknown or other
  modified_base (475)..(475): a, c, t, g, unknown or other
  modified_base (478)..(478): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggacggtcctgagactctcctgtgcagcctctggatacatcttacaaaagtttcgaaatgagctggtccgcaggctccgtgggaaggggccgagtggatttcatacatcagtagtagtgtaacnccttgactatgcagactntgtagagggccattcaccatctccagacacaacgccaaagaattcacttgttctagacaaatgaacagcctgagagacgaggatacggcttattactattgtcgacgnganaacgaacgaaacggaaacgcggacgtacgtaggtcggg

SEQ ID NO: 412543 - DNA, 516 bp, Homo sapiens
  misc_feature: GZ8MTXP02H0NRU.11.73.G07.1.454.CMB.2.raw
  modified_base (194)..(194): a, c, t, g, unknown or other
  modified_base (263)..(263): a, c, t, g, unknown or other
  modified_base (365)..(365): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttccaggcagtcaggacattaagaactattaatgtatcgcagcgacaggaacnccctgagctctgactctacgatgcgtacctaagtttaggaaacagacggtacccacccggtaggttcagtagggaagtggatcgtagggacagtactttacnctacaccatcagcagcctgacagccgtagaagtatattgacaaactattaattactgtacaaatagtatgattccgtctccgtactaacgtttccgggcccttagggaccagtacgtagacagtaagaaaccgtaatcgtggactgacaac

SEQ ID NO: 412544 - DNA, 478 bp, Homo sapiens
  misc_feature: GZ8MTXP02HTF6T.11.73.G07.1.454.CMB.2.raw
tcagcgagagataccacgaccggtgctcgatttagctctacgctcagggggcaggagtcagtcccaaccaggacacaacatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattggtatcggcagcgaccagggaaagcccctgagctcctgatctacgatgcgtccaatttggaaacagaggtcccacccgagttcagtggagtggatctgggacagactttatctcaccatcagcagcccagcagcctgaagatatgcaacatatactgtacaacagtatgatcgtctctcaatttcgcctggaccagacgtggacagtaagaaacgaactcgagctgcaacc

SEQ ID NO: 412545 - DNA, 487 bp, Homo sapiens
  misc_feature: GZ8MTXP02HJIOF.11.73.G07.1.454.CMB.2.raw
  modified_base (194)..(194): a, c, t, g, unknown or other
  modified_base (267)..(267): a, c, t, g, unknown or other
  modified_base (362)..(362): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaactattaaatggtatcggcagcgacaggaancccctgagctcctgatctacgatgcgtcctaaatttggaaacagacgtcccccaccgagttcaggtggaagtggatcgtgggacagtactttacnctcacatcagcagctgcagcctgaagattatgacaactatattactgtacaacagtatgatcgtctccttcactttccggcctgggacagacgtgacaagtagaaaaccgtactgacgctagacc

SEQ ID NO: 412546 - DNA, 569 bp, Homo sapiens
  misc_feature: GZ8MTXP02IE6CH.11.73.G07.1.454.CMB.2.raw
  modified_base (251)..(251): a, c, t, g, unknown or other
  modified_base (267)..(267): a, c, t, g, unknown or other
  modified_base (369)..(369): a, c, t, g, unknown or other
  modified_base (377)..(377): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacataagaactattaaatgtatcgnagcgacgagggaaacncccctgagctcctgatctacgatgacgtaccaaagtttaggaaacaggacggtacccccaacgtaggttcaggtggaagtggatcgtaggacagtactttcnctcaccancagcagcctgacacgcctagaaagtattaagttcgactaaactattaatttaccgtagtaccaaatagttaatgtaacttcgtacttacccttacttaaacgttttcccgggacccttagggggaaccctaggtacggttaacggaactaaagttacggaaaaccgtaacgtggtacggacttacggaaccc

SEQ ID NO: 412547 - DNA, 518 bp, Homo sapiens
  misc_feature: GZ8MTXP02GMYNZ.11.73.G07.1.454.CMB.2.raw
  modified_base (364)..(364): a, c, t, g, unknown or other
  modified_base (374)..(374): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttacaaaagtttcgaaatgagctgggtccgccaggctccgtggggaagggccgagtggatttcatacatcagtagtagtggtaacaccttgtactntgcagactcngtgaagggcgattcacatctccagacgacaacgaccaagatcactgttctgacaaatgaacagacctgagagacgagatacggcttattactattgtagcgcgatcgaacgaagaaaacggcggtacggaccgtagttcggggg

SEQ ID NO: 412548 - DNA, 520 bp, Homo sapiens
  misc_feature: GZ8MTXP02I0ZLU.11.73.G07.1.454.CMB.2.raw
  modified_base (354)..(354): a, c, t, g, unknown or other
  modified_base (363)..(363): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggacggtccctgagactctcctgtgcagcctctggatacatcttcaaaagtttcgaaatgagctgggtccgccaggctccgtggggaaggggccggagtggatttcatacatcagtagtagtggtaacncttgtactntgcagactctgtgaagggccgattcaccatctccagagacaacgccaagaattacacttgtttctgacaaatagaacagacctgagagacgaggatacggctatttactattgtgcgcgatcgacaagaaaacgcggtacggaccgtagttcggggg

SEQ ID NO: 412549 - DNA, 537 bp, Homo sapiens
  misc_feature: GZ8MTXP02JSFB7.11.73.G07.1.454.CMB.2.raw
  modified_base (341)..(341): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatggtatcggcagcgacagggaaagcccctgagctcctgatctacgatgcgtccaatttggaaacagacggtccccaccgagttcagtggaagtggntcgtgggacagacttactctcacatcagcagcctgcagccctgaacgtatattgacaacattattactagtacaatacgtatgtactcgtctcctactaacttttccggacccttagggaaccctaggtacggttacggaaccgtaagttaacggaaaaaccggtaacgttacggtacggtaccgttacgaacccg

SEQ ID NO: 412550 - DNA, 521 bp, Homo sapiens
  misc_feature: GZ8MTXP02F03AA.11.73.G07.1.454.CMB.2.raw
  modified_base (298)..(298): a, c, t, g, unknown or other
  modified_base (352)..(352): a, c, t, g, unknown or other
  modified_base (361)..(361): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttacaaaagtttcgaaatgagctgggtccncaggctccgtggggaagggccgagtggatttcatacatcagtagtagtgtaacncttgtactntgcagactctgtgaagggcgattcacatctccagacgacaacgacaagaattacactgtttctgacaaatagaacagctagagagacgagatacggcttattactattgtcgtcgcgataacgaacgaaggaaaacgcggtacggaccgtaggttcgggg

SEQ ID NO: 412551 - DNA, 547 bp, Homo sapiens
  misc_feature: GZ8MTXP02IWXTD.11.73.G07.1.454.CMB.2.raw
  modified_base (273)..(273): a, c, t, g, unknown or other
  modified_base (348)..(348): a, c, t, g, unknown or other
  modified_base (369)..(369): a, c, t, g, unknown or other
  modified_base (376)..(376): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaacncccctgacgctcctgatctacgatgcgtcctaaatttggaaacagacggtcccccacgagttcagtggaagtggntcgtggggacagtactttacnctcaccntcagcagcctgcagcctagaagattattgacaaactattattactgtaacaacagttatagattaccgtctaccttactaaacgttttccggcccttaggggaccctaggtacggttacggaacctaagtaacggaaaacgtaaccgttaggttacggacttacgaacccg

SEQ ID NO: 412552 - DNA, 507 bp, Homo sapiens
  misc_feature: GZ8MTXP02JQ07L.11.73.G07.1.454.CMB.2.raw
  modified_base (334)..(334): a, c, t, g, unknown or other
  modified_base (352)..(352): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcagtcaggacattaagaactattaaattgtatcggcagcgacaggaaagcccctgagctcctgatctacgatgcgtcaatttaggaaacagacgtccccacgagtcagtggagtgntctgggacagactttacnctcaccatcagcagccctagcagcctagaagatatgacaacatattactgtacaacagtatgatctactcctactaatttccggacccgtgggaaccctaggacgttcggaacgtaagtacggaaaacgtaccgtaggtacggcgttacgacccg

SEQ ID NO: 412553 - DNA, 496 bp, Homo sapiens
  misc_feature: GZ8MTXP02J07JU.11.73.G07.1.454.CMB.2.raw
  modified_base (251)..(251): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacattaagaactattaatgtatcgnagcgacaggaagcccctgagctcctgatctacgatgcgtccaaatttgaaacagacggtccccaccgaggttcagtggaagtggatcgtggggacagtactttactctcaccatcagcagcctgcagcctagaagatattgacaacattattactgtacaacgtagtatgatcgtctcctactaatttccggcccttacgggaccagacgtggacaagtacgaaaacgactggtacggctagacc

SEQ ID NO: 412554 - DNA, 533 bp, Homo sapiens
  misc_feature: GZ8MTXP02JQOM2.11.73.G07.1.454.CMB.2.raw
  modified_base (362)..(362): a, c, t, g, unknown or other
  modified_base (371)..(371): a, c, t, g, unknown or other
  modified_base (484)..(484): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggacggtccctgagactctcctgtgcagcctctggatacatcttacaaagtttcgaaatgagctgggtccgcaggctccgtggggaacggggccggagtggatttcatacatcagtagtagtggtaacacttgactntgcagactntgtggaagggccgattccaccatctccagacgacaacgaccaagattcacttgttctgacaaatagaacagcctgagagacgagatacggacttattactagttgtacgtcgngactaacgaacaaggaaaacggcggtacggtaccgtaggtttacggggg

SEQ ID NO: 412555 - DNA, 547 bp, Homo sapiens
  misc_feature: GZ8MTXP02I60E2.11.73.G07.1.454.CMB.2.raw
  modified_base (279)..(279): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatccctcctgtctgcatctataggagacagagtcacatcacttgccaggcgagtcaaggactaattaaagaacttaattaaagtggtatcggacagacgacgaaggaacnccctgacgctctgatctagatgcgtacctaagttacggaaacacgacggtacccccacggtaggttacaggtaggaagtggagtcgtagggactagtacctttactactacacatacagcacgctacgcagtcgtaagaatatagtacaactaaactattacttactacgtaacaagtagtatagtacttctactcctactacgttccggacccgtaggaccagtaggtacgacgaagtaacgaaacgtacgtggtacgacgtcaacc

SEQ ID NO: 412556 - DNA, 530 bp, Homo sapiens
  misc_feature: GZ8MTXP02INK56.11.73.G07.1.454.CMB.2.raw
  modified_base (413)..(413): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattggtatcggcagcgaccaagggaaacgcccctgagctcctgatctacgatgcgtacaatttggaaacagacggtcccccaccggagttcaggtggaagtggatcgtgggacagactttactctcacatcagcagcctgcagcctagaagatatgacaacatattacngtacaacagtatgatcgtctccctacgtaacgtttccggcccgtagggaacccaggtaaggttcggaaaccgtaagtacggaaaaaccgtaacgtcggtacgggcttacggaacccc

SEQ ID NO: 412557 - DNA, 502 bp, Homo sapiens
  misc_feature: GZ8MTXP02HRKWP.11.73.G07.1.454.CMB.2.raw
  modified_base (193)..(193): a, c, t, g, unknown or other
  modified_base (350)..(350): a, c, t, g, unknown or other
  modified_base (406)..(406): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctatagganacagagtcaccatcacttgccaggcagtcaggacataagaactattaaatgtatcggcagcgaccaggaaagcccctgagctcctgatctacgatgcgtccaatttgaaacagacgtccccacgagtcagtggaagtgatctggacagtactttacnctcacatcagcagcctgcagcctgaagatattgacaactattattactagtacaanagtatgaatcgtctcctactactttaccggccttacggggaccacgagttcgggacaattacggaaaacgtaaacgtgttacggcttacggaaccc

SEQ ID NO: 412558 - DNA, 501 bp, Homo sapiens
  misc_feature: GZ8MTXP02I8JDH.11.73.G07.1.454.CMB.2.raw
  modified_base (194)..(194): a, c, t, g, unknown or other
  modified_base (359)..(359): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacataagaactattaatgtatcggcagcgacaggaaacgcccctgagctcctgatctacgatgcgtccaatttggaaacagacggtcccccacgaggttcagtggaagtggatctggggacagtactttacnctcaccatcagcagcctagcagcctagaagatattcgacaactatattactgtacaacagtatgatcgtctcctactaatttccggcccttagggaccctaggacgtggacaagtacgaaaacgtactggtacggactgacc

SEQ ID NO: 412559 - DNA, 524 bp, Homo sapiens
  misc_feature: GZ8MTXP02H6O3D.11.73.G07.1.454.CMB.2.raw
  modified_base (341)..(341): a, c, t, g, unknown or other
  modified_base (361)..(361): a, c, t, g, unknown or other
  modified_base (388)..(388): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattgtatcggcagcgaccagggaacgcccctgacgctcctgatctacgatgcgtcaatttggaaacagacggtccccacgtagttcagtggaagtgntcgtgggactagactttacnctcaccatcagcagctgcagcctaganatatgacaactatattactgtacaacagttatgtactcgtcttcctactaacgttttcccggcccgttacggggaccctaagggacgttcggacctaagtacggaaaacgtacgttacggtacggcttacggaccc

SEQ ID NO: 412560 - DNA, 517 bp, Homo sapiens
  misc_feature: GZ8MTXP02JLN6Q.11.73.G07.1.454.CMB.2.raw
  modified_base (339)..(339): a, c, t, g, unknown or other
  modified_base (357)..(357): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattggtatcggcagcgaccagggaaagcccctgagctcctgatctacgatgcgtccaatttgaaacagagtccccacgaggttcagtggagtggntcgtggacagactttacnctcacatcagcagcctgcagcctagaagatattgacaacatattactgtacaacagttatgattacgtctccttactaacgtttccggccctaggggaccctaggacggttacggacctaagtacggaaaacgtaacgtaggtacggacgttacgacccg

SEQ ID NO: 412561 - DNA, 526 bp, Homo sapiens
  misc_feature: GZ8MTXP02JE559.11.73.G07.1.454.CMB.2.raw
  modified_base (348)..(348): a, c, t, g, unknown or other
  modified_base (368)..(368): a, c, t, g, unknown or other
  modified_base (405)..(405): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaatggtatcggcagcgaccagggaaacgcccctgagctcctgatctacgatgcgtaccaatttaggaaacaggacggtcccccaccgaggttcaggtggaagtggntcgtgggacagtactttacnctacaccatcagcagcctgcagcctagaagatagttnactaacattattactagtacaatagtatgactcgtcctcctactaacgtttccggacccgtacgggaccaggtacggtcggaactaagtaacgaaaacgtacgtcggtacgtcgtgaaccc

SEQ ID NO: 412562 - DNA, 498 bp, Homo sapiens
  misc_feature: GZ8MTXP02JGVTZ.11.73.G07.1.454.CMB.2.raw
  modified_base (332)..(332): a, c, t, g, unknown or other
  modified_base (358)..(358): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacataagaactattaatggtatcggcagcgacagggaaagcccctgagctcctgatctacgatgcgtccaatttggaacagacgtccccacgagtcagtgagtgntcgtgggacagactttactctcaccntcagcagccctgccagcctagaagatattagacaaactataagttactgtacaaacgagtatgatcgtctcctactaacgtttccggccctagggaccctagacgtggacaagtacgaaaacgacgtgtcggactgaccc

SEQ ID NO: 412563 - DNA, 506 bp, Homo sapiens
  misc_feature: GZ8MTXP02FTVHT.11.73.G07.1.454.CMB.2.raw
  modified_base (194)..(194): a, c, t, g, unknown or other
  modified_base (423)..(423): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaactatttaaatggtatcggcagcgacaggaaagcccctgagctcctgatctacgatgcgtcaatttggaaacagaggtccccacgagttcagtggaagtggatcgtagggacagtactttactctcaccatcagcagccctgcagcctagaaagattattgacaaacattatttaactgtaccaaanagttatgaatcgtctacctctaacgtttccggaccctggggaccctagacgtggacaagtaggaaacgactgtacggctgacc

SEQ ID NO: 412564 - DNA, 568 bp, Homo sapiens
  misc_feature: GZ8MTXP02GR54I.11.73.G07.1.454.CMB.2.raw
  modified_base (194)..(194): a, c, t, g, unknown or other
  modified_base (267)..(267): a, c, t, g, unknown or other
  modified_base (412)..(412): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaactattaaatgtatcgcagcgacagggaacnccctgacgctcctgactctacgatgccgtacctaaattaggaaaacaggaaccggtcccccaaccggtaggttacaaggtaggaaggtggatcgtaggggaactacgtactttactctacaaccatcagcagctgcagctagaanatatgacaactatattactgaacctaagtagtactaggacttcgtactaccgttacttaaacgtttcccggacccgttaggggaaaccctaggaacggtcggaaacctaaggttaaacgaaaacggtaaacgttcggacggtaccttacggaaccc

SEQ ID NO: 412565 - DNA, 508 bp, Homo sapiens
  misc_feature: GZ8MTXP02GNN6W.11.73.G07.1.454.CMB.2.raw
  modified_base (357)..(357): a, c, t, g, unknown or other
  modified_base (377)..(377): a, c, t, g, unknown or other
tcagcgagagataccacgaccggtgctcgatttagctctacgctcagggggcaggagtcagtcccaaccaggacacagcatggacatgagggtccctgctcagctcctggggctcctgctactctgtctctcaggtgccagatgtgacatccagttgacccagtctccatcctccctgtctgcatctataggagacagagtcaccatcacttgccaggcgagtcaggacattaagaactattaatgtatcggcagcgacaggaagcccctgagctcctgatctacgatgcgtccaatttggaaacagacggtccacccgaggttcagtggaagtggatcgtgggacagtactttacnctcaccatcagcagcctgcngcctagaagatattagacaaacattattactgtacaaacagtatgactcgtctcctactaacgtttccggccctcggggaccaggagtcggaacagtaagaaaacgtaacgtgtacggctacggctaaccg

SEQ ID NO: 412566 - DNA, 480 bp, Homo sapiens
  misc_feature: GZ8MTXP02H89IW.11.73.G07.1.454.CMB.2.raw
  modified_base (352)..(352): a, c, t, g, unknown or other
  modified_base (408)..(408): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattgtatcggcagcgaccaggaaagcccctgagctcctgatctacgatgcgtcaatttggaaacagagtccccacgagttcagtgaagtgatctggacagactttacnctcaccatcagcagcctgcagcctgaagatattgcaaacataattactagtacaanagtatgatcgtctacctctaatttccggccctgggaccagacgtgacaatacgaaaacgactgtggctgacc

SEQ ID NO: 412567 - DNA, 517 bp, Homo sapiens
  misc_feature: GZ8MTXP02JVQ6S.11.73.G07.1.454.CMB.2.raw
  modified_base (255)..(255): a, c, t, g, unknown or other
  modified_base (270)..(270): a, c, t, g, unknown or other
  modified_base (309)..(309): a, c, t, g, unknown or other
  modified_base (336)..(336): a, c, t, g, unknown or other
  modified_base (340)..(340): a, c, t, g, unknown or other
  modified_base (356)..(356): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatggtatcggnagcgacagggaaacncccctgagctcctgatctacgatgcgtacaattgaaacngacgtccccacgagtcagtggaagtgntcgngggacagtactttacnctcaccatcagcagcctgcagctagagatatgactaaacattaattactatacaaactagtatgtattcgtctacctactaaacgtttccgggccccgttaggggaaccaggacggttacggaaccaagtaacggaaaacgactggtacggctacgaaccc

SEQ ID NO: 412568 - DNA, 521 bp, Homo sapiens
  misc_feature: GZ8MTXP02GC3ZU.11.73.G07.1.454.CMB.2.raw
  modified_base (297)..(297): a, c, t, g, unknown or other
  modified_base (361)..(361): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggacggtccctgagactctcctgtgcagcctctggatacatcttacaaaagtttcgaaatgagctgggtccncaggctccgtggggaagggccgagtggatttcatacatcagtagtagtgtaacaccttgtactntgacagactcgtgtgaacgggcgattccacatctccagagacaacgaccaagattcacttgttctgacaatagaacagacctagagagacgagagtacggacttattactattcgtgtcgacgataacgacaagaaaacgcggtacgccgtagttcgggg

SEQ ID NO: 412569 - DNA, 533 bp, Homo sapiens
  misc_feature: GZ8MTXP02F0ZWW.11.73.G07.1.454.CMB.2.raw
  modified_base (298)..(298): a, c, t, g, unknown or other
  modified_base (356)..(356): a, c, t, g, unknown or other
  modified_base (365)..(365): a, c, t, g, unknown or other
  modified_base (375)..(375): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttacaaaagtttcgaaatgagctgggtccnccaggctccgtggggaaggggccggagtggatttcatacatcagtagtagtggtaacncttgtactntgcagtactntgtgaagggccgattccaccatctccagacgacaacgaccaaagaattacacttgtttctgacaaatagaacagctgagagacgagatacggacttatttactattgtagcgcgagtaacgacaaagaaaacggcggtacggaccgtaggttcggggg

SEQ ID NO: 412570 - DNA, 518 bp, Homo sapiens
  misc_feature: GZ8MTXP02JQR9K.11.73.G07.1.454.CMB.2.raw
  modified_base (297)..(297): a, c, t, g, unknown or other
  modified_base (354)..(354): a, c, t, g, unknown or other
  modified_base (362)..(362): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggacggtccctgagactctcctgtgcagcctctggatacatcttacaaaagtttcgaaatgagctgggtccnccaggctccgtggggaaggggccggagtggatttcatacatcagtagtagtgtaacncttgactntgacagactctggtagaagggccgatcacatctccagagacaacgacaagatcatgttctgacaatagaacagcctagagagacgagatacggctattactattgtgcgtcgataacgaacaagaaaaacggcggtacggaccgtaggttcggggg

SEQ ID NO: 412571 - DNA, 496 bp, Homo sapiens
  misc_feature: GZ8MTXP02GDMWU.11.73.G07.1.454.CMB.2.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaatggtatcggcagcgaccagggaaagcccctgagctcctgatctacgatgcgtccaatttggaaacagaggtcccccacgagttcagtggaagtggatctgggacagactttactctcaccatcagcagcctgcaagcctgaagatattgacaacatattactgtacaacagtatgatcgtctcctacaactttcggacctcggaccagtacgtggtacgaattacgaaaacgtactagtggcttaggacc

SEQ ID NO: 412572 - DNA, 524 bp, Homo sapiens
  misc_feature: GZ8MTXP02JWB9O.11.73.G07.1.454.CMB.2.raw
  modified_base (273)..(273): a, c, t, g, unknown or other
  modified_base (316)..(316): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattggtatcggcagcgaccgagggaaacncccctgagctcctgatctacgatgcgtaccaaatttggaaacngacggtcccccacgaggttcaggtggaagtgggatcgtgggactagtacttactctacaccatcagcagcctgcagcctagaagattatgactacattattactgtactaacagtatgtatcgtactcccgtactaacgtttccggccgttacggggacctaggacggttagactaagtagaaaaccggtactggtacggctacgacc

SEQ ID NO: 412573 - DNA, 492 bp, Homo sapiens
  misc_feature: GZ8MTXP02FVYVT.11.73.G07.1.454.CMB.2.raw
  modified_base (310)..(310): a, c, t, g, unknown or other
  modified_base (363)..(363): a, c, t, g, unknown or other
  modified_base (421)..(421): a, c, t, g, unknown or other
tcagcgagagataccacgaccggtgctcgatttagctctacgctcaggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatgtatcggcagcgaccagggaaagcccctgagctcctgatctacgatgcgtccaaatttggaaacngacggtcccccacgaggttcagtggaagtgggatcgtgggacagtactttacnctcaccatcagcagcctgcagcctgaaagatattgacaacattattactgtaccaaanagtatgatcgtctcctactaatttccggccctgggaccagacgtgacaagtacgaaacgatgtggactgac

SEQ ID NO: 412574 - DNA, 515 bp, Homo sapiens
  misc_feature: GZ8MTXP02GAWM5.11.73.G07.1.454.CMB.2.raw
  modified_base (298)..(298): a, c, t, g, unknown or other
  modified_base (353)..(353): a, c, t, g, unknown or other
  modified_base (371)..(371): a, c, t, g, unknown or other
  modified_base (416)..(416): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagactctcctgtgcagcctctggatacatcttacaaaagtttcgaaatgagctgggtccncaggctccgtggggaagggccgagtggatttcatacatcagtagtagtggtaacncttgtactatgcagactntgtgaaggccgattcacatctcagagacacgcaagatcatcgttngacaaatgaacagctagacgagacgagatacggcttattactatgtacgtcgacgagtaacgaacaaagaaaacgcggtacgaccgttaggttcggggg

SEQ ID NO: 412575 - DNA, 493 bp, Homo sapiens
  misc_feature: GZ8MTXP02GAP6A.11.73.G07.1.454.CMB.2.raw
  modified_base (265)..(265): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacataagaactattaatgtatggcagcgacagggaaancccctgagctcctgatctacgatgcgtcctaaatttggaaacagacggtccccacgagtcagtggaagttggatctgggacagactttacgtctcacatcagcagcctgcagcctgaagatattgacaacatattactagtacaatagtatagatcgtctcctctaagtttccggacccttggggacccaggacgtggaactaagtagaaacgactggtaggctgacc

SEQ ID NO: 412576 - DNA, 523 bp, Homo sapiens
  misc_feature: GZ8MTXP02HOGGN.11.73.G07.1.454.CMB.2.raw
  modified_base (270)..(270): a, c, t, g, unknown or other
  modified_base (311)..(311): a, c, t, g, unknown or other
  modified_base (341)..(341): a, c, t, g, unknown or other
  modified_base (361)..(361): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatggtatcggcagcgaccagggaaancccctgagctcctgatctacgatgcgtccaatttggaaacngacgtcccccacgagttcagtggaagtggntcgtgggacagtactttacnctcaccatcagcagcctgcagcctagacgatattgacaactatattactgtacaactagtatgattcgtctaccttactaaacgtttccggacccttggggaacccaggtacggttacggacctaagttacgaaaacgtaacgtggacggtcttacggaccc

SEQ ID NO: 412577 - DNA, 557 bp, Homo sapiens
  misc_feature: GZ8MTXP02JP198.11.73.G07.1.454.CMB.2.raw
  modified_base (194)..(194): a, c, t, g, unknown or other
  modified_base (272)..(272): a, c, t, g, unknown or other
  modified_base (352)..(352): a, c, t, g, unknown or other
  modified_base (356)..(356): a, c, t, g, unknown or other
  modified_base (373)..(373): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatttcatagganacagagtcaccatcacttgccaggcgagtcaggacattaagaactattaaattggtatcggcagcgacgagggaaacncccctgacgctcctgatctacgatgcgtaccaagtttacggaaacagacggtcccccacgtaggttacaggtggaagtgntcgngggactagtactttacnctacacctatacagcagtcctagcacgtccgtagagtatattgacaactattattactagtacaaactagttactagtacttcgtctacccgttactaacgtttccggacccgttaggggaaccctaggtacggttacggaactaagttaacgaaaacggtactaggtcggtactaggaacccg

SEQ ID NO: 412578 - DNA, 525 bp, Homo sapiens
  misc_feature: GZ8MTXP02I7XCJ.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggacggtccctgagactctcctgtgcagcctctggatacatcttcaaaagtttcgaaattagctgggtccgccaggctcctggggaaggggccggagtgggatttcatacatcagtagtagtgtaacaccttgtactatgcagactctgtagaagggcgattcaccatctcagagacaacgaccaagattcactgtttctgacaatagaacagcctagagagacgagatacggactatttactagttgtagtcgcgactcgaacgaagaaaaacgcggtaggtccgtagtcggggtttgg

SEQ ID NO: 412579 - DNA, 523 bp, Homo sapiens
  misc_feature: GZ8MTXP02IJNIK.11.73.G07.1.454.CMB.2.raw
  modified_base (256)..(256): a, c, t, g, unknown or other
  modified_base (270)..(270): a, c, t, g, unknown or other
  modified_base (361)..(361): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattggtatcggnagcgacagggaaancccctgagctcctgatctacgatgcgtaccaatttgaaacagacggtcccccacgagttcagtggaagtggatctagggacagactttacnctcaccatcagcagcctgcagcctagagatattgacaactatattacagtacaaactagtatagtatcgtactccttcaaacgttttccggacccttcggggaacctaggacgttacggaacaagttacgaaaacgtaaccgtggttacggcttacggaccc

SEQ ID NO: 412580 - DNA, 531 bp, Homo sapiens
  misc_feature: GZ8MTXP02FO0E7.11.73.G07.1.454.CMB.2.raw
  modified_base (353)..(353): a, c, t, g, unknown or other
  modified_base (362)..(362): a, c, t, g, unknown or other
  modified_base (371)..(371): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttacaaaagtttcgaaatgagctgggtccgcaggctccgtggggaaggggccgagtggatttcatacatcagtagtagtgtaacncttgtactntgcagactntgtgaagggcgattcacatctccagacgacaacgccaaagaattacacttagtttctagacaaatagaacagcctgagagacgaggatacggacttatttactattgtcgtcgacgataacgaacgaaagaaaacggcggtacggccgtaggttcggggg

SEQ ID NO: 412581 - DNA, 626 bp, Homo sapiens
  misc_feature: GZ8MTXP02GYUA2.11.73.G07.1.454.CMB.2.raw
  modified_base (258)..(258): a, c, t, g, unknown or other
  modified_base (362)..(362): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctcttgttactattttagaaggtgtccactgtggcgtgcacctagtggagtcgtgggggagcttggtacagcctggacggtccctgagactctcctgtgcagcctcnggatacatcttacaaaagtttcgaaatgagcgtcgggtccgccaggcctccggtaggggaacggggccggagtggtatttcatacatcagtagtagtgtaaacncttagtactatgacagtactcgtaggtacggaaacgggcccgtattacccaccctaactcctacccgaacggaacggaaccaaaccgacccgaaagtaaactttacctaactttcggtttacctagtaactaaaagtacgaaaaccgacgtacctaggaacgaagaacggaaggaacgtaacggtacttaagtttactattcgtcgcgacgactaacgaacgaaaggaaaaacggcgggtacgtaccggttaaggtttcggggg

SEQ ID NO: 412582 - DNA, 517 bp, Homo sapiens
  misc_feature: GZ8MTXP02HCGUM.11.73.G07.1.454.CMB.2.raw
  modified_base (344)..(344): a, c, t, g, unknown or other
  modified_base (363)..(363): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaatgtatcggcagcgaccaggaaacgcccctgagctcctgatctacgatcgcgtccaatttggaaacaggacgtcccccacgagttcaggtggaagtggntcgtggactagactttacnctcacatcagcagcctgcagcctagaacgatattcgacaaactattaacttactacgtacaactagtatagtacttcgtacctccttactacgtttccggcccgtaggaccagacgtggaacaagtacgaaacgtacgtggtacgactacgacc

SEQ ID NO: 412583 - DNA, 511 bp, Homo sapiens
  misc_feature: GZ8MTXP02IYX85.11.73.G07.1.454.CMB.2.raw
  modified_base (250)..(250): a, c, t, g, unknown or other
  modified_base (365)..(365): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacataagactattaatgtatcgnagcgacaggaacgccctgacgctcctgactctacgatcgcgtacctaagtttaggaaacagacggtcccccacgagttcgaggtggaagtggatcgtagggactagtactttacnctcacatcagcagcctgcacgctagagattatacgacaactattattactagtacaactagtatacgtactcgtctacctactacgtttccggccgtaggaccagtacgtggacaagtacgaaacgtacgtcgtacggctacgacc

SEQ ID NO: 412584 - DNA, 480 bp, Homo sapiens
  misc_feature: GZ8MTXP02GOHQS.11.73.G07.1.454.CMB.2.raw
  modified_base (334)..(334): a, c, t, g, unknown or other
  modified_base (352)..(352): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaatggtatcggcagcgaccaggaaagcccctgagctcctgatctacgatgcgtccaatttgaaacagagtccccacgagtcagtgagtgntctgggacagactttacnctcaccatcagcagcctgcagcctgaagatattgacaaacatattactgtacaacagtatgatcgtctcctacaatttccggcctgggaccagacgtggacaagtacgaaacgaactgacggctgacc

SEQ ID NO: 412585 - DNA, 471 bp, Homo sapiens
  misc_feature: GZ8MTXP02I0FWA.11.73.G07.1.454.CMB.2.raw
  modified_base (355)..(355): a, c, t, g, unknown or other
  modified_base (383)..(383): a, c, t, g, unknown or other
  modified_base (393)..(393): a, c, t, g, unknown or other
  modified_base (408)..(408): a, c, t, g, unknown or other
  modified_base (470)..(470): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatgtatcggcagcgaccaggaaacgcccctgagctcctgatctacgatgcgtcaaattggaaacagaggtccccacgagttcagtggaagtggatctgggacagacttacnctcaccatcagcagctgcagcctagaanatatgacaanatattactgtacaanagtatgatcgtctctacaatttcggcctagggaccagagtgacaatgaaaacatgtgacgtnc

SEQ ID NO: 412586 - DNA, 520 bp, Homo sapiens
  misc_feature: GZ8MTXP02HTCXL.11.73.G07.1.454.CMB.2.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattggtatcggcagcgaccagggaaacgcccctgagctcctgatctacgatgcgtacctaaattggaaacaggacggtcccccacgagttcaggtggaagtggatcgtgggacagtacttactctacaccatcagcagcctgcagcctagagtatagttgactaactatattactgtacaacagtatgattcgtcttcctactaacgtttccggccttagggaccaggtacgtaggaacaagtacggaaaacgtacgtaggtcggacttagaaccc

SEQ ID NO: 412587 - DNA, 497 bp, Homo sapiens
  misc_feature: GZ8MTXP02GFSUU.11.73.G07.1.454.CMB.2.raw
  modified_base (361)..(361): a, c, t, g, unknown or other
  modified_base (420)..(420): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatggtatcggcagcgacagggaaagcccctgagctcctgatctacgatgcgtcctaatttggaaacagacggtcccccacgagttcagtggaagtggatcgtgggacagtactttanctcacatcagcagcctgcagcctgaaagatattgactaactataattactagtaccaanagtatgatcgtctctctaatttcggcctagggaccagacgtggacaagtacgaaaacgaacgtgtcggctacgaccg

SEQ ID NO: 412588 - DNA, 514 bp, Homo sapiens
  misc_feature: GZ8MTXP02I5OX7.11.73.G07.1.454.CMB.2.raw
  modified_base (296)..(296): a, c, t, g, unknown or other
  modified_base (357)..(357): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggacagcctgggacggtcctgagactctcctgtgcagcctctggatacatcttacaaaagtttcgaaatgagctgggtccncaggctccgtgggaagggccgagtggatttcatacatcagtagtagtgtaacacttgactntgacagactctgtgaacgggcattcaccatctcagagacaacgaccaagaattacacttgtttctgacaaatagaacagactagagagacgagatacggactattactattgtgtacgcgatcgaacaagaaaacgcggaggtaccgtagttcgggg

SEQ ID NO: 412589 - DNA, 485 bp, Homo sapiens
  misc_feature: GZ8MTXP02FOETW.11.73.G07.1.454.CMB.2.raw
  modified_base (342)..(342): a, c, t, g, unknown or other
  modified_base (356)..(356): a, c, t, g, unknown or other
  modified_base (386)..(386): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagagtccccacgagtcagtgaagtggatcngggacagactttanctcaccatcagcagcctgcagcctgaaagntattgacaacatattactgtacaacagtatgatcgtctcctactaatttcggccctgggaccagagtggtacaatacgaaacgaactgtacggctgacc

SEQ ID NO: 412590 - DNA, 538 bp, Homo sapiens
  misc_feature: GZ8MTXP02H9GTZ.11.73.G07.1.454.CMB.2.raw
  modified_base (267)..(267): a, c, t, g, unknown or other
  modified_base (311)..(311): a, c, t, g, unknown or other
  modified_base (371)..(371): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcagtcaggacattaagaactattaaattggatcggcagcgacagggaacnccctgagctctgatctacgatgcgttaccaaagtttcggaaacnggacggtacccccaccggtaggttcaggtggaaggtgatcgtagggactagtactttacnctacacctatcacgcagcctagcagcctagagtatattgacaactatattactgtacaacagtatgtatcgtctacctactaacgttttccggacccttacgggaccaggtacggttacgaacgtaagtaacggaaaacgtacgtacggtacggtacttacggaccc

SEQ ID NO: 412591 - DNA, 492 bp, Homo sapiens
  misc_feature: GZ8MTXP02FIDFS.11.73.G07.1.454.CMB.2.raw
  modified_base (340)..(340): a, c, t, g, unknown or other
  modified_base (426)..(426): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacatagaactattaaatggtatcggcagcgaccagggaaagcccctgagctcctgatctacgatgcgtccaaatttggaaacagaggtcccccacgaggttcagtggaagtggntcgtgggacagactttactctcaccatcagcagcctgcagcctgaaagatattgacaacatattactgtacaacagtatgatcgtntcctctaacgtttccggccctgggacccaggacgttggaacaagtgaaaacgactggacgctgacc

SEQ ID NO: 412592 - DNA, 495 bp, Homo sapiens
  misc_feature: GZ8MTXP02HB8YD.11.73.G07.1.454.CMB.2.raw
  modified_base (193)..(193): a, c, t, g, unknown or other
  modified_base (329)..(329): a, c, t, g, unknown or other
  modified_base (346)..(346): a, c, t, g, unknown or other
  modified_base (484)..(484): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctatagganacagagtcaccatcacttgccaggcagtcagacataagactattaatggtatcgcagcgaccagggaagcccctgagctcctgatctacgatgcgtccaatttgaacagagtcccccacgagttcagtgaagtggntcgtgggacagacttanctcaccatccagcagccctagcaagcctagaaacgtatagttgacaaacattaattactagtacaaactagtaatggtaatcgtctacctcaacgtttcggcccttgggacctagacgtggacaagtagaaacgtacngtcgctagacc

SEQ ID NO: 412593 - DNA, 519 bp, Homo sapiens
  misc_feature: GZ8MTXP02FX94A.11.73.G07.1.454.CMB.2.raw
  modified_base (297)..(297): a, c, t, g, unknown or other
  modified_base (352)..(352): a, c, t, g, unknown or other
  modified_base (360)..(360): a, c, t, g, unknown or other
  modified_base (368)..(368): a, c, t, g, unknown or other
  modified_base (482)..(482): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggacggtccctgagactctcctgtgcagcctctggatacatcttacaaaagtttcgaaatgagctgggtccnccaggctccgtgggaacggggccgagtggatttcatacatcagtagagtgtaacncttgactngcagactntgtgaagggcgattcaccatctccagacgacaacgaccaaagaattcaacttgtttctgacaaatagaaacagacctagagagacgaggatacggctatttactattgtagcgngatcgacaagaaaacgcggtacggccgtagttcgggg

SEQ ID NO: 412594 - DNA, 488 bp, Homo sapiens
  misc_feature: GZ8MTXP02GZTKN.11.73.G07.1.454.CMB.2.raw
  modified_base (194)..(194): a, c, t, g, unknown or other
  modified_base (339)..(339): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaactatttaaatggtatcggcagcgaccaggaaagcccctgagctcctgatctacgatgcgtcaatttaggaaacagacgtccccacgagtcagtggaagtggntctgggacagtactttactctcaccatcagcagcctgcagcctgaagatattgacaactatattactagtacaacagtatgtatcgtctcctactaatttccgcctgggaccagtacgtggacaagtacgaaacgactgtcggctcgac

SEQ ID NO: 412595 - DNA, 526 bp, Homo sapiens
  misc_feature: GZ8MTXP02JNM2S.11.73.G07.1.454.CMB.2.raw
  modified_base (299)..(299): a, c, t, g, unknown or other
  modified_base (310)..(310): a, c, t, g, unknown or other
  modified_base (355)..(355): a, c, t, g, unknown or other
  modified_base (363)..(363): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctgggacggtccctgagactctcctgtgcagcctctggatacatcttacaaaagtttcgaaatgagctgggtccnccaggctccgnggggaaggggccgagtggatttcatacatcagtagtagtgtaacncttgactntgcagactgtgtgaacgggccgattcaccatctccagagacaacgacaaagaacttcacttgtttctagactaaatagaactagcctaggagagacgagactacggactatttactattgtcgacgcgatcgaacaagaaaagcggtacggacgtagtcgggg

SEQ ID NO: 412596 - DNA, 495 bp, Homo sapiens
  misc_feature: GZ8MTXP02IXXE5.11.73.G07.1.454.CMB.2.raw
  modified_base (268)..(268): a, c, t, g, unknown or other
  modified_base (339)..(339): a, c, t, g, unknown or other
  modified_base (419)..(419): a, c, t, g, unknown or other
tcagcgagagataccacgaccggtgctcgatttagctctacgctcaggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattgtatcggcagcgacagggaaancccctgagctcctgatctacgatgcgtccaaatttggaaacagaggtccccaccgagttcagtgaagtggntctgggacagactttactctcaccatcagcagcctgccagcctagaagatattgacaaactattatttactgtaccaaanagtatgatcgtctcctacaactttcggcccttagggacccaggagtggaacaagtagaaacgaactgtggctgacc

SEQ ID NO: 412597 - DNA, 531 bp, Homo sapiens
  misc_feature: GZ8MTXP02H34PJ.11.73.G07.1.454.CMB.2.raw
  modified_base (296)..(296): a, c, t, g, unknown or other
  modified_base (351)..(351): a, c, t, g, unknown or other
  modified_base (360)..(360): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccatgtggcgtgcacctagtggagtctgggggagcttggtacagcctggacggtccctgagactctcctgtgcagcctctggatacatcttacaaaagtttcgaaatgagctgggtccncaggctcgtaggggaaggggccgagtggatttcatacatcagtagtagtgtaacnctttgactntgcagactctgtgaagggccgatcacatctcagagacaacgaccaagaatcacttgtttctgacaaatagaacagactagagagaacgagaatacggacttatttactaattgtagcgacgataacgaacgaaacgaaaaaggcggtacggtaccgttaacggttcggggg

SEQ ID NO: 412598 - DNA, 520 bp, Homo sapiens
  misc_feature: GZ8MTXP02F6ZR4.11.73.G07.1.454.CMB.2.raw
  modified_base (267)..(267): a, c, t, g, unknown or other
  modified_base (357)..(357): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcagacataagaactattaaatggtatcggcagcgacagggaaancccctgagctcctgatctacgatgcgtaccaatttgaaacagacggtccccacgagttcagtggaagtggatcgtgggacagactttacnctcaccatcagcagcctgcagcctagaagatatgacaacatattactagtaccaatagtatagatcgtctcctactaaacgtttccggacccgttaggggacccaaggtacgtacgggaactaagttaacgaaaacggtaacgtggttacggctacggaaccc

SEQ ID NO: 412599 - DNA, 505 bp, Homo sapiens
  misc_feature: GZ8MTXP02GZHDX.11.73.G07.1.454.CMB.2.raw
  modified_base (399)..(399): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacataagaactattaaatggtatcggcagcgacagggaaagcccctgagctcctgatctacgatgcgtaccaatttggaaacagacggtcccccacgaggttcaggtggaaagtgggatcgtaggggacagtactttacgtctacaccatcagcagccctgcagcctgaagntaattgacaactatattactgtacaacagtatgatcgtctcctactaactttccggccctggggaccagagtaggacaagtagaaaacgactggtacggctagacc

SEQ ID NO: 412600 - DNA, 542 bp, Homo sapiens
  misc_feature: GZ8MTXP02FX525.11.73.G07.1.454.CMB.2.raw
  modified_base (299)..(299): a, c, t, g, unknown or other
  modified_base (366)..(366): a, c, t, g, unknown or other
  modified_base (375)..(375): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttgggtacagcctgggacggtccctgagactctcctgtgcagcctctggatacatcttacaaaagtttcgaaatgagctgggtccncaggctccgtggggaaggggccggagtggatttcatacatcagtagtagtaggtaacacttgtactntgcagactntggtgaagggccgattcaccatctcagacgacaacgaccaaagaacttacacttgtttctagacaaatagaacagcctagaagagacgaggatacggtacttatttactattgtcgtcgacgataacgaacgaaggaaaacggcggtacggaccgtaggttcggggg

SEQ ID NO: 412601 - DNA, 557 bp, Homo sapiens
  misc_feature: GZ8MTXP02FQ4XF.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactatttagaaggtgtccactgtggcgtgcacctagtggagtctgggggagcttggtacagcctggacggtccctgagactctcctgtgcagcctctggatacatcttacaaaagtttcgaaatgagctgggtccgccaggctccgtggggaaggggccgagtggatttcatacatcagttagtagtaggtaacaccgtttgtaacttatgcagtaccttcgtggtagaaagggccgattcaccatctccagacgaacaaacgaccaaagaacttacaacttgtttactgacaaatagaacagacctgagagaacgaggaagtaacggcttaatttactaagttgtagcgcgataacgaacgaaggaaaaacgcggtacggccgtaagtttcggggg

SEQ ID NO: 412602 - DNA, 642 bp, Homo sapiens
  misc_feature: GZ8MTXP02HWHCK.11.73.G07.1.454.CMB.2.raw
  modified_base (303)..(303): a, c, t, g, unknown or other
  modified_base (397)..(397): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggaccggtccctgagctctcctgtgcagcctctggatacatcttacaaaagtttcgaaatgagtcgtcggggtcccnccgaggcctaccggtagggggaacgggggtcccggtaggtgggtaatttcaattacatcgaggttagtaggttcggtaaactctttagtaactntgacagtaccttgtggagtaacggggcctattccactatcctaccagacgaacaacgaccaaagtacttacacttgtttactgaactaaagtacgaaacacgacctaggacgaaaggaccggaaggtaacgtaccgggtactttaactttaaacgtagtttacggtcgaccgtacgtaacgtaaccggaaactaaaaggggtaaaacggtccggggttacggaacccgtttaagggtttcggggg

SEQ ID NO: 412603 - DNA, 551 bp, Homo sapiens
  misc_feature: GZ8MTXP02GDB59.11.73.G07.1.454.CMB.2.raw
  modified_base (298)..(298): a, c, t, g, unknown or other
  modified_base (364)..(364): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttgggtacagcctggacggtccctgagactctcctgtgcagcctctggatacatcttacaaaagtttcgaaatgagctgggtccncaggctccgtggggaacggggccgagtggatttcatacatcagtagtagtggtaacacttgtactntgcagtactcgtggtagaagggccgattcaccatctccagagacaacgaccaaagaacttacacttgtttctgacaaatagaaacagacctagaagagacgaaggatacggtactaatttactattgtcgacgcgagtaacgaaacgaaaggaaaaacggcggtacggaccgttaaggtttcggggg

SEQ ID NO: 412604 - DNA, 541 bp, Homo sapiens
  misc_feature: GZ8MTXP02IUWY8.11.73.G07.1.454.CMB.2.raw
  modified_base (297)..(297): a, c, t, g, unknown or other
  modified_base (351)..(351): a, c, t, g, unknown or other
  modified_base (360)..(360): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggacggtccctgagactctcctgtgcagcctctggatacatcttacaaaagtttcgaaatgagctgggtccncaggctccgtggggaagggccgagtggatttcatcatcagtagtagtggtaacncttgtactntgcagactctgaggaacgggccgtattcgaccatcctccagagaacaacgaccaagaattacacttgtttctgtacaaatagaactagcctagagagaacgaggagtacggacttaagtttactaattcgtcgacgcgataacgactaaagaaaacgcggtacggccgtacgtttcggggg

SEQ ID NO: 412605 - DNA, 548 bp, Homo sapiens
  misc_feature: GZ8MTXP02GDDZ1.11.73.G07.1.454.CMB.2.raw
  modified_base (356)..(356): a, c, t, g, unknown or other
  modified_base (364)..(364): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagactctcctgtgcagcctctggatacatcttacaaaagtttcaaatgagcgtgggtccgccgaggctccgtggggaaggggccggagtggatttcatacatcagtagtagtgtaacncttgactntgcagactcgtggtaggaacgggccgattccaccatctccgagacgaacaacgacaaagtaattctacttgtttactgacaaatgaaacagctagagagaacgagatacggacttattacttatcgtcgcgacgtataacgaacgaaacgaaaacggtcggtacggtaccgtaggtttcggggg

SEQ ID NO: 412606 - DNA, 511 bp, Homo sapiens
  misc_feature: GZ8MTXP02JWQ28.11.73.G07.1.454.CMB.2.raw
  modified_base (295)..(295): a, c, t, g, unknown or other
  modified_base (304)..(304): a, c, t, g, unknown or other
  modified_base (329)..(329): a, c, t, g, unknown or other
  modified_base (345)..(345): a, c, t, g, unknown or other
  modified_base (353)..(353): a, c, t, g, unknown or other
  modified_base (362)..(362): a, c, t, g, unknown or other
  modified_base (414)..(414): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggacggtccctgagctctctgtgcagcctctggatacatcttacaaaagtttcgaaatgagctgggtccncaggctcgnggggaagggccgagtgattcatacntcagtgtagtgtaacncttgactntgcagactntgtgaagggccgattcacatctcagagacaacgccaagattacacttgttcngacaaatgaacagctagagagacgagatacggtacttattactattgtcgcgagataacgaacaaggaaaacggcggacgtaccgtaggtttcgggg

SEQ ID NO: 412607 - DNA, 577 bp, Homo sapiens
  misc_feature: GZ8MTXP02JL4VX.11.73.G07.1.454.CMB.2.raw
  modified_base (356)..(356): a, c, t, g, unknown or other
  modified_base (365)..(365): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagactctcctgtgcagcctctggatacatcttacaaaagtttcgaaatgagcgtgggtccgcaggctccgtggggaacggggccggagtggatttcatacatcagtagtagtgtaacncttgtactntgcagactcgtggtaggaacgggccgtattaccacctactcctacccgaagacgaacaaccgaccaaagtaacttactacttagtttctagactaaatacgaaacacgacctagaacggaggaacggaggacgtacggtacttatttactagttgtcgacgacgactaacgaacgaaaggaaaacggcggtacggtaccgtaggtttcgggg

SEQ ID NO: 412608 - DNA, 530 bp, Homo sapiens
  misc_feature: GZ8MTXP02ITKJM.11.73.G07.1.454.CMB.2.raw
  modified_base (252)..(252): a, c, t, g, unknown or other
  modified_base (265)..(265): a, c, t, g, unknown or other
  modified_base (359)..(359): a, c, t, g, unknown or other
  modified_base (423)..(423): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaatgtatcgnagcgacaggaaanccctgagctcctgatctacgatgcgtaccaaatttggaaacagacggtcccccacgaggttcagtggaagtggatcgtgggacagtactttacnctcaccatcagcagccctgcagcctagaaagatattgacaaactattaattactagtaccaaanagtatgaatcgtctaccttactaacgtttccggacccttaggggaccctagggaacgttcgggaaccaagttacggaaaacgtacgtaggtcggacttacggaaccc

SEQ ID NO: 412609 - DNA, 539 bp, Homo sapiens
  misc_feature: GZ8MTXP02GBV3A.11.73.G07.1.454.CMB.2.raw
  modified_base (365)..(365): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctggggggagcttgggtacagcctggacggtccctgagactctcctgtgcagcctctggatacatcttacaaaagtttcgaaatgagctgggtccgcaggctccgtggggaaggggccggagtggatttcatacatcagtagtagtggtaacacttgtactntgcagtactctgtagaacgggccgattcaccatctccagacgacaacgaccaaagaacttacacttgtttctagacaaatagaacagctagagagacgaggatacggacttagttactattcgtagcgcgataacgaacgaaagaaaacggcggtacgaccgtaggttcggggg

SEQ ID NO: 412610 - DNA, 538 bp, Homo sapiens
  misc_feature: GZ8MTXP02HNO89.11.73.G07.1.454.CMB.2.raw
  modified_base (298)..(298): a, c, t, g, unknown or other
  modified_base (356)..(356): a, c, t, g, unknown or other
  modified_base (364)..(364): a, c, t, g, unknown or other
  modified_base (373)..(373): a, c, t, g, unknown or other
  modified_base (376)..(376): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggacggtccctgagactctcctgtgcagcctctggatacatcttacaaaagtttcgaaatgagcgtgggtccnccaggctccgtggggaacggggccgagtggatttcatacatcagtagtagtgtaaacncttgactntgcagactntgngaaggcgatcacatctcagacgacaacgaccaaagaacttacacttgtttactagactaaatacgaacacgcctagagaagacgaaggatacggacttaatttacttattgtgcgtcgataaccgaagaacgaaaaggcggtacggaccgttagttcggggg

SEQ ID NO: 412611 - DNA, 519 bp, Homo sapiens
  misc_feature: GZ8MTXP02GVNKK.11.73.G07.1.454.CMB.2.raw
  modified_base (194)..(194): a, c, t, g, unknown or other
  modified_base (268)..(268): a, c, t, g, unknown or other
  modified_base (417)..(417): a, c, t, g, unknown or other
  modified_base (439)..(439): a, c, t, g, unknown or other
  modified_base (514)..(514): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaactattaaatggtatcggcagcgacaggaacncccctgacgctcctgatctacgatgtcgtaccaaagtttaggaaacacggtacgtcccccaacgtaggttcaaggttggaagtggatcgtaggggacacgtactttactctaccaccatacgagcagcctgcagcctagaagatagttnacaactatattactgaccaagngtatagatcgtctcgtactaacgttcgcccgtaggacctagacgtagacaagttacgaaacgcgtagcggtaccncgtac

SEQ ID NO: 412612 - DNA, 508 bp, Homo sapiens
  misc_feature: GZ8MTXP02FMLD9.11.73.G07.1.454.CMB.2.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaatggtatcggcagcgaccagggaaagcccctgagctcctgatctacgatgcgtccaaatttggaaacagaggtccccacgagttcagtggaagtggatctggggacagactttactctcaccatcagcagcctgcagcctgaagatattgacaaacatattactagtacaaacagtatgatcgtctcctactaagttttccggaccccttggggacccaggtaggtcggaacaagtacgaaaacgaactggtacggctagacc

SEQ ID NO: 412613 - DNA, 541 bp, Homo sapiens
  misc_feature: GZ8MTXP02JGUF0.11.73.G07.1.454.CMB.2.raw
  modified_base (367)..(367): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcagacataagaactattaatgtatcggcagcgacaggaacgccctgagctcctgactctacgatcgcgtacctaagtttaggaaacagacggtcccccacgtaggttcaggtggaagtggatcgtaggggactagtactttacnctacacctatcagctagcccgtgacgacgcctagaagtattaattgactaactaattaatttaccgtagttaacaactagtagtagtacttcgtacttcctacgtaacgtttccggacccgtagggaccaggtagtacggacaagtaacgaaacgtacgtgtacggctagaacc

SEQ ID NO: 412614 - DNA, 530 bp, Homo sapiens
  misc_feature: GZ8MTXP02H0NJW.11.73.G07.1.454.CMB.2.raw
  modified_base (195)..(195): a, c, t, g, unknown or other
  modified_base (273)..(273): a, c, t, g, unknown or other
  modified_base (356)..(356): a, c, t, g, unknown or other
  modified_base (375)..(375): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctccctgtctgcatctatagganacagagtcaccatcacttgccaggcgagtcaggacattaagaacttattaaattggtatcggcagcgacgagggaacncccctgacgctcctgatctacgatgcgtaccaaagtttaggaaacaggtacggtcccccgacgtaggttcaggtggaagtggntcgtgggacagtacttacnctacaccatcagcacgcctgcagcctagagtatatgacatatattactgtacaactagtatgtactcgtactcctactaacgtttccggacccttaggggaaccctaggtagtacggaacctaagtacgaaaacgtacgtgtacggactcggacc

SEQ ID NO: 412615 - DNA, 556 bp, Homo sapiens
  misc_feature: GZ8MTXP02G601N.11.73.G07.1.454.CMB.2.raw
  modified_base (250)..(250): a, c, t, g, unknown or other
  modified_base (367)..(367): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagatcaccatcacttgccaggcgagtcaggacataagaactattaatgtatcgnagcgacgaggaacgccctgagctctgatctacgatcgcgtacctaaagttaggaaacaggacgtacccccaccgtaggttcaggtggaagtggagtcgtagggacagttactttacnctacaccatcagcagccctagccagtcctagaacgtatactgaactaaatattaacttactagtaaccaaaagtagttatagtaacttcgttacctaccttaccgtaaacgtttcccggacccgttagggaacccgtaggacgttaggaactaagtaacggaaaacgtaacgtggtacgacgtacgacc

SEQ ID NO: 412616 - DNA, 540 bp, Homo sapiens
  misc_feature: GZ8MTXP02FV4OL.11.73.G07.1.454.CMB.2.raw
  modified_base (297)..(297): a, c, t, g, unknown or other
  modified_base (443)..(443): a, c, t, g, unknown or other
tcagcgagagataccacgaccggtgctcgatttagctctacgctcaggggatctcagagaggtgccttagccctggattccaaggcatttccacatggtgatcagcactgaacacagaggactcaccatggagttggggctgtgctgggtgctccttgttactattttagaaggtgtccatgtggcgtgcacctagtggagtctgggggagcttggtacagcctggacggtccctgagactctcctgtgcagcctctggatacatcttacaaaagtttcgaaatgagctggggtccnccaggcctccgtggggaaggggccggagtggatttcatacatccagtagtagtggtaacaccttgtactatgacagactcgtggtagaagggccgtattccaccatcctaccagagaacaacgacaaagtaacttcacttgtttcngtacaaatagaaacagcctagagagacgaaggactacggacttatttactattgtcgcgcgaagtacgaacgaaagaaaagcggtagtaccgttagg

SEQ ID NO: 412617 - DNA, 496 bp, Homo sapiens
  misc_feature: GZ8MTXP02GLFNE.11.73.G07.1.454.CMB.2.raw
  modified_base (254)..(254): a, c, t, g, unknown or other
  modified_base (359)..(359): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatgtatcggnagcgaccagggaaagcccctgagctcctgatctacgatgcgtccaaatttggaaacagacgtccccacgagtcagtggaagtggatcgtgggactagactttacnctcacatcagcagcctgcagcctagaagatattgacaactatattactagtacaatagtatgatcgtctctactacgtttccggccctagggacctagacgtggacaagtagaaaacgtacgtggtacggctagacc

SEQ ID NO: 412618 - DNA, 515 bp, Homo sapiens
  misc_feature: GZ8MTXP02I5AO7.11.73.G07.1.454.CMB.2.raw
  modified_base (368)..(368): a, c, t, g, unknown or other
  modified_base (504)..(504): a, c, t, g, unknown or other
tcagcgagagataccacgaccggtgctcgatttagctctacgctcagggggcaggagtcagtcccaaccaggacacagcatggatatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaattggtatcggcagcgaccagggaaacgcccctgagctcctgatctacgatgcgtacctaaatttggaaacagacggtcccccacgaggttcaggtggaagtggatcgtgggacagactttacnctcaccatcagcagcctgcagcctagaagatattgaccaaatataactttactagtacaaacagtatgtattcgtctacctactaaagtttccggccctaggggaccagtacgtggaacaagtacgaaaacgtacngtggactgacc

SEQ ID NO: 412619 - DNA, 519 bp, Homo sapiens
  misc_feature: GZ8MTXP02FGZAN.11.73.G07.1.454.CMB.2.raw
  modified_base (299)..(299): a, c, t, g, unknown or other
  modified_base (367)..(367): a, c, t, g, unknown or other
  modified_base (404)..(404): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttgggtacagcctgggacggtccctgagactctcctgtgcagcctctggatacatctacaaaagtttcgaaatgagctgggtccnccaggctccgtggggaaggggccggagtggatttcatacatcagtagtagtggtaacaccttgtactntgcagactctgtgaagggcgattcaccatctccaganacaacgcaaagatcactgttctgcaaatgaacagcctgagagacgagatacggctattactattgtacgcgcgataacgaacaaggaaaaacgacggtaggacctagttcggggg

SEQ ID NO: 412620 - DNA, 727 bp, Homo sapiens
  misc_feature: GZ8MTXP02GPF8U.11.73.G07.1.454.CMB.2.raw
  modified_base (260)..(260): a, c, t, g, unknown or other
  modified_base (267)..(267): a, c, t, g, unknown or other
  modified_base (360)..(360): a, c, t, g, unknown or other
  modified_base (364)..(364): a, c, t, g, unknown or other
  modified_base (369)..(369): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggaggcttggtacagcctggacggtccctgagactctcctgtgcagcctcnggatacntcttacaaaagtttcgaaatgagcgtgggtccgcgaggctccgtgggggaacggggccggagtggatttcgatacatcagtagtagtgtaacncttntactntgacagtactcgtggtagaaacgggtccgatttaccgacctactcctacccgaagaacgaaccaaaccggaccctaaaaggtaactttacctaacccgtttagttttacccgtaggtaaaccctaaaagttacgaaaacccgacggtacccgttaagggaaacggtaagggaaacccgggaaggggtaaacgttaaaccggggttaccctttaaaaggtttttaaacccttaaaggttttcggtacggtacccgggtaaccggttaaacgaacccggtaaaacggaaaacggggtaaaaaaaccggggttccggggttacggggtaaccccggtttaaaggggtttttaccggggggg

SEQ ID NO: 412621 - DNA, 634 bp, Homo sapiens
  misc_feature: GZ8MTXP02G79JC.11.73.G07.1.454.CMB.2.raw
  modified_base (194)..(194): a, c, t, g, unknown or other
  modified_base (251)..(251): a, c, t, g, unknown or other
  modified_base (265)..(265): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacataagaactattaatgtatcgnagcgacgaggaacnccctagacgctctgactctacgatcgacgtactaagttaggaaacagacggtcccccacggtagttacgaggtaggaacggtggacgtcgtaggggactacgttactttacctactacccacctagtaccgaagaccgaacgtcccgttagacccgaacgtacccgttaaggaaacgtatttaacgtttacgaacctaaaacgttaacttaactttaaccgtacgtaaccaaacgttaagttaagttacgtaacgtttccgtaacccttaccccgtttaacgtaaccggttttcccgggacccggttacgggaaccgtaggtacgtacggaactaaggtaacgaaacgtacgtgtacggcctagacccg

SEQ ID NO: 412622 - DNA, 519 bp, Homo sapiens
  misc_feature: GZ8MTXP02GIK00.11.73.G07.1.454.CMB.2.raw
  modified_base (341)..(341): a, c, t, g, unknown or other
  modified_base (345)..(345): a, c, t, g, unknown or other
  modified_base (360)..(360): a, c, t, g, unknown or other
  modified_base (389)..(389): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaatggtatcggcagcgacagggaaagcccctgagctcctgatctacgatgcgtccaaatttgaaacagaggtcccccacgagttcagtggaagtggntcgngggacagactttacnctcacatcagcagctagcagcctgaaagntattgacaacatattactgtacaactagtatgattccgtacttccctactaacgttttcccggacccgttaggggacccaggtaccggtggaacctaagtaacggaaaactacgtgtacgacttagaccc

SEQ ID NO: 412623 - DNA, 608 bp, Homo sapiens
  misc_feature: GZ8MTXP02HZBQ3.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctgggacggtccctgagactctcctgtgcagcctctggatacatcttacaaaagtttcgaaatgagctgggtccgcaggcctccgtggggaaggggccggagtggatttcatacatcagtagtagtggtaactacttgtactgtgacagactcgtgtaggaacgggccgattccacctatcctccagacgaacaacgaccaaagaattctaacttgtttctagactaaaatagaaacacgaccgtaggaaggaaggaacgggaaggtaacgtaaccgggtactttaaattttaacttaagtttaggtcggtacgacgaacgttaaccggaaacgaaaagggaaaaacggtcggggtacgggtaccgtttaacgggtttcggggg

SEQ ID NO: 412624 - DNA, 523 bp, Homo sapiens
  misc_feature: GZ8MTXP02JANTQ.11.73.G07.1.454.CMB.2.raw
  modified_base (297)..(297): a, c, t, g, unknown or other
  modified_base (353)..(353): a, c, t, g, unknown or other
  modified_base (361)..(361): a, c, t, g, unknown or other
  modified_base (370)..(370): a, c, t, g, unknown or other
  modified_base (436)..(436): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggacggtccctgagactctcctgtgcagcctctggatacatcttacaaaagtttcgaaatgagctgggtccnccaggctccgtggggaaggggccgagtggatttcatacatcagtagtagtgtaacncttgactntgcagactntgtgaaggccgattcaccatctccagacgacaacgaccaagaattacacttgtttctgacaaatanaacagctgagagacgagatacggcttattactagttgtcgacgcgatcgaacgaagaaaacggcggtacggacctaggtttcggggg

SEQ ID NO: 412625 - DNA, 517 bp, Homo sapiens
  misc_feature: GZ8MTXP02F33GJ.11.73.G07.1.454.CMB.2.raw
  modified_base (362)..(362): a, c, t, g, unknown or other
  modified_base (371)..(371): a, c, t, g, unknown or other
  modified_base (396)..(396): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccatgtggcgtgcacctagtggagtctgggggagcttggtacagcctgggacggtccctgagactctcctgtgcagcctctggatacatcttacaaaagtttcgaaatgagctgggtccgccaggctccgtggggaaggggccgagtggatttcatacatcagtagtagtggtaacacttgactntgcagactntgtagacggcgatcacatctcaganacaacgcaagatacactgtttctgacaaatgaacagactgagagaacgaggatacggtacttatttactattgtcgacgcgactaacgaacaagaaaacgcggtaggccgtagttcggggg

SEQ ID NO: 412626 - DNA, 596 bp, Homo sapiens
  misc_feature: GZ8MTXP02F0ORS.11.73.G07.1.454.CMB.2.raw
  modified_base (258)..(258): a, c, t, g, unknown or other
  modified_base (298)..(298): a, c, t, g, unknown or other
  modified_base (366)..(366): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagctctcctgtgcagcctcnggatacatcttacaaaagtttcgaaatgagcgtgggtccncaggctccggtaggggaacggggccggagtggatttcatacatcagtagtagtgtaactcttgtactntgacagactcgtaggtaggaacgggccgtacttaccaccctactcctaccgaagaacgaaccaaaccgaccaaagtaacttactacttcgtttacgtagactaaatacgaaacacgcgtaggaagagaacggagtaacgtaacggtactttaaatttacttaagttggtacgacgtacgagtaacgaacgaaaggaaaacggcggtacggtaccgttaggtttacggggg

SEQ ID NO: 412627 - DNA, 649 bp, Homo sapiens
  misc_feature: GZ8MTXP02F215D.11.73.G07.1.454.CMB.2.raw
  modified_base (357)..(357): a, c, t, g, unknown or other
  modified_base (365)..(365): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctgggacggtccctgagactctcctgtgcagcctctggatacatcttacaaaagtttcgaaatgagcgtgggtccgcaggctccgtggggaaggggccggagtggatttcatacatcagtagtagtagtaacncttgactntgcagactctgtggaaagggcgattcacctatctaccagacgaacaacgaccaaaagtaacttactaaccgttgtttacctagtaactaaaagttacgaaaaccacggtacctaggaaaggaacggaaaccgggaaagggtaaacgttaaccgggtacgtttaaacgttttaaacttaaagtttcggttacggaccgtaccggtaacgtaaaccggtaaaccggaaaaaggaaaaaacggggtccggggttacgggtacccggtttaagggtttaccggggggg

SEQ ID NO: 412628 - DNA, 552 bp, Homo sapiens
  misc_feature: GZ8MTXP02FVMN4.11.73.G07.1.454.CMB.2.raw
  modified_base (298)..(298): a, c, t, g, unknown or other
  modified_base (365)..(365): a, c, t, g, unknown or other
  modified_base (399)..(399): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccatgtggcgtgcacctagtggagtcgtgggggagcttggtacagcctgggacggtccctgagactctcctgtgcagcctctggatacatcttacaaaagtttcgaaatgagctgggtccnccaggctccgtggggaacggggccggagtggatttcatacatcagtagtagtagtaactcttgactntgacagtactgtgtaggaacggcgattcacatcncagacgacaacgacaagaacttactacttgtttctagactaaagtacgaactacgacctagaagagaacggagtaagtacggtacttatttactattgtcgtacgcgagtaacgaacgaaagaaaacggcggtacggtaccgtaggttcgggg

SEQ ID NO: 412629 - DNA, 534 bp, Homo sapiens
  misc_feature: GZ8MTXP02HICTO.11.73.G07.1.454.CMB.2.raw
  modified_base (194)..(194): a, c, t, g, unknown or other
  modified_base (259)..(259): a, c, t, g, unknown or other
  modified_base (365)..(365): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgcccaggcgagtcgaggacattaagaacttatttaaatggtatcggnagcgaaccgagggaacgcccctgacgctcctgatctacgatcgctacaattaggaaacagacgtccccacgtagtcagtaggagtgatcgaggacagtactttacnctcacatacagcagcctagcagacctaggaatatattcgactaactaattacttactagtaccaatagtatacgattccgtactccttacgtacgtttccggaccctagggacctaggtacgtacggactaagtacggaaaaccgtaacgtgtacggtacctagacccg

SEQ ID NO: 412630 - DNA, 680 bp, Homo sapiens
  misc_feature: GZ8MTXP02JBXTS.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacgtcctgagctctctgtgcagcctctggatacattcttaacaaaagtttcgaaatggagtcgtgggtccgccgaggcctccggtagggggaacggggccgtaggtggtactttcgatacatcagtagtagtacgtaactactttgactgtcgactagtacctcgtaggtacgggaacgggtaccgtattacccaacctactccctaccgaacggaacgaaccgaaaccggacccaaaacggttaactttacctaaccgtttacgtttaccgttacgaacctaaaagtacggaaacaccggtaccgttagggaaacgaacgggaacggtaaagggaacgttaaccggttactttaacgttttaactacgtttaggtacgacggtacgtaacgtaaccgaaaaggaaacggtaaaacgggtcggtaacggtaccggttacgggtttacggggg

SEQ ID NO: 412631 - DNA, 541 bp, Homo sapiens
  misc_feature: GZ8MTXP02GAJJ0.11.73.G07.1.454.CMB.2.raw
  modified_base (276)..(276): a, c, t, g, unknown or other
  modified_base (384)..(384): a, c, t, g, unknown or other
  modified_base (413)..(413): a, c, t, g, unknown or other
  modified_base (437)..(437): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagatcaccatcacttgccaggcgagtcaggacaattaagaacttatttaaatggtatcggacagacgaccgagggaaacnccccgtagacgctcctgactctacgatcgcgtactaagttaggaaacaggacggtcccccacggtagttacgaggtaggaagtggatcgagggactacgtactttacnctacacatcgagcagctgcagctagagtntatcacaactatatactgactaanagtatagtactacgtctcctacgtacgtttccgggacccgttagggacctaggtacgtacggaacaagtaacggaaacgtacgtaggtacggacctacgtaccc

SEQ ID NO: 412632 - DNA, 598 bp, Homo sapiens
  misc_feature: GZ8MTXP02H1YWF.11.73.G07.1.454.CMB.2.raw
  modified_base (297)..(297): a, c, t, g, unknown or other
  modified_base (355)..(355): a, c, t, g, unknown or other
  modified_base (364)..(364): a, c, t, g, unknown or other
  modified_base (374)..(374): a, c, t, g, unknown or other
  modified_base (409)..(409): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagactctcctgtgcagcctctggatacatcttacaaagtttcgaaatgagctgggtccnccaggctccgtggggaaggggccggagtggatttcatacatcagtagtagtggtaacnccttgactntgcagacctntcggtagaacggggccctatccaccatcctcaganacacgaccaagacttcacttgtttctagacaaaagtgaaaccgtagacccttaggaacgtaaggaaccgggaagggtaacgttaaccgggtacctttaagttttaacctaaggttacgtcgggaccgtacgacttaacggaacgaaaagggaaaacggtcgggtacggtaccgttaagggtttcggggg

SEQ ID NO: 412633 - DNA, 504 bp, Homo sapiens
  misc_feature: GZ8MTXP02HOGXP.11.73.G07.1.454.CMB.2.raw
  modified_base (296)..(296): a, c, t, g, unknown or other
  modified_base (305)..(305): a, c, t, g, unknown or other
  modified_base (366)..(366): a, c, t, g, unknown or other
  modified_base (369)..(369): a, c, t, g, unknown or other
  modified_base (388)..(388): a, c, t, g, unknown or other
  modified_base (410)..(410): a, c, t, g, unknown or other
  modified_base (415)..(415): a, c, t, g, unknown or other
  modified_base (418)..(418): a, c, t, g, unknown or other
  modified_base (420)..(420): a, c, t, g, unknown or other
  modified_base (422)..(422): a, c, t, g, unknown or other
  modified_base (425)..(425): a, c, t, g, unknown or other
  modified_base (427)..(427): a, c, t, g, unknown or other
  modified_base (429)..(429): a, c, t, g, unknown or other
  modified_base (431)..(431): a, c, t, g, unknown or other
  modified_base (469)..(469): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtcatgtggcgtgcacctagtggagtcgtgggggagcttggacagcctggacggtccctgagactctcctgtgcagccctctggatacatcttacaaaagtttcgaaatgagctgggtccncaggctcgngggaagggcgagtggattcatacatcagtagtagtaggtaacacttgaactatgcagactntgngaaagggccattcacatcncagagacaacgctaaagaatanacttnttntnanaananananacagagagagagagtacgtatattactatgtgcgaganaacgaacgaaagaaagacggacgtacgtacgtcgg

SEQ ID NO: 412634 - DNA, 550 bp, Homo sapiens
  misc_feature: GZ8MTXP02IIQXK.11.73.G07.1.454.CMB.2.raw
  modified_base (257)..(257): a, c, t, g, unknown or other
  modified_base (297)..(297): a, c, t, g, unknown or other
  modified_base (354)..(354): a, c, t, g, unknown or other
  modified_base (363)..(363): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggaccggtccctgagctctcctgtgcagcctntggatacatcttacaaaagtttcaaatgagcgtgggtccnccaggctccgtggggaaggggccgagtggatttcatacatcagtagtagtggtaacncttgtactntgacagacctgtgtggaaacgggccgtattccaccatctaccagacgacaacgccaaagacttcacttgtttctagactaaagtcgaacagccgtagaagagacgagacgtacggtacttagtttacttattgtcgcgtcgataacgaacaaaggaaaacgcggtacggtaccgtaggtttcggggg

SEQ ID NO: 412635 - DNA, 479 bp, Homo sapiens
  misc_feature: GZ8MTXP02ILC25.11.73.G07.1.454.CMB.2.raw
  modified_base (319)..(319): a, c, t, g, unknown or other
  modified_base (355)..(355): a, c, t, g, unknown or other
  modified_base (383)..(383): a, c, t, g, unknown or other
  modified_base (411)..(411): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacataagactattaatgtatggcagcgacaggaaacgcccctgagctcctgatctacgatgcgtccaatttggaaacagacgtccccaccgngttcagtggaagtggatctgggactagtactttacnctcaccatcagcagcctgcagctagaanatattgacaactatattacagtaccaanagtatgattcgtctctactaatttcgacctgggaccagacgtgacaagtagaaacgactgtcgctgac

SEQ ID NO: 412636 - DNA, 495 bp, Homo sapiens
  misc_feature: GZ8MTXP02GTZC1.11.73.G07.1.454.CMB.2.raw
  modified_base (346)..(346): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatggtatcggcagcgaccagggaaagcccctgagctcctgatctacgatgcgtccaatttggaaacagaggtcccccaccgagtcagtggaagtgggatcgnggggacagtactttactctcaccatcagcagccctgcagcctagaacgatattgacaactatattactgtacaaacagtatgatcgtctcctctaattcggccctaggaccagacgtagacaagtacgaaacgactgtacggctcgacc

SEQ ID NO: 412637 - DNA, 562 bp, Homo sapiens
  misc_feature: GZ8MTXP02JB3I0.11.73.G07.1.454.CMB.2.raw
  modified_base (265)..(265): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaatgtatcgcagcgacaggaacnccctgagctctgatctagatgcgtacctaagttggaaacagacggtcccccacggtagttcaggtggaagtggatcgtaggggactagtactttactctcaccatcagcagcctagcagcctagaagtattatgactaaactattaacttacgtacgtaactaaacgtaggttaatacggtaacttccgttacctacccttacgttaaacgtttcccgggacccgttaggggaaccctaagggtacggtacggaacctaagtaacggaaaacgtacgtaggtcggactacgaacccg

SEQ ID NO: 412638 - DNA, 564 bp, Homo sapiens
  misc_feature: GZ8MTXP02HIY9Q.11.73.G07.1.454.CMB.2.raw
  modified_base (290)..(290): a, c, t, g, unknown or other
  modified_base (347)..(347): a, c, t, g, unknown or other
  modified_base (369)..(369): a, c, t, g, unknown or other
  modified_base (375)..(375): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaatgtatcggcagcgacgaggaacgccctgagctcctgatctacgntcgcgtactaagttaggaaacaggacggtcccccacgtaggttcaggtggaagtggntcgtagggactagtactttacnctcacntcagcagcctgcagtcctagaagtacttattgacaactattacttactagtacaaacgtagtattagtacttccgtacttacccttacgttaacgttttccgggacccgttacggggaaccctaggtacggttacggaacctaagtaacggtaaaacgttacgttaggtacggtacgttacggaacccg

SEQ ID NO: 412639 - DNA, 518 bp, Homo sapiens
  misc_feature: GZ8MTXP02JPHOC.11.73.G07.1.454.CMB.2.raw
  modified_base (194)..(194): a, c, t, g, unknown or other
  modified_base (272)..(272): a, c, t, g, unknown or other
  modified_base (370)..(370): a, c, t, g, unknown or other
  modified_base (383)..(383): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaactattaaatggtatcggcagcgaccgagggaaacncccctgagcctcctgatctacgatgcgtccaagtttggaaacaggaggtccccccaccgaggttcaggtggaagtggatcgaggggacagactttacnctcacatcagcancctgcagcctagaacgatagttgacaactatattactagtacaacagtatgattcgtctccttactaacgtttccggacccttaggggaccagacgtcggaactaagtaggaaaacgtacgtgtcggactggacc

SEQ ID NO: 412640 - DNA, 529 bp, Homo sapiens
  misc_feature: GZ8MTXP02H28UT.11.73.G07.1.454.CMB.2.raw
  modified_base (296)..(296): a, c, t, g, unknown or other
  modified_base (399)..(399): a, c, t, g, unknown or other
  modified_base (434)..(434): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccatgtggctgcacctagtggagtcgtgggggagcttggtacagcctggacggtccctgagactctcctgtgcagcctctggatacatcttacaaaagtttcgaaatgagctgggtccncaggctcgtgggaagggccgagtggatttcaatacatcagtagtagtgtaacaccttgactatgcagactctggtgaaacgggccgattcaccatctccaganacaacgaccaagaatcactgtttctgacaatgaanagcctagagagacgagatacggacttagtttaactattcgtagcgtacgataacggaacaaaggaaaaggtcggtacggaccgttaagtcggggg

SEQ ID NO: 412641 - DNA, 729 bp, Homo sapiens
  misc_feature: GZ8MTXP02JKQEX.11.73.G07.1.454.CMB.2.raw
  modified_base (196)..(196): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatccctcctgtctgcatctagtagganacagagtcaccatcacttgccgaggcgagtcgaggactaattaagaacttaatttaagtggtatcggacgaggaccgaaccggaagggaaaccgccccgtagacgtcctccgtagtaactaccgtacgtacgttcggtaccgttaccgttaaagtttaacggaaaccgtacgggtaccggtaccccccgacggttagggtttaccgaaggggttagggtaaggttagggtacgttacgggtacgggggtaacctaacggttaacctttaccgtaccttacccaaaccctacgttaccgaacgtaccgtaccgtacccgttacgccgtaacgtacccgttaagggaaactaagttaacggtacgtaaacctaaacttagtttaactttaccgtaagtaccctaaacgtaggttaactacgtacgttaccttacctccttaacgttaccgtttccgggacccgttagggaacccgtaggtacggtacggaactaacgtaaacggaaaccgtaggtcgtacggtactacgtaaccc

SEQ ID NO: 412642 - DNA, 580 bp, Homo sapiens
  misc_feature: GZ8MTXP02ILPWK.11.73.G07.1.454.CMB.2.raw
  modified_base (258)..(258): a, c, t, g, unknown or other
  modified_base (298)..(298): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggacggtccctgacgactctcctgtgcagcctntggatacatctacaaaagtttcgaaatgagcgtgggtccnccaggcctccggtggggaaggggccgtaggtggtatttcaatacatcagtagtagtacggtaaactcctttgtactgtcgcagtacctcgtagtggaacgggcgtatcacatctacagacgaacaacgacaaagtacttacacttgttctagactaaagtagaacagaccgtagaagagaacggaggaacgttaacggtacttaacttaactagttgtacgtacgtcgtaacgtaacgaacgaaaggaaaacggtcgggtacggtaccgtaggtttcggggg

SEQ ID NO: 412643 - DNA, 549 bp, Homo sapiens
  misc_feature: GZ8MTXP02GTHF5.11.73.G07.1.454.CMB.2.raw
  modified_base (297)..(297): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactatttagaaggtgtccatgtggcgtgcacctagtggagtcgtgggggagcttggtacagcctggacggtccctgagactctcctgtgcagcctctggatacatcttacaaaagtttcgaaatgagcgtgggtccncaggctccgtggggaacgggccgagtggatttcatacatcagtagtagtgtaactcttgaactatgacagactcgtgtagaacgggccgattcaccatctaccagacgaacaacgacaaagaattactacttgtttactagactaaatagaaacagacctagagagaacgagacgtacggtacttatttactattagtcgacgacgataacgaacgaaagaaaacggcggtacggccgtaaggtttcggggg

SEQ ID NO: 412644 - DNA, 624 bp, Homo sapiens
  misc_feature: GZ8MTXP02I16G3.11.73.G07.1.454.CMB.2.raw
  modified_base (302)..(302): a, c, t, g, unknown or other
  modified_base (363)..(363): a, c, t, g, unknown or other
  modified_base (372)..(372): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggaccggtccctgagactctcctgtgcagcctctggatacatcttacaaaagtttcgaaatgagcgtggggtcccnccgaggcctccgtaggggaacggggccggagtggatttcatacatcagtagtagtgtaacncttgtactntgcagtacctgtggtaggaacgggccgtatccacctactccgtaccgagacgaacaaccgaccaaagtaacttacacgtttcgtttactgaactaaagtacgaaacacgtaccgtaggaacgacggaacggaaggtaacgtaaccgggtacttaaagtttaaccgttagttggtcgtaccggtacgaagttaaccggaaacgaaaaggtaaaaacggtccggggtacggtaccggttaacggtttacggggg

SEQ ID NO: 412645 - DNA, 558 bp, Homo sapiens
  misc_feature: GZ8MTXP02F79RT.11.73.G07.1.454.CMB.2.raw
  modified_base (298)..(298): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagactctcctgtgcagcctctggatacatcttacaaaagtttcgaaatgagctgggtccncaggctccgtggggaaggggccggagtggatttcatacatcagtagtagtgtaacacttgtactatgacagactcgtggtagaacgggccgattcaccatcctcagacgaacaacgaccgaaagaacttacacttgtttactgactaaagtacgaaacagacctagagagacgaaggactacggtacttatttactattgtacgacgacgactaacgaacgaaacgaaaacggcggtacggtaccgtaggtttacggggg

SEQ ID NO: 412646 - DNA, 537 bp, Homo sapiens
  misc_feature: GZ8MTXP02FVG7F.11.73.G07.1.454.CMB.2.raw
  modified_base (194)..(194): a, c, t, g, unknown or other
  modified_base (380)..(380): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaactatttaaatgtatcggcagcgacgagggaaacgcccctagacgctcctgatctacgatcgcgtacctaaagtttggaaaacaggacggtccccccacggtaggttcgaggtggaagtgggatcgtggggacagtactttacnctcaccatcagcacgctgcagcctagaaagattatgacaactattattactgtaccaatagtatagattcgtcctactactaacgtttccggcccgtagggaaccaggtacgtcggaactaagtaacggaaaacgtacgtggtacggtctacgaccc

SEQ ID NO: 412647 - DNA, 635 bp, Homo sapiens
  misc_feature: GZ8MTXP02F3CRR.11.73.G07.1.454.CMB.2.raw
  modified_base (297)..(297): a, c, t, g, unknown or other
  modified_base (308)..(308): a, c, t, g, unknown or other
  modified_base (354)..(354): a, c, t, g, unknown or other
  modified_base (362)..(362): a, c, t, g, unknown or other
  modified_base (372)..(372): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactatttagaaggtgtccatgtggcgtgcacctagtggagtcgtgggggagcttggtacagcctgggacggtccctgagactctcctgtgcagcctctggatacatcttacaaaagtttcgaaatgagctgggtccnccaggctccgnggggaaggggccgagtggatttcatacatcagtagtagtgtaaccncttgactntgcagacctntgtagaagggccgtattccacctatcctaccaagacaacgaaaccgaccaaagtaacttacacctttgtttacctagaactaaaagtagaaaaccacggtaccctaggaaaggaacggaacggaaggggtaacgttaaccgggtacttttaaagtttaacttaagtttacggtcggacgtacgtaaacgtaaccggaaaaccgtaaaacgggaaaaaacgggtccgggttaacgggtacccggtttaaggggtttccgggggg

SEQ ID NO: 412648 - DNA, 605 bp, Homo sapiens
  misc_feature: GZ8MTXP02FMEW5.11.73.G07.1.454.CMB.2.raw
  modified_base (357)..(357): a, c, t, g, unknown or other
  modified_base (365)..(365): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctcttgttactatttagaaggtgtccatgtggcgtgcacctagtggagtcgtgggggagcttggtacagcctgggacgtccctgagctctcctgtgcagcctcgtggatacatcttacaaaagtttcgaaatggagcgtgggtccgcgaggcctccggtggggaacggggccggagtggatttcatacatcagtagtagtgtaacncttgactntcgcagtactgtaggtaggaaacgggtccgtattccaacctactcctaccaagacgaacaaaccgaccaaaagtaacttactacttgtttccagtactaaaatagaacctagccgtaggaacggaagaacggtaggaactacggtactttaagttttaactaagtttggtacgacgacgtaacgtaacgaaacgaaaaggtaaaaacggtcgggtacggtaccgttaagggtttcggggg

SEQ ID NO: 412649 - DNA, 552 bp, Homo sapiens
  misc_feature: GZ8MTXP02IFXMT.11.73.G07.1.454.CMB.2.raw
  modified_base (295)..(295): a, c, t, g, unknown or other
  modified_base (349)..(349): a, c, t, g, unknown or other
  modified_base (369)..(369): a, c, t, g, unknown or other
  modified_base (395)..(395): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgtactattttagaaggtgtccactgtggcgtgcacctagtggagtctgggggagcttggtacagcctggacgtccctgagactctcctgtgcagcctctggatacatctacaaaagtttcgaaatgagcgtgggtccncaggctccgtggggaagggccgagtggatttcatacatcagtagtagtgtaacncttgtactgtgacagactgngtgaacggcgatcacatctaccaganacaacgccaaagattcgacttcttctacgactaaactagaacacgaccgtgaacgagacgaaggactaacggtcttaagtttacttagttgtcgacgtcggaactaacggaacgaaacggaaaaacggcggtacggtaccgttaacggtttcggggg

SEQ ID NO: 412650 - DNA, 539 bp, Homo sapiens
  misc_feature: GZ8MTXP02I5OH2.11.73.G07.1.454.CMB.2.raw
  modified_base (297)..(297): a, c, t, g, unknown or other
  modified_base (360)..(360): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggacagcctggacggtccctgagactctcctgtgcagcctctggatacatcttacaaaagtttcgaaatgagctgggtccncaggctccgtggggaaggggccgagtggatttcatacatcagtagtagtgtaactcttgactntgcagactcgtgtaggaacgggccgattcaccatctcagacgacaacgaccaagaacttacacttgtttactgactaaatacgaaacagacctagagagacgaggactacggtactatttactattcgtcgcgcgagtcgaacgaacgaaaacggcggtacggaccgtaggttcggggg

SEQ ID NO: 412651 - DNA, 510 bp, Homo sapiens
  misc_feature: GZ8MTXP02IDDA2.11.73.G07.1.454.CMB.2.raw
  modified_base (294)..(294): a, c, t, g, unknown or other
  modified_base (347)..(347): a, c, t, g, unknown or other
  modified_base (355)..(355): a, c, t, g, unknown or other
  modified_base (364)..(364): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccatgtggctgcacctagtggagtctgggggagcttggtacagcctggacggtccctgagactctcctgtgcagcctctggatacatcttcaaaagtttcgaaatgagctgggtccncaggctccgtggggaaggggccgagtggattcatcatcagtagtagtgtaacncttgactntgcagactntgtgaaggccgatcacatctccagacgacaacgacaagatcacttgttctgacaatagaacagctgagagacgagagtacggcttattactattgtcgcgtcgagtaacgacgaagaaaacgcggtacggaccgtaggttcggggg

SEQ ID NO: 412652 - DNA, 534 bp, Homo sapiens
  misc_feature: GZ8MTXP02I357R.11.73.G07.1.454.CMB.2.raw
  modified_base (253)..(253): a, c, t, g, unknown or other
  modified_base (268)..(268): a, c, t, g, unknown or other
  modified_base (386)..(386): a, c, t, g, unknown or other
  modified_base (421)..(421): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaatgtatcggnagcgacgaggaaacncccctgagctcctgatctacgatcgcgttacctaagtttacggaaactaggacggtaccccccacggtaggttcaggtggaacggttggtagtcgtaggggacctagtaccttttacnctacaccatacagcacgcctgcacgctagaacgtntagtgacactatatactagtacatagtatgactcgtctcctacgtacgttccggacctgggacccagtacgtaggactaagtaacgaaacgtacgtcggtacgactacgtacc

SEQ ID NO: 412653 - DNA, 580 bp, Homo sapiens
  misc_feature: GZ8MTXP02HFB5W.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccatgtggcgtgcacctagtggatctgggggagcttgggtacagcctgggaccggtcctgagactctcctgtgcagcctctggatacatcttacaaaagtttcgaaatgagctgggtccgcaggcctccggtggggaacggggccgagtggatttcatacatcagtagtagtaggtaactaccgttgtaactatgactagacttcgtaggtggaaacgggtccgtattccacctactctaccagacgacaacgtaccaaagtacttcaccttgtttctgacaaatcgaaactgacctaggaagaggacgaaggtaactacggtacttaagtttactagttggtacgcgtacgataacggaacgaaaggaaaacggtcggtacggtaccgtaaggtttcggggg

SEQ ID NO: 412654 - DNA, 592 bp, Homo sapiens
  misc_feature: GZ8MTXP02J3G6T.11.73.G07.1.454.CMB.2.raw
  modified_base (232)..(232): a, c, t, g, unknown or other
  modified_base (392)..(392): a, c, t, g, unknown or other
tcagcgagagataccacgaccggtgctcgatttagctctacgctcagggggcaggagtcagtcccaacaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacatanaacttattaaattgatcggcagcgacagggaaagcccctgacgctcctgatctaacgatgacgttacctaaagtttagggaaaaccaggacggtacccccccaccggtaggtttcaggttgggaaagttgggattcgtaggggacctagttacctttacncttaccacccataccagcacggccctggaccagacctagaaacgtatattcgacaactattattaactgtacaaactagttataggattccgtcttacccttactaacgttttcccggggaccccttacgggggaaccctaacgggacgttaggacctaagttacggaaaaccgtaaccgttggtcgggcttacggaccc

SEQ ID NO: 412655 - DNA, 566 bp, Homo sapiens
  misc_feature: GZ8MTXP02JU4XL.11.73.G07.1.454.CMB.2.raw
  modified_base (368)..(368): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagactctcctgtgcagcctctggatacatcttacaaaagtttcgaaatgagcgtgggtccgccaggcctccgtggggaacggggccggagtggtattcatacatcagtagtagtggtaacacttgtactntgcaagactcgtgtaggaacgggccgattccacctatcctaccagacgaacaacgaccaaagtaacttctacttgtttctagactaaatacgaacagacctaggagagacggagacgtacggtacttaattactattggtcgcgacgagtaacgaacgaaggaaaacggcgggtacggtaccgtacggtttacggggg

SEQ ID NO: 412656 - DNA, 537 bp, Homo sapiens
  misc_feature: GZ8MTXP02JEFTG.11.73.G07.1.454.CMB.2.raw
  modified_base (367)..(367): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacatagaactattaatggtatcggcagcgaccaggaaacgcccctgagctcctgatctacgatgcgtccaagtttaggaaacaggacggtacccccaccgaggttcacggtggaagtggatcgtgggacagtactttacnctcaccatcagcagcctgcagcctagaacgtatacgttgacaactattaactttactagtaccaaagtagttatagtactcgtactacctactaacgttttccggcccgttaggggaacccaggtacgtcggaactaagtaacgaaaacgtacgtggtacggctacgacc

SEQ ID NO: 412657 - DNA, 559 bp, Homo sapiens
  misc_feature: GZ8MTXP02HF3ZH.11.73.G07.1.454.CMB.2.raw
  modified_base (298)..(298): a, c, t, g, unknown or other
  modified_base (363)..(363): a, c, t, g, unknown or other
  modified_base (427)..(427): a, c, t, g, unknown or other
  modified_base (441)..(441): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaggtgtccatgtggcgtgcacctagtggagtcgtgggggagcttggtacagcctggacggtccctgagactctcctgtgcagcctcgtggatacatcttacaaaagtttcgaaatgagcgtgggtccnccgaggcctcgtggggaaggggccggagtggattcatacatcagtagtagtgtaacacttgactntgcagactctgtaggaacgggcctattccacatctaccagacacaacgcaaagacttacacttnttctagacaaatanaacagcctagagagacgaggacgtacggacttagtttaacttagttaggtcgcggtacgtaacgtaacggaaacgaaggaaaaacggtcgggtacggtaccgttacggtttacggggg

SEQ ID NO: 412658 - DNA, 523 bp, Homo sapiens
  misc_feature: GZ8MTXP02JOH8V.11.73.G07.1.454.CMB.2.raw
  modified_base (340)..(340): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcagtcagtacataagaactattaattgtatcgcagcgacaggaaacgcccctagacgctcctgactctacgatgcgtactaatttacggaaacagacgtccccgacgtagtcagtggagtgntcgagggacagtacttactctcacatacacgcacgcctgcacgtaccgtagaaagtattagttcgactaactattaattactagtacaactagttatgtacttacgtctcctactaacgtttcggacccgtacggacctagacggtcggaactaagtacgaaacgtactagtcggctacgacc

SEQ ID NO: 412659 - DNA, 500 bp, Homo sapiens
  misc_feature: GZ8MTXP02HWTL0.11.73.G07.1.454.CMB.2.raw
  modified_base (194)..(194): a, c, t, g, unknown or other
  modified_base (252)..(252): a, c, t, g, unknown or other
  modified_base (265)..(265): a, c, t, g, unknown or other
  modified_base (269)..(269): a, c, t, g, unknown or other
  modified_base (309)..(309): a, c, t, g, unknown or other
  modified_base (371)..(371): a, c, t, g, unknown or other
  modified_base (404)..(404): a, c, t, g, unknown or other
  modified_base (428)..(428): a, c, t, g, unknown or other
  modified_base (464)..(464): a, c, t, g, unknown or other
  modified_base (487)..(487): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaactattaaatgatcgnagcgacaggaacncccngagctcagatctacgatgacgtacaaagtttaggaaaacnggtacggtccccccaacggtaggttcaaggttggaagtggatcgtaggactagtactttacnctcactatacagcagcctgcagctagatatatnacaatatatactgtacaagtatangtatcgtactctacactttccggacctagggacagngtagacaagtacgaaacgtacgngtacgacgtacac

SEQ ID NO: 412660 - DNA, 507 bp, Homo sapiens
  misc_feature: GZ8MTXP02GQBD4.11.73.G07.1.454.CMB.2.raw
  modified_base (255)..(255): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatggtatcggnagcgaccagggaaagcccctgagctcctgatctacgatgcgtccaatttggaaacagacggtcccccacgaggttcagtggaagtggatctgggacagtactttactctcaccatcagcagcctgcagcccgaagactattagcaaacattattactgtacaaactagtatgaatcgtactcctactaaactttccggacccttgggacctaggagtacggacataagaaaacgaactgtaggctcgcaacc

SEQ ID NO: 412661 - DNA, 594 bp, Homo sapiens
  misc_feature: GZ8MTXP02H55DQ.11.73.G07.1.454.CMB.2.raw
  modified_base (194)..(194): a, c, t, g, unknown or other
  modified_base (252)..(252): a, c, t, g, unknown or other
  modified_base (374)..(374): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaaccatcattgccaggcgagtcaggacataagactattaaatgtatcggnagcgacagggaacgccctgacgctcctgatctacgatgcgtacctaaagtttaggaaacaggacggtcccccaccggtagttcgaggttaggaaggtggatcggtaggactagtactttacncttaccaacccatcaagcgagcctagacagcctagaagtatattgaactaaactattaacttacttaggtaacaaacgtagttaacgtgtaacgttcgttaccttaccttacgttaaaacgttttcccgggaccccttaggggaacccctaagggtacggttaggaaaccgtaagttaaacggaaaaccgtacgttaggtacggtacgttacggaacccg

SEQ ID NO: 412662 - DNA, 700 bp, Homo sapiens
  misc_feature: GZ8MTXP02JPDAG.11.73.G07.1.454.CMB.2.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccatcctccctgtctgcatctataggagacagagtccaccatcacttgccaggcgagtcaggactattaagaactattaatgtatcggcagcgaccgaggaaaccgccccgtagacgtcctcgtgactctaacgatcggtacctacgtaagtttaggaaacctacggtaccggtaccccccacggtaggttacgaaggttagggaagtgggtagtcggtacggggaacctacgtaacctttacctaccttaccaaccctactaccgacgaccgaacgtcccgttacgaccgaacggtacccgtaaggtaaacgttaattacgttaccggtaacctaaaacgttaacctttaagtttaaccttacggtaacctaaacgtaaggttaatcgttaaccggtttccgttaccttacccgttaacgtttaaccggtttcccgggtaccccggttaacggggaacccgtaaggtaacggttacggaaccgtaagtaaacggtaaaaccgttacgtaggtccggtactacggtaacccc

SEQ ID NO: 412663 - DNA, 791 bp, Homo sapiens
  misc_feature: GZ8MTXP02H1W36.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaggtgtccatgtggctgcacctagtggagtcgtgggggagcttggacagcctggacgtccctgagactctcctgtgcagcctctggatacatcttaacaaagtttcgaaatgagtcgtcgggtccaaccgaggcctaccggtggggaacggggtccggagtaggtatttcaaagttacatacgtaggttacgtaggttacggtaaacctacccgttttaggtaaccttatcggtaccaaaggtaccttccgttaggggtacgaaaacggggggtcccccgtaaatttacccaaaccccgtaacgtttccctaacccccgtaaagggaaaacgaaacccgtaaaaccccggaccctaaaacggttaaaactttcccgttaaaaccgtttggtttttacccgttacggtaaaccaaaaagttacgggaaaacaaccgggtacccttaaggggaaacggtaaacgggtaaaccgggaagggtaaaacgttaacccggggtaaccttttaaaggtttaaacctttaaggtttcggttacgaccggtacgtaaacgttaaccgaaaaccgtaaaacggaaaaacggggtcgggtaaccggtaccgtttaaacgggtttccgggggg

SEQ ID NO: 412664 - DNA, 627 bp, Homo sapiens
  misc_feature: GZ8MTXP02H5GZP.11.73.G07.1.454.CMB.2.raw
  modified_base (307)..(307): a, c, t, g, unknown or other
  modified_base (408)..(408): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccactccctccctgtctgcatctataggagacagagtcaccatcacttgccaggcgagtcaaggactaattaaagaacttaattaaagttggtatcggcagacgacgaaggaacgcccctgacgtctcctagactctaagntcgacgtactaaagtttacggaaacaggtaccggtcccccacggtaggttacgaagggtacggaaggttcggagtcggtaggggacctaagtacctttacnctacaccatccgagcacgctagcagcctaagacgtatagttagaacctaaatattaacttacgttagaactaaactagttaactaggtacttacgtaccttaccgttacgttaaaccggtttcccgggaccgttacggggaaacctaggtaacggttacggaaaccgtaaggtaaaaccgtaaaacggtaacttcggggtaccgtacgttacggaaccc

SEQ ID NO: 412665 - DNA, 554 bp, Homo sapiens
  misc_feature: GZ8MTXP02GJKS8.11.73.G07.1.454.CMB.2.raw
  modified_base (299)..(299): a, c, t, g, unknown or other
  modified_base (367)..(367): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagactctcctgtgcagcctctggatacatcttacaaaagtttcgaaatgagcgtgggtccnccaggctccgtggggaaggggccgagtggatttcatacatcagtagtagtagtaactaccttgtactntgcagactcgtgtagaacgggccgattcacatctccagacgaacaacgaccaaagaacttactacttgtttcttagacaaatagaacagactagagagacgaggatacggtacttatttactattgtacgtacgcgtagtaacgaacgaaggaaaaacgtcggtacggtaccgtaaggtttcggggg

SEQ ID NO: 412666 - DNA, 601 bp, Homo sapiens
  misc_feature: GZ8MTXP02J0ABU.11.73.G07.1.454.CMB.2.raw
  modified_base (356)..(356): a, c, t, g, unknown or other
  modified_base (365)..(365): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctgggacggtccctgagactctcctgtgcagcctctggatacatcttacaaaagtttcgaaatgagcgtgggtccgcaggctccgtggggaaggggccggagtggatttcatacatcagtagtagtgtaacncttgtactntgcagactcgtgtagaacgggccgtattcaccatcctccagacgacaacgaccaagtaacttctacttcgtttactagactaaagtagaaacacgacctaggacggaagaacggaaggtaacgtaacgggtacttaagtttaacgttaagttggtacgtaccggacgtaacgtaaccggaaaccgaaaagggaaaaacgggtccgggtacgggtacccgttaagggtttcgggggg

SEQ ID NO: 412667 - DNA, 639 bp, Homo sapiens
  misc_feature: GZ8MTXP02F1PNP.11.73.G07.1.454.CMB.2.raw
  modified_base (252)..(252): a, c, t, g, unknown or other
  modified_base (294)..(294): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttgggctgtgctgggtgctcttgttactatttagaagtgtccatgtggcgtgcacctagtggagtcgtgggggagcttggtacagcctggacggtccctgagctctcctgtgcagcctntggatacatcttacaaaagtttcgaaaattgagctgggtccnccaggctccgtggggaaggggccgagtggatttcatacatcagtagtagtgtaactcttgtactgtgacagtaccttcgtaggtaggaaacgggccgtatttccaaccctacttcctacccgaagaacgaacgaaaccgaccgaaaagtaactttacaacctttggttttactaggaacctaaaagttacgaaaaccacggacccttaggaaacggaggaaaccggaaggtaacgtaacgggtactttaaagttttaacgtaagttggtacgtaccgacgtaataacggaaaccgtaaaaggaaaaacggtcggggtacggtacccgttaaggttttccgggggg

SEQ ID NO: 412668 - DNA, 656 bp, Homo sapiens
  misc_feature: GZ8MTXP02JK7YU.11.73.G07.1.454.CMB.2.raw
  modified_base (298)..(298): a, c, t, g, unknown or other
  modified_base (370)..(370): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccatgtggcgtgcacctagtggagtcgtgggggagcttggtacagcctgggaccggtccctgagactctcctgtcgcagcctctggatacatctacaaaagttcgaaatgagctgggtccncaggctccgtggggaacgggccgagtggatttcatacagtcaggtacgtagtcggtaaactccgttagactntcgcaaggtactcgtagggtacggaaacgggccgtaattaccgacctactccgtacccgaagaacgaaccgaaaccggaccaaacgtaacttaccactttcgtttcgtacgactaaaacgtacggaaactacgacccgtaggaacggaacggaaccggtaggaaacgttacgggtactttaaacgtttaccgttagtttacggtggtaccgtacggtacgtaacggaaaccgaaaagggtaaaaacgggtcgggtaccggtacccggttacgggttttacgggggg

SEQ ID NO: 412669 - DNA, 624 bp, Homo sapiens
  misc_feature: GZ8MTXP02H4AQ0.11.73.G07.1.454.CMB.2.raw
  modified_base (299)..(299): a, c, t, g, unknown or other
  modified_base (370)..(370): a, c, t, g, unknown or other
tcagcgagagataccacgaccggtgctcgatttagctctacgctcaggggatctcagagaggtgccttagccctggattccaaggcatttccacttggtgatcggcactgaacacagaggactcacatggagttggggctgtgctgggtgctccttgttactattttagaaggtgtccatgtggcgtgcacctagtggagtcgtggggggagcttggtacagcctggacggtcctgagactctcctgtgcagcctctggatacatcttactaaaagttcgaaatgagtcgtgggtcccncgaggctccggtaggggaggggccggagtggatttcatacatcagtgtagtacggtaacactttgtactgngcaagcttcgtgtgggaaacggtcgtactcacctatctaccaagacgaacaaccgaccaaagtacttactacttacggtttactaggtaactaaagtacgaaacgtacgaccgtaggaaacggacggaacggtaacgggaacgttaaccgggtactttaaaacgtttttacgtatttagggtcgacggacgtaagtaccgaacgaaaacggtaaaacggccggttaggtaccgtaagggtttcgggggtttagg

SEQ ID NO: 412670 - DNA, 537 bp, Homo sapiens
  misc_feature: GZ8MTXP02GO52T.11.73.G07.1.454.CMB.2.raw
  modified_base (357)..(357): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctgggaccggtccctgagactctcctgtgcagcctctggatacatcttacaaaagtttcgaaatgagctggtccgccaggctccgtggggaaggggccgaggtggatttcatacatcagtagtagtggtaacncttgtactagtgctagactctgtaggaacgggccgtattcaccatctccagacgacaacgccaaagtaacttcacttgttctagacaaatagaaacagctagagagacgagatacggatatttactatgtcgacgcgataaccgaagaaagaaaacgcggtacggtacctaggttcgggg

SEQ ID NO: 412671 - DNA, 528 bp, Homo sapiens
  misc_feature: GZ8MTXP02IWZ21.11.73.G07.1.454.CMB.2.raw
  modified_base (254)..(254): a, c, t, g, unknown or other
  modified_base (391)..(391): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaattgtatcggnagcgacaggaaagcccctgagctcctgatctacgatgcgtacaaatttaggaaacagacggtccccacgagttcagtggaagtggatcgtgggactagtacctttacgctcaccatcagcagctgcagcctagaagntagttgacaactatattactagtacaactagtatagattcgtactccgttactaacgttttccgggaccctaggggtaacccaggtaacggttgaacctaagttaacgaaaacggtaactggtcggcttacggaccg

SEQ ID NO: 412672 - DNA, 577 bp, Homo sapiens
  misc_feature: GZ8MTXP02IJZP4.11.73.G07.1.454.CMB.2.raw
  modified_base (369)..(369): a, c, t, g, unknown or other
  modified_base (473)..(473): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccatgtggcgtgcacctagtggagtcgtgggggagcttggtacagcctggacggtccctgagactctcctgtgcagcctctggatacatcttacaaaagtttcgaaatgagcgtgggtccgccaggctccggtaggggaacggggccgagtggtatttcatacatcgagtagtagtgtaaactcttgtactntgacagactcgtggtagaacgggccgtactaccacctacgtcctaccgagacgaacaaaccgaccaaagtaacttacacttgtttctagactaaagtagaaacncgacctagagaagacgagacgtacggtacttatttactattgtacgtcgacgtagtaacgaaacgaaaggtaaaacggcggtacggaccgttaggtttcggggg

SEQ ID NO: 412673 - DNA, 542 bp, Homo sapiens
  misc_feature: GZ8MTXP02IC516.11.73.G07.1.454.CMB.2.raw
  modified_base (255)..(255): a, c, t, g, unknown or other
  modified_base (270)..(270): a, c, t, g, unknown or other
  modified_base (315)..(315): a, c, t, g, unknown or other
  modified_base (373)..(373): a, c, t, g, unknown or other
  modified_base (382)..(382): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacaattaagaatattaaattggtatcggnagcgacgaggaaacnccctgagctctagatctacgatcgcgttacaaagttggaaaaccnggtacggtcccccaccggtagttcgagtggaagtggatgtagggactagtactttacnctacactanacacgcacgctagcgacgacaagatatatagactaaatattacgttactagaactaagtatacgtacgtactaccgtcttaccttacgtacgtttccggaccgtacgggacaggtcgtaagaactaaggtaacgaaacgtcgtaggtcgacgtacgtacg

SEQ ID NO: 412674 - DNA, 558 bp, Homo sapiens
  misc_feature: GZ8MTXP02GQIF8.11.73.G07.1.454.CMB.2.raw
  modified_base (151)..(151): a, c, t, g, unknown or other
  modified_base (294)..(294): a, c, t, g, unknown or other
  modified_base (352)..(352): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtnctccttgttactatttagaaggtgtccatgtggcgtgcacctagtggagtcgtgggggagcttggacagcctggacggtccctgagactctcctgtgcagcctctggatacatcttacaaaagtttcaaatgagctgggtccncaggctccggtaggggaaggggccgagtggatttcatacatcagtagtagtgtaaccncttgactgcgcagtactgtaggtaggaacgggtcctagttaccacctactcctaccgagacgaacaaccgaccaaagtacttactacttgtttctagactaaagtagaacagacctagagagacgagactacgtacttattactattggtcgacgacacgtaacgaacgaaaggtaaaacgcggtacggtacctaggtttacgggg

SEQ ID NO: 412675 - DNA, 541 bp, Homo sapiens
  misc_feature: GZ8MTXP02HDZC6.11.73.G07.1.454.CMB.2.raw
  modified_base (295)..(295): a, c, t, g, unknown or other
  modified_base (305)..(305): a, c, t, g, unknown or other
  modified_base (352)..(352): a, c, t, g, unknown or other
  modified_base (361)..(361): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccatgtggcgtgcacctagtggagtcgtgggggagcttggtacagcctggacggtccctgagctctctgtgcagcctctggatacatcttacaaaagtttcgaaatgagctgggtccncaggctccgnggggaacggggccgagtggatttcatacatcagtagagtggtaaacncttgtactntgacagtactgtgtaggaacgggccattccacatcctccagacgacaacgaccaaagacttcacttgttctagacaaatgaacagcctagagagaacgagaactacggacttatttactagttcgtgcgtacgaatcgaacgaaacggaaaacggtcggacggtacgtaggtttcggggg

SEQ ID NO: 412676 - DNA, 521 bp, Homo sapiens
  misc_feature: GZ8MTXP02GALM0.11.73.G07.1.454.CMB.2.raw
  modified_base (350)..(350): a, c, t, g, unknown or other
  modified_base (367)..(367): a, c, t, g, unknown or other
  modified_base (376)..(376): a, c, t, g, unknown or other
  modified_base (404)..(404): a, c, t, g, unknown or other
  modified_base (492)..(492): a, c, t, g, unknown or other
  modified_base (502)..(502): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctgggacggtccctgagactctcctgtgcagcctctggatacatcttacaaaagtttcgaaatgagctgggtccgccaggctccgtggggaaggggccggagtggatttcatacatcagtagtagnggtaacaccttgtactntgcagactntgtgaagggccgattcacatctccaganacaacgccaaagaattcactgtttactgtacaaatagaacagcctgagagacgagatacggctatttactattgtgtacgcgatcganaagaaaacgnggtacggcctagttcgggg

SEQ ID NO: 412677 - DNA, 565 bp, Homo sapiens
  misc_feature: GZ8MTXP02IWBQA.11.73.G07.1.454.CMB.2.raw
  modified_base (298)..(298): a, c, t, g, unknown or other
  modified_base (355)..(355): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcatgcacctagtggagtcgtgggggagcttggtacagcctggacggtccctgagactctcctgtgcagcctctggatacatcttacaaaagtttcgaaatgagctgggtccncaggctccgtggggaacggggccgagtggatttcatacatcagtagtagtggtaacnccgtttgactatgcagtacctcgtaggtagaaaggggcctattccaaccattcctaccagacgaaccaaccgaccaaagtaacttcacttgtttcagtacaaagtcgaacacgcctaggagagacgaggtactacggtacttaactttactagttcgtacgcgacgtaagtacgaacgtaaagaaaacggcgggtacgtaccgtttaggg

SEQ ID NO: 412678 - DNA, 622 bp, Homo sapiens
  misc_feature: GZ8MTXP02JPPY6.11.73.G07.1.454.CMB.2.raw
  modified_base (304)..(304): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccatgtggcgtgcacctagtggagtcgtgggggagcttggtacagccgtggaccggtccctgagactctcctgtgcagcctctggatacatcttacaaaagtttcgaaatggagtcgtggggtcccnccgaggcctccggtgggggaaacgggggcccggtaggttggtatttcgaatacatcaaggttagtagtacggtaactccttagactgtcgcagtactgtaggtaggaacgggccgtattaccacctactcctaccaaggacgaaccgaaccgaccaaagtaacttacacgttagtttactagacctaaagtacgaaacgacgtaccgagaggaacggaacgaggaacgtacggtacttaatttaacttagttgtacgtcgtacgtacgtaacgaacgaaaggtaaaacggcggtacggtaccgttaggtttacggggg

SEQ ID NO: 412679 - DNA, 651 bp, Homo sapiens
  misc_feature: GZ8MTXP02F8WST.11.73.G07.1.454.CMB.2.raw
  modified_base (258)..(258): a, c, t, g, unknown or other
  modified_base (369)..(369): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagactctcctgtgcagcctntggatacatcttacaaaagtttcgaaatgagcgtgggtccgcaggctccgtggggaaggggccggagtggatttcatacatcagtagtagtaggtaacctacttgtaactntgacagacttcgtggtaggaacgggccgattccacctatcctaccgagacgaaccaaacgacccaaaagtaacttacctaacgttgtttacctagtaactaaaattacgaaaccacgtaccgtaggaaacggaaggaaaccggaagggtaacgttaaccggggtactttaaattttaacgttaaacgtttacggttcggacggtacggtaacgtaacggaaacgtaaaacgggaaaaaacgggtccggggttacgggtacccggtttaagggtttcgggggg

SEQ ID NO: 412680 - DNA, 682 bp, Homo sapiens
  misc_feature: GZ8MTXP02G5P99.11.73.G07.1.454.CMB.2.raw
  modified_base (262)..(262): a, c, t, g, unknown or other
  modified_base (303)..(303): a, c, t, g, unknown or other
  modified_base (378)..(378): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagccgtggaccggtccctgacgacctctcctgtgcagcctntggatacatcttactaaaagttcgaaatgagcgtcgggccnccgaggctccggaggggaacgggccgagtggtattcatacatcgaagttagtagtacgtaactccgttagtactntcggactaacgtacttcgtagggtacgggtaaaccgggggtcccttaactttacccaaccgtacgttcccgaacccgtaagaacgtaaaccccgaaaccgaccctaaaagttaccttacgtactttacggtttacacgtaactaaaagttacgaaaccgtacgtacccgtaggaacgaaggaacggtaagtaacgttaacggtactttaacgtttacgttagttcggtcggacccgtaggttaaacgaaccgaaacggaaaaggtaaacgggcgggttaacgtaccggtttagggtttcggggg

SEQ ID NO: 412681 - DNA, 602 bp, Homo sapiens
  misc_feature: GZ8MTXP02JUUE0.11.73.G07.1.454.CMB.2.raw
  modified_base (194)..(194): a, c, t, g, unknown or other
  modified_base (250)..(250): a, c, t, g, unknown or other
  modified_base (266)..(266): a, c, t, g, unknown or other
  modified_base (311)..(311): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcactgccaggcagtcagacataagaactattaaatggtatcgnagcgaccgaggaaacncccctgacgctcctgatctagatcgcgtacctaaagtttgaaacnggtacgtacccccgaccggtaggttcaggtaggtaaagtggatcgaggggtacctagtactttacactcacgtataccagcaagccgtcgacgacgtacctagggaaatacgttaaacgttcgaaacctaactaacgtttaatttaacgttcgttaacaaacgtagttaagtacggtacttccggtaccttccgttacgtaacgttttaccggcccggttagggacccgaagtacggtacgtaaccgaagtaacggtaaaaccgtaagtcggtacggactaggtaaccccg

SEQ ID NO: 412682 - DNA, 532 bp, Homo sapiens
  misc_feature: GZ8MTXP02JB4CC.11.73.G07.1.454.CMB.2.raw
  modified_base (297)..(297): a, c, t, g, unknown or other
  modified_base (354)..(354): a, c, t, g, unknown or other
  modified_base (362)..(362): a, c, t, g, unknown or other
  modified_base (468)..(468): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggacggtccctgagactctcctgtgcagcctctggatacatcttacaaaagtttcgaaatgagctgggtccncaggctccgtggggaacggggccgagtggatttcgatacatcagtagtagtgtaacncttgactntgcagtactgtgtagaacgggccgattcaccatctcagacgacaacgaccaagaattcaacttgttactagacaaagtagaacagctagagagacgagatacggtntattactattagtcgacgcgactcgaacgaagtaaaacggcggtacgtaccgttagttcggggg

SEQ ID NO: 412683 - DNA, 580 bp, Homo sapiens
  misc_feature: GZ8MTXP02JD3YD.11.73.G07.1.454.CMB.2.raw
  modified_base (196)..(196): a, c, t, g, unknown or other
  modified_base (288)..(288): a, c, t, g, unknown or other
  modified_base (402)..(402): a, c, t, g, unknown or other
  modified_base (414)..(414): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatccctccctgtctgcatctatagganacagacgtcaccatcacttgccaggcgagtcaggactaattaaagaacttaatttaaattggtaatcggacaggacgaccgaagggaaaccncccctagacgctcctgactctacgatcgcgtacctaagtttaggaaacagtacggtaccccccaacggtaggttcaagggtcggaagtgtagtcgtagggactagtactttacnctacaccatcancagccctgcacgcctagaagtattagttgactaaactattaacttacgtagtaccaaataggtatacggtacttccgtactaccttacgtaacgtttcccggaccgttagggaacctaggtacgtcgaaacgaagtaacgaaacgtacgtggacgtcctacgaccg

SEQ ID NO: 412684 - DNA, 572 bp, Homo sapiens
  misc_feature: GZ8MTXP02JF9W7.11.73.G07.1.454.CMB.2.raw
  modified_base (266)..(266): a, c, t, g, unknown or other
  modified_base (299)..(299): a, c, t, g, unknown or other
  modified_base (517)..(517): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagctctcctgtgcagcctcgtggatacntcttacaaaagtttcgaaatgagcgtgggtccnccaggcctccgtggggaacggggccggagtggatttcatacatcaggtatagtagtaactaccgttgtactagtcgacagtaccttgtaggtaggaaacgggcccgtaattccaccatcctcccagacgacaacgacaagattcacttgtttcagacaaatacgaacagacctagaagaggacgagagtacggtcttaatttactagttgtcgaccgngtaacgtaacgaacgaaaggaaaacggtgggtacggtaccgttaggtttcggggg

SEQ ID NO: 412685 - DNA, 525 bp, Homo sapiens
  misc_feature: GZ8MTXP02FTPY5.11.73.G07.1.454.CMB.2.raw
  modified_base (296)..(296): a, c, t, g, unknown or other
  modified_base (412)..(412): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggacggtccctgagactctcctgtgcagcctctggatacatcttcaaaagtttcgaaatgagctgggtccnccaggctccgtggggaaggggccggagtggatttcatacatcagtagtagtggtaacaccttgtactatgacagactctgtgaagggccgattcacatctcagagacaacgacaanaattcactgtttctgacaaatagaacgagcctgagagacgaggatacggtctatttactattgtacgcgcagtaacgaagaagaaaacgcggtcggaccgtagtttacggggg

SEQ ID NO: 412686 - DNA, 563 bp, Homo sapiens
  misc_feature: GZ8MTXP02H4L9Z.11.73.G07.1.454.CMB.2.raw
  modified_base (250)..(250): a, c, t, g, unknown or other
  modified_base (363)..(363): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcagtcaggacataagactattaatgtatcggnagcgacaggaacgccctgagctcctgatctagatgcgttaccaaatttggaaacacgaggtcccccaccggagttacagtaggaagtggatcgtggggactagtacctttacnctcaccatcagcagcctgacagacctgaagacttattacgactaaactattacttaactcgtaccaacgtagtacgtagtacttccgtactacctttacaacgttttccggacccgttacggggaaccctaggtacggtcggaaaccgtaattaaccgggaaaaccgtaaccgttagggtacgggtccttaggtaacccc

SEQ ID NO: 412687 - DNA, 607 bp, Homo sapiens
  misc_feature: GZ8MTXP02H5QNS.11.73.G07.1.454.CMB.2.raw
  modified_base (258)..(258): a, c, t, g, unknown or other
  modified_base (300)..(300): a, c, t, g, unknown or other
  modified_base (410)..(410): a, c, t, g, unknown or other
tcagcgagagataccacgaccggtgctcgatttagctctacgctcaggggatctcagagaggtgccttagccttggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagactctcctgtgcagcctntggatacatcttacaaaagtttcgaaatgagcgtcgggtccncgaggcctccggtgggggaacggggccggagtggtattcatacatcagtagtagtggtaactcgttgtactgtgcagactcgtggaggaacgggccgtatcacctatccncgaagacgaacaaccgaaccaagtaacttctactttagtttcctagactaaaagtcgtaaacacgtaccgtagaagaacgaacggacggtaacgttacggtactttaaacgtttacttaacgttagtcgacgtcgtaacgtaacgaaaccgtaaaaggaaaacggtcgggtacggtaccgtttaagggtttcggggg

SEQ ID NO: 412688 - DNA, 486 bp, Homo sapiens
  misc_feature: GZ8MTXP02FYM2C.11.73.G07.1.454.CMB.2.raw
  modified_base (360)..(360): a, c, t, g, unknown or other
  modified_base (367)..(368): a, c, t, g, unknown or other
  modified_base (370)..(370): a, c, t, g, unknown or other
  modified_base (373)..(373): a, c, t, g, unknown or other
  modified_base (375)..(375): a, c, t, g, unknown or other
  modified_base (393)..(393): a, c, t, g, unknown or other
  modified_base (410)..(410): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcagtcaggacattaagaactatttaaatgtatcggcagcgaccagggaaagcccctgagctcctgatctacgatgcgtccaaatttggaaacagaggtccccacgaggttcagtggaagtggatctggggacagactttacnctcacannancancngcagacagagatataganaacatatactatacaanatatatatactctctactacttacgtccgtcggacgacgacgtagacaagtacgaaacgaaacgtagtcgcgcgac

SEQ ID NO: 412689 - DNA, 680 bp, Homo sapiens
  misc_feature: GZ8MTXP02HHHIL.11.73.G07.1.454.CMB.2.raw
  modified_base (196)..(196): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatccctccctgtctgcatctatagganacagatcaccatcacttgccaggcgagtcgaaggactaattaaagaacttaatttaaagttggtatcggcacgaccgaccgaagggaaaccgccccgtgacgccttccgtgaatccgtaacgatcggaccgttactaaagtttaggaaaccaggtaccggtaccccccgaccggtaggttacgaagggtacggaaggtggtcgtacgtagggggaaacctacgttaacctttactccgtaccctaaccagttccgacgaccgaacgtcccgtacgccgaacgtaccgtaaggtaaacgtatttagtacgaactaaactaagtttacttacgtacgtaactaaacgtagttacttagacgtttccgttcccttaccgttaacgttaccggtttcccgggaccggttacggaacccggtaggtaacggtacggaactaacggtaacggtaaaacggtacgttaggttaccggacgtaccgaacccg

SEQ ID NO: 412690 - DNA, 589 bp, Homo sapiens
  misc_feature: GZ8MTXP02GND7L.11.73.G07.1.454.CMB.2.raw
  modified_base (365)..(365): a, c, t, g, unknown or other
  modified_base (374)..(374): a, c, t, g, unknown or other
  modified_base (539)..(539): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtggggggagcttggtacagcctgggaccggtccctgagactctcctgtgcagcctctggatacattcttacaaaagtttcgaaatgagcgtcggggtccgccgaggctccggtggggaacggggccggagtggatttcatacatcagtagtagtgtaacncttgtactntgcagacttcgtggtagggaaacggggtcccgtattaccacccatcctaccgaagaacgaacaaacgaccaaagtaacttactacttcgtttctagactaaaatagaaacacgccgtaggaagagaacgagtacgtacggtactttatttacttattcgtcgcgngagtaacgaacgaaaggaaaacggcggtacggtaccgtaggtttcggggg

SEQ ID NO: 412691 - DNA, 605 bp, Homo sapiens
  misc_feature: GZ8MTXP02F2ZM5.11.73.G07.1.454.CMB.2.raw
  modified_base (257)..(257): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccatgtggcgtgcacctagtggagtcgtgggggagcttggtacagcctggacgtccctgagactctcctgtgcagcctcnggatacatcttacaaaagtttcgaaatgagctgggtccgcaggctccgtaggggaacggggccggagtggatttcgatacatacagtagtagtaggtaactaccgttagtactagtgacagtacctcgtagtacggaacgggaccgtattccacctatcctaccgaagacgaacaaccgaccaaagtacttactacttgtttacctagactaaaagtacgaaaccacgactaggaaggagacgaaggtaagtaccggtactttaaatttacgtagtttaggtacgcgtacgacgtaaccggaacgaaaaggtaaaacggcgggtacggtaccgttaggtttacggggg

SEQ ID NO: 412692 - DNA, 544 bp, Homo sapiens
  misc_feature: GZ8MTXP02FGHY8.11.73.G07.1.454.CMB.2.raw
  modified_base (364)..(364): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggacggtccctgagactctcctgtgcagcctctggatacatctacaaaagtttcgaaatgagctgggtccgccaggctccgtggggaaggggccggagtggatttcatacatcagtagtagtggtaacaccttgtactntgcagactctgtgaagggccgattcaccatctccagagacaacgaccaaagaattacactgtttctgacaaatagaacagacctagagagacgaggagtaacggtctatttacctaagttgtacgtcgacgataacgaacgaacggaaaaaggcggtacggaccttacggtttacggggg

SEQ ID NO: 412693 - DNA, 612 bp, Homo sapiens
  misc_feature: GZ8MTXP02HC9AH.11.73.G07.1.454.CMB.2.raw
  modified_base (298)..(298): a, c, t, g, unknown or other
  modified_base (308)..(308): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccatgtggcgtgcacctagtggagtcgtgggggagcttggtacagcctggaccggtccctgagactctcctgtgcagcctctggatacatcttacaaaagtttcgaaatgagctgggtccncaggctccgnggggaacgggccgagtggatttcgatacatcagtagtagtgtaactacttgtactgtgcagtactcgtgaggaacgggccgtattccgacctagtcctaccgaagacgaaccaaaccgaccgaaagtaacttaccactttacgtttactagaacctaaaatacgaaacacgaccgtagaaggacgaacggaaggaacgttaacggtacctttaatttaaccgtagttacggtcgaccggtacgtaacgtcgaaacgaaaacggtaaaaacggtccggtacggtaccgttaacgggtttcggggg

SEQ ID NO: 412694 - DNA, 708 bp, Homo sapiens
  misc_feature: GZ8MTXP02GY5DK.11.73.G07.1.454.CMB.2.raw
  modified_base (275)..(275): a, c, t, g, unknown or other
  modified_base (287)..(287): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctccctgtctgcatctataggagacagagtcaccatcacttgccaggcgagtcaggactaattaagaactatttaaatggtatcggcagcgacgagggaaacnccctgacgctcngactctacgatcgacgtacctaagtttaacggaaacacgggtacggtacccccccaaccgggtaggtttaccaagggttacggggtaaagtcgggtagttccgttagggggaacctaacgttaccttttacctccgttaccaaccattaccgaacgtccacgtccctaggacccgagtcccgtaagggaaactactttaagttcgaaactaaaccttattaaatttaccgtagttaaacccgaaagttaacgttacgtaaggtacctttaacccggtcctttacccctttaaccgttaaacgggtttttacccccggggccccggtttaaacgggggaacccgtaagggtaccgggtttagggaaactaaacggtaacggtaaaaaccggacggttacggttcggacgtacggtaaacccg

SEQ ID NO: 412695 - DNA, 597 bp, Homo sapiens
  misc_feature: GZ8MTXP02JYLSZ.11.73.G07.1.454.CMB.2.raw
  modified_base (274)..(274): a, c, t, g, unknown or other
  modified_base (324)..(324): a, c, t, g, unknown or other
  modified_base (359)..(359): a, c, t, g, unknown or other
  modified_base (383)..(383): a, c, t, g, unknown or other
  modified_base (588)..(588): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccactcctccctgtctgcatctataggagacagagtcaaccatcacttgccaggcgagtcagtacattaagaacttattaatggtatcggcagcgacgagggaaacncccctgacgctccgtgactcgtacgatcgacgtactaagttacgaaacgnggacggtccccacggtaggttcaggtggaaggtgngtcgtagggactagtacctttacncctacgacctatacacgtcacgcctagcacggtacctagaaagtattaagttcgaacctaaactatttaactacgttagtaactaaaaccgtaggttaaactcgtaacgttcccgttaccgttacccttacgtaacgtttcccggacggtaacggaccgtaggacggtacgaacgtaagtaacggaaaaccgtgtaggcggtacncggtaaccg

SEQ ID NO: 412696 - DNA, 552 bp, Homo sapiens
  misc_feature: GZ8MTXP02G4K28.11.73.G07.1.454.CMB.2.raw
  modified_base (250)..(250): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcagacataagaactattaatgtatcgnagcgacgaggaaacgcccctgagctctgatctagatcgcgtactaagtttagaaactaggacggtcccccgacgtagttcaggtggaaggttggactcgtagggactagtactttacgctacaccatcagcagcctgcagctagagactagtgactaaatattacttactagtacaactaggtataggtaacttcgtctaccttactaacggtttccggacccgttacgggaccctaggtacggttacgaacgtaacgtaacggtaaaacggtaccgtaggtacggtacgtacggtaacccg

SEQ ID NO: 412697 - DNA, 673 bp, Homo sapiens
  misc_feature: GZ8MTXP02HASZD.11.73.G07.1.454.CMB.2.raw
  modified_base (260)..(260): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcactagtggagtcgtgggggagcttggtacagcctgggaccggtccctgagactctcctgtgcagcctcnggatacattcttaactaaaagtttcgaaatgagtcgtcgggtccgccgaggtcctccggagggggaacggggcggtaggtggtatttcaagtacatacgaggttagtagtacggtaaacctcgtttagtaacttgtcgactagtaccttcggtaggtacgggaacgggaccgtacttaccacctactctacccgaagaccgaaccaacgaccaaagtacttacctacgtttagtttcagtacaaagtacgaaacgacgaccgtaggaacggaacggaacggaaaggtacttaacgggttacctttaaagttttaccttaaggttcgtcgggtacgtaaccggtaagtaaccgaaaggtaaaaacggtaaaacgggtccgggtaccgggtaaccggttaagggttttcgggggg

SEQ ID NO: 412698 - DNA, 584 bp, Homo sapiens
  misc_feature: GZ8MTXP02H9OET.11.73.G07.1.454.CMB.2.raw
  modified_base (193)..(193): a, c, t, g, unknown or other
  modified_base (366)..(366): a, c, t, g, unknown or other
  modified_base (414)..(414): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctatagganacagagtcaccatctacttgccaggcgagtcaggacattaaagaacttaatttaaagttggtatcggacaggaccgaaccgaagggtaaaccgcccctgacgtctcctggactctacgatggcgtactaaagtttaggaaacaggacggtccccacgtagtcaggtggagtgntcgtaggactagtactttcactacaccatacacgcacgcctagcgtanaccgtagaagtattagttacacaaacttattaacttacgtagttaacaactagttacgtagtactacgttacctccgttactaacgtttcccggacccgttaggggaaccctagggtacgttacggaactaagtaaacgtaaacgtacgtaggtaccgtcgtaccgaccg

SEQ ID NO: 412699 - DNA, 511 bp, Homo sapiens
  misc_feature: GZ8MTXP02FTZ3C.11.73.G07.1.454.CMB.2.raw
  modified_base (257)..(257): a, c, t, g, unknown or other
  modified_base (298)..(298): a, c, t, g, unknown or other
  modified_base (352)..(352): a, c, t, g, unknown or other
  modified_base (360)..(360): a, c, t, g, unknown or other
  modified_base (369)..(369): a, c, t, g, unknown or other
  modified_base (386)..(386): a, c, t, g, unknown or other
  modified_base (389)..(389): a, c, t, g, unknown or other
  modified_base (416)..(416): a, c, t, g, unknown or other
  modified_base (424)..(424): a, c, t, g, unknown or other
  modified_base (470)..(470): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggacggtccctgagctctcctgtgcagccctntggatacatcttacaaaagtttcgaaatgagcgtgggtccnccaggctccgtggggaagggccgagtggatttcatacatcagtgtagtgtaacncttgactntgcagactntgtagaggcgattcacntcnccagagacaacgcaagatcactgttcngacaatanaacagacctgagagacgagatacggacttattactagttcgtgcgngatcgaacaaggaaaacgcggtacgaccgtagtttcggggg

SEQ ID NO: 412700 - DNA, 538 bp, Homo sapiens
  misc_feature: GZ8MTXP02HWYZX.11.73.G07.1.454.CMB.2.raw
  modified_base (348)..(348): a, c, t, g, unknown or other
  modified_base (358)..(358): a, c, t, g, unknown or other
  modified_base (369)..(369): a, c, t, g, unknown or other
  modified_base (487)..(487): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttgggacagcctgggacggtccctgagactctcctgtgcagcctctggatacatcttacaaaagttcaaatgagctgggtccgcaggctcgtggggagggccggagtggattcatacatcagtagtagtgtaacnccttagactntgcagtacttntgtaggaacgggccgtattcactatcctcagacgacaacgccaagacttacattgttctagacaaatgaacagacctggagagacgaagagtacggtacttattactattgtcgcganacgtaacgaagaaacggaaaacggcggtacggtaccgtaggtttacggggg

SEQ ID NO: 412701 - DNA, 624 bp, Homo sapiens
  misc_feature: GZ8MTXP02JH0GV.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagtcttggtacagcctgggacggtccctgagactctcctgtgcagcctcgtggatacatcttacaaaagtttcgaaatgagcgtcgggtccgccgaggcctccggtagggggaacggggccggaggtgggtatttccgatacatcgaggtagtagtacggtaaacctaccgtttagtaactagtgactaggtaccttcgtaggtacgggaacggggtacccgtattaccaaccctatcctaccgagaacgaaccaaaccgaccaaagtaacttacctacttgtttactagtacaaagtagaaacgacgacctaggaagaggacggaagaacgtacggtacttatttactagttcgtcgacgtcgataacgaacgaaacggtaaaacggcggtacggtaccgttaggttcgggg

SEQ ID NO: 412702 - DNA, 566 bp, Homo sapiens
  misc_feature: GZ8MTXP02HZ0BB.11.73.G07.1.454.CMB.2.raw
  modified_base (358)..(358): a, c, t, g, unknown or other
  modified_base (367)..(367): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagactctcctgtcgcagcctctggatacatcttacaaaagtttcgaaatgagcgtgggtccgcaggctccgtggggaacggggccgagtggtatttcatacatcagtagtagtggtaacncttgtactntgcagactgtgtagaagggcatcacatctcagacacaacgacaagaattcactttgtttactgaacctaaaagtcgaaactagacctaggacgacggccgaagggaccgaaccgggtccgttaaatttacgtttacgtagtacgaacgaaaaggtcgtaaccgggataagttagtaaggtccgtacctaacggtacggg

SEQ ID NO: 412703 - DNA, 630 bp, Homo sapiens
  misc_feature: GZ8MTXP02HDCJU.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactatttagaaggtgtccactgtggcgtgcacctagtggagtcgtgggggagcttggtacagccgtggacgtccctgagctctcctgtgcagcctcgtggatacatcttaactaaagtttacgaaatgagtcgtcgggtcccgccgaggcctaccggtaggggaacgggggccggtaggtcggtatttacatacatcgagtagtagtacggtaactacgttgtactgtcgcagtactcgtaggagggaacgggccgtatccgaccatcctacgagacgaacaacgacaaagtacttactactttcgttactagaactaaagtacgaaactacgacgtaggaacggaacgaacggtaaggtaacgttacggtacttttaactttaacgtagttcgtacggcgtaacgtacgtaaccggaaagaaaacgggtaaaacgggtcggtacgggtaccggtttagggtttcggggg

SEQ ID NO: 412704 - DNA, 602 bp, Homo sapiens
  misc_feature: GZ8MTXP02GF592.11.73.G07.1.454.CMB.2.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacaattaagaactaattaaatgtatcggcagcgacaggaaacgcccctagagctcctagactactacgatgccgttaccaaagtttaggaaaacacggacggtaccccccaccggtaggttcaaggtggggaaagttgggacttcgagggggtaactaacggtacctttaactctaccacccatacagcagcctaggcagcctagaaagtatagttcaactaaactattaactttaactggtaacaaaactagttatagtacttccgttactcctaactaaacgttttccgggaccccgttaggggaccccaaggacgttagggaacctaaagttaacggaaaaacgtaccgttaggacgggtacttacgaaccc

SEQ ID NO: 412705 - DNA, 637 bp, Homo sapiens
  misc_feature: GZ8MTXP02ID61F.11.73.G07.1.454.CMB.2.raw
  modified_base (257)..(257): a, c, t, g, unknown or other
  modified_base (385)..(385): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctcttgttactattttagaaggtgtccactgtggcgtgcacctagtggagtcgtgggggagcttggtacagcctggacggtccctgagactctcctgtgcagcctntggatacatcttacaaaagtttcgaaatgagcgtcggggtccgccgaggcctccggtagggggaacggggccggtaggtggtatttcaagtacatcgagttagtagtaggtaaactcgtttagaactntgacagtactcgtggtacgaaacgggccgtattaccaacctacttccctaccgaaggaacggaaaccaaaccgaccctaaaagtaacttacctaacgttcgtttactacgaactaaaagtacgaaacgacgaccgtaggaaggaacgaacggaaggaacgtaacggtactttaaatttaactaagttcgtcgacgacgaagtaaccgaaacgaaaggaaaaacggcgggtacggaccgttaggtttcggggg

SEQ ID NO: 412706 - DNA, 550 bp, Homo sapiens
  misc_feature: GZ8MTXP02GL051.11.73.G07.1.454.CMB.2.raw
  modified_base (298)..(298): a, c, t, g, unknown or other
  modified_base (354)..(354): a, c, t, g, unknown or other
  modified_base (362)..(362): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagactctcctgtgcagcctctggatacatcttacaaaagtttcgaaatgagctgggtccncaggctccgtggggaaggggccgagtggatttcatacatcagtagtagtggtaacncttgactntgcagactgtggtgaacgggcgattcacatctccagacgacaacgaccaaagaattacacttagtttctagacctaaatagaaacgtagccgtagacgagaacgaggaatacggtacttagtttactagttgtcgacgagacgtaacgaacgaaagaaaacggcggtacggaccgtaggttacggggg

SEQ ID NO: 412707 - DNA, 616 bp, Homo sapiens
  misc_feature: GZ8MTXP02IIC7U.11.73.G07.1.454.CMB.2.raw
  modified_base (194)..(194): a, c, t, g, unknown or other
  modified_base (272)..(272): a, c, t, g, unknown or other
  modified_base (384)..(384): a, c, t, g, unknown or other
  modified_base (416)..(416): a, c, t, g, unknown or other
  modified_base (436)..(436): a, c, t, g, unknown or other
  modified_base (471)..(471): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagatcaccatcacttgccaggcagtcaggactattaagaacttaatttaaatggtatcggcagcgacgagggaacnccccgtagagctcgtagactctaacgattcgaccgttacctaaagtttacggaaaactaggaaccgtacccccgaaaccggtaggtttacaagggtacgggaaggttagggngttcggtaggggaacctacgttaacctttacncttacccaactatacgaacncgacgcctgaccacgtcctaagaagtattagttanaactaaactattattactagtaccaagtagtatacggatacgtcttactacgttaacgttccggaccggttacggaacctagggtaacgttcggaactaaggttaaacggaaaccgtacggttggacggtaccttaggaaccccg

SEQ ID NO: 412708 - DNA, 616 bp, Homo sapiens
  misc_feature: GZ8MTXP02GU9I4.11.73.G07.1.454.CMB.2.raw
  modified_base (255)..(255): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactatttagaaggtgtccatgtggcgtgcacctagtggagtcgtgggggagcttggtacagcctggaccggtcctgagctctcctgtgcagcctntgatacatcttacaaaagtttcgaaaatgagctcgggtcccgcgaggcctccggtaggggaacggggccgaggttggatttcgattacattacgagttagtaggtacgtaaacctccgtttagtaactagtgacaggtactcgtaggtacggaacgggcctattccacatctaccgagaccgactaaacgacaaagacttacctacttcggttactagaactaaagtacgaaacacgtaccgtaggaacgaaggaacgtaggacgttaacggtactttagtttaacttacgtttgacgtaccgagtaacgccgaaacgaaaaggaaaacggcgggttacgaccgtttaagggtttcggggg

SEQ ID NO: 412709 - DNA, 534 bp, Homo sapiens
  misc_feature: GZ8MTXP02I5HFQ.11.73.G07.1.454.CMB.2.raw
  modified_base (364)..(364): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaatggtatcggcagcgacaggaaacgcccctgagctctgatctacgatgcgtcctaaatttaggaaacagacggtccccacgagtttcaggtggaagtggatcgtgggactagacctttacnctcaccatcagcagcctgccagcctagaagtatattgacaactattattactagtacaaactagttatggtaacttcgtacttcctactaacgttttcccggacccgttacggggaccctaggtaacgtggaacctaagtacgaaaacgtacgtagtcggactacgaacc

SEQ ID NO: 412710 - DNA, 526 bp, Homo sapiens
  misc_feature: GZ8MTXP02FK97N.11.73.G07.1.454.CMB.2.raw
  modified_base (365)..(365): a, c, t, g, unknown or other
  modified_base (374)..(374): a, c, t, g, unknown or other
  modified_base (437)..(437): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctggacggtccctgagactctcctgtgcagcctctggatacatcttacaaaagtttcgaaatgagctgggtccgccaggctccgtggggaaggggccggagtggatttcatacatcagtagtagtggtaacacttgtactntgcagactntgtgaagggcgattcacatctccagagacaacgacaagaattacactgtttctgacaaaatanaacagcctagagagacgagatacggactatttactaattgtgcgcgataacgaacaacgaaaaaggcggtacggaccgtagttcggggg

SEQ ID NO: 412711 - DNA, 537 bp, Homo sapiens
  misc_feature: GZ8MTXP02IF0DC.11.73.G07.1.454.CMB.2.raw
  modified_base (270)..(270): a, c, t, g, unknown or other
  modified_base (384)..(384): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaacttattaaatggtatcggcagcgacagggaacnccccgtgagctcctgatctaacgatcgcgtacctaagtttacggaaacagacggtcccccaccggtagttcaggtggaagtggtagtcgtgggactagtactttactctcaccntcagcacgcctgcagacctagaacgtatattagaacctaactattaacttacgtataccaatagtatcgtatccgtcttaccctactacgtttccggccgttacgggacctaggacgtgaacaagtacgaaacgtactggtcggtactcgacc

SEQ ID NO: 412712 - DNA, 574 bp, Homo sapiens
  misc_feature: GZ8MTXP02JZSLN.11.73.G07.1.454.CMB.2.raw
  modified_base (299)..(299): a, c, t, g, unknown or other
  modified_base (354)..(354): a, c, t, g, unknown or other
  modified_base (363)..(363): a, c, t, g, unknown or other
  modified_base (464)..(464): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctgggaccggtccctgagctctcctgtgcagcctctggatacatcttacaaaagtttcgaaatgagctgggtccncaggctccgtggggaggggccgagtggatttcatacatcagtagtagtggtaacncttgtactntgcagactgtggtaggaacgggccgtattccaaccatcctccagacgaaccaacgacccaaagaacttaccactttcgtttactagactaaaatagaaacngacctaggaggagacggaggacgtacggtacttaagttacttagttgtcgcgtacgaataacggaacgaaacggtaaaacggtcgggtacggaccgttaggtttcggggg

SEQ ID NO: 412713 - DNA, 624 bp, Homo sapiens
  misc_feature: GZ8MTXP02HLAFP.11.73.G07.1.454.CMB.2.raw
  modified_base (277)..(277): a, c, t, g, unknown or other
  modified_base (303)..(303): a, c, t, g, unknown or other
  modified_base (366)..(366): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacaggccgtgggacggtccctggacgactctcctgtgcagcctctggatacatcttanaaaagtttcgaaatgagctgggtccncaggcctcgtggggaacgggcggagtggatttcatacatcagtagtagtgtaactcttgactntcgacagtactcgtaggtacggaaacgggcccgtaattcccgaacctacgttcctacccgaagtaacgaaaccaaacggtacaaaagtaactttaccgaacgtttgtttactagtaacctaaagtacgaaacgacgtaccgtaggaacgaaggaacggaggtaacgttaacggtactttaagtttaactagttgacgcggtacgacgtaacgaacgaaaaggaaaacggtcggtacggtaccgttaggtttacggggg

SEQ ID NO: 412714 - DNA, 565 bp, Homo sapiens
  misc_feature: GZ8MTXP02FO1B1.11.73.G07.1.454.CMB.2.raw
  modified_base (194)..(194): a, c, t, g, unknown or other
  modified_base (272)..(272): a, c, t, g, unknown or other
  modified_base (409)..(409): a, c, t, g, unknown or other
  modified_base (418)..(418): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcacatcacttgccaggcgagtcaggactattaagaacttattaaatggtatcggcagcgaccgagggaacncccctagagctcctgactctacgatgcgtacctaagttaggaaacaggacgtcccccacggtaggttacaggtggaacgtgggatcgtagggactagtactttacgctcaccatcagcagcctgcagctagaaacgnttatacganaactattaacttacgtagtaccaatagtagtgtactcgtaccttacctacgttaaacgttttcccggaccgttacgggaacccgtaggtaacggttacggaacctaaggtaacgtaaaaccgtacgtgtacgggacctacggtaccc

SEQ ID NO: 412715 - DNA, 571 bp, Homo sapiens
  misc_feature: GZ8MTXP02JI5FP.11.73.G07.1.454.CMB.2.raw
  modified_base (297)..(297): a, c, t, g, unknown or other
  modified_base (353)..(353): a, c, t, g, unknown or other
  modified_base (362)..(362): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacgtccctgagctctcctgtgcagcctctggatacatcttacaaaagtttcgaaatgagcgtgggtccncaggctccgtggggaaggggccgagtggatttcgatacatcagtagtagtgtaacncttgtactntgcagtactgtgtaggaacgggccgattcacctatcctccagacgaacaacgacaaagaacttacacttgtttctagacaaatacgaaacacgacctagagacggacgaggacgtaacggtacttagtttaactagttaggtcgaccggacgtacgtaacgtaaacgaaacggtaaaaacggcggtacggtaccgtaaggtttcggggg

SEQ ID NO: 412716 - DNA, 515 bp, Homo sapiens
  misc_feature: GZ8MTXP02I3AM0.11.73.G07.1.454.CMB.2.raw
  modified_base (258)..(258): a, c, t, g, unknown or other
  modified_base (298)..(298): a, c, t, g, unknown or other
  modified_base (307)..(307): a, c, t, g, unknown or other
  modified_base (350)..(350): a, c, t, g, unknown or other
  modified_base (368)..(368): a, c, t, g, unknown or other
  modified_base (480)..(480): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagactctcctgtgcagcctntggatacatcttacaaaagtttcgaaatgagctgggtccncaggctcgnggggaagggcgagtggatttcatacatcagtagtagtgtaacncgttgactatgcagactntgtaggaagggccgattcacatctccagacgacaacgacaagaattcactgttctagacaatagaacagcctgagacgagagactacggtactattactattgtgcgacgancgaacaacggaaaagcggtacgacgtacgttgggg

SEQ ID NO: 412717 - DNA, 643 bp, Homo sapiens
  misc_feature: GZ8MTXP02HMKAW.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggacagcctgggaccggtccctgagactctcctgtgcagcctctggatacatcttacaaaagtttcgaaatgagcgtgggtcccgccaggcctccgtggggaacggggccggagtggatttcagtacatcagtagtagtacggtaactaccgttgttactagtgacagtaccttcgtggtaggaaacgggccgtacttaccaccaacttccgtaccgaagacgaaccgaaaccggaccctaaagtaaacttaccgtaactttcggttttacttagaactaaaactacgaaaccgaacggacctaggaagacgaaacggtaggaacgtaacggtactttaaagtttacttaagttggtacgtaccgacgtacgtaacgaacgtaaacggaaaaacgggcggtacggtaccggtttacggtttcggggg

SEQ ID NO: 412718 - DNA, 547 bp, Homo sapiens
  misc_feature: GZ8MTXP02F7N4S.11.73.G07.1.454.CMB.2.raw
  modified_base (251)..(251): a, c, t, g, unknown or other
  modified_base (349)..(349): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctataggagacagagtcaccatcacttgccaggcgagtcaggacataagaactattaatgtatcggnagcgacgaggaaacgcccctgacgctcctgatctacgatgcgtcctaaagtttaggaaacaggacggtcccccaccggaggttacaggtggaagtggntcgtgggactagtactttacgctacacctatcagcagcctgcagcctagaacgtatattacgacaactattaattactagtaccaatagtatgacttacgtctacctactaacgtttccggaccgtacgggaccaggtacgttcggaaccgtaagttaacggaaaacgtaacgttcggtacggtcgttacgtaacccg

SEQ ID NO: 412719 - DNA, 525 bp, Homo sapiens
  misc_feature: GZ8MTXP02GKYQZ.11.73.G07.1.454.CMB.2.raw
  modified_base (310)..(310): a, c, t, g, unknown or other
  modified_base (356)..(356): a, c, t, g, unknown or other
  modified_base (364)..(364): a, c, t, g, unknown or other
  modified_base (373)..(373): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttgggacagcctgggacggtccctgagactctcctgtgcagcctctggatacatcttacaaaagtttcgaaatgagcgtgggtccgccaggctccgnggggaaggggccggagtggatttcatacatcagtagtagtgtaacncttgactntgcagactntgtagaacggcgatcacatctccagacgacaacgacaagactactactgttctgacaaatagaacagctagagagacgagatacggacttattactagtcgtgacgcgataacgaacaaaggaaaacgcggtacggaccgtaggttcggggg

SEQ ID NO: 412720 - DNA, 628 bp, Homo sapiens
  misc_feature: GZ8MTXP02HRYZA.11.73.G07.1.454.CMB.2.raw
  modified_base (379)..(379): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactatttagaaggtgtccatgtggcgtgcacgtagtggagtcgtgggggagcttggacagcccgtggaccggtccctgagactctcctgtgcagcctctggatacatcttactaaaagtttcgaaattgagcgtcggggtcccgccgaggcctccggtggggaacggggccggaggtggatttcatacatcgagtagtagtggtaactaccttgtactntcgacagtactcgtggtaggacgggtaccgattaccacctaactcctacccaagaacgaaccgaaccgaccgtaaacgtaacttaccgtacgtttacgtttacgtacgaactaaacgtacgaaacacggacctaggaaggaacgacggaaggaacgtaccggttacttaaatttactaagtttggcgtcgacgtacgtaacgaacgtaaaggaaaacggtcgggtacggtaccggtaggtttacggggg

SEQ ID NO: 412721 - DNA, 530 bp, Homo sapiens
  misc_feature: GZ8MTXP02IYL1S.11.73.G07.1.454.CMB.2.raw
  modified_base (374)..(374): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaacgcccctgagctcctgactctacgatcgcgtccaaagtttaggaaacaggacggtcccccaccggtagttcagtggaagtggatcgtgggacagtactttacnctcaccatcagacagcctgcagcctagaagatattcgacaactattacttactagtacaactagtatagtattcgtctacctactaacgtttcccggccgtagggaccaggacgtaggaacaagtacgaaaacgtaacgtggtacggtctacgacc

SEQ ID NO: 412722 - DNA, 720 bp, Homo sapiens
  misc_feature: GZ8MTXP02G85H5.11.73.G07.1.454.CMB.2.raw
  modified_base (309)..(309): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagctctcctgtgcagcctctggatacatcttacaaaagtttcgaaatgagcgtgggtccgcaggctccggnggggaaggggccgagtggattcatacatcagtagtagtggtaactcttgtactagtcgacaggtaccttcgtaggtacgggaaacggggtacccgtattacccaaccctacgttacccttacccgaagaaccggaaacccgaaaacccggaacccaaaacggttaaactttacccgtaaaccgtttcgtttttacccgttaggtaaccctaaaagttacgaaaaccgacggtacccgtacggaaagggaacggaaacgggtaaacgggaacggttaaaccgggtacttttaaacgttttaaaccggttaacgtttgggttaccggaccggtacggtaacgttaaccggtaaaaccgaaaaggtaaaaaacggggtcggggtaacgggtacccgtaagggggttttcggggg

SEQ ID NO: 412723 - DNA, 524 bp, Homo sapiens
  misc_feature: GZ8MTXP02GT5GS.11.73.G07.1.454.CMB.2.raw
  modified_base (352)..(352): a, c, t, g, unknown or other
  modified_base (356)..(356): a, c, t, g, unknown or other
  modified_base (371)..(371): a, c, t, g, unknown or other
  modified_base (378)..(378): a, c, t, g, unknown or other
  modified_base (437)..(437): a, c, t, g, unknown or other
  modified_base (493)..(493): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattgtatcggcagcgaccgaggaaacgcccctgagctcctgactctacgatcgcgttacctaatttaggaaacaggacgtcccccgacgagttcaggtggaagtggntcgngggacagtacttacnctacacntacagcacgcctagccagtcctagaagtatagttgaactaactattattactagacaanagtactagtacttcgtctacctactaacgttccgccgtaggaccagtacgacgganaagtacgaaacgtactggacgtcgtacgacc

SEQ ID NO: 412724 - DNA, 770 bp, Homo sapiens
  misc_feature: GZ8MTXP02ITW7R.11.73.G07.1.454.CMB.2.raw
  modified_base (194)..(194): a, c, t, g, unknown or other
  modified_base (281)..(281): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgaccagtctccatcctccctgtctgcatctatagganacagagtcaccatcacttgccaggcgagtcaggacaattaaagaacttaatttaaatggtatcggacagacgaaccgaagggaaacnccccgtagacgtcctccgtagatctaacgagtcgtccgttacctaaagtttacgggaaactacggtaaccggtaccccccgtaaccggtaaggtttccaaggggtaggaaaggttgggtacgttccgggttagggggaaaccctaggttaaccctttttaccgccttaaccaaaccctacgtaccacgaccgaacggtcccttagacccgaggtacccttaaaggaaacgttattaaacggtttacgaaaccctaaaaaccgtttagtttaaaacctttaccggttaacgttaaacccttaaaacggtaaaggtttaacttaagggtacttttaaccccggggttaccctttaaccccttaaaacgtttacccgggttttacccccggacccgggttaacgggggaaacccctaaggggtaacggttaacgggaaactaacggtaaaacggtaaaacggtaccgtgggtccgggtacttaccggaaccc

SEQ ID NO: 412725 - DNA, 524 bp, Homo sapiens
  misc_feature: GZ8MTXP02JTT7H.11.73.G07.1.454.CMB.2.raw
  modified_base (193)..(193): a, c, t, g, unknown or other
  modified_base (269)..(269): a, c, t, g, unknown or other
  modified_base (307)..(307): a, c, t, g, unknown or other
  modified_base (319)..(319): a, c, t, g, unknown or other
  modified_base (333)..(333): a, c, t, g, unknown or other
  modified_base (337)..(337): a, c, t, g, unknown or other
  modified_base (351)..(351): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctatagganacagagtcaccatcacttgccaggcgagtcaggacattaagaactattaaatggtatcggcagcgacagggaaacncccctgagctcctgatctacgatgcgtcaattgaaacngagtccccacgngtcagtggagtggntcgngggacagactttcnctcacatcagcagcctgcagcctagacgatattcgactaacattacttactagtacaactagttaatgtaactcgtactccttacgtaaacgttttccgggacccttaggggaccctaggacgttagggaacctaagtacggaaaacgtacgtagtacgggtccttaggaccc

SEQ ID NO: 412726 - DNA, 551 bp, Homo sapiens
  misc_feature: GZ8MTXP02JJNWY.11.73.G07.1.454.CMB.2.raw
  modified_base (299)..(299): a, c, t, g, unknown or other
  modified_base (356)..(356): a, c, t, g, unknown or other
  modified_base (365)..(365): a, c, t, g, unknown or other
  modified_base (376)..(376): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagactctcctgtgcagcctctggatacatcttacaaaagtttcgaaatgagcgtgggtccnccaggctccgtggggaacggggccgagtggatttcatacatcagtagtagtgtaacncttagactntgacagtactntgtagaacgggccgattcaccatctaccagacgaacaacgaccaagaacttacacttcgtttactgactaaatacgaacagctagagagacgagatacggtacttatttacgtagttgtacgacgcgataacgaacgaaaggaaaacggcggtacggaccgttaggtttcggggg

SEQ ID NO: 412727 - DNA, 506 bp, Homo sapiens
  misc_feature: GZ8MTXP02I91Y2.11.73.G07.1.454.CMB.2.raw
  modified_base (194)..(194): a, c, t, g, unknown or other
  modified_base (252)..(252): a, c, t, g, unknown or other
  modified_base (280)..(280): a, c, t, g, unknown or other
  modified_base (311)..(311): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacataagactattaatggtatcggnagcgacgaggaacgcccctgacgctccngatctacggatgcgtaccaagtttagaaacngacgtacccccacgtaggttcaggtaggaacgtggagtcgtaggggaacagttactttactctaccacactcagcacgctagcagcctagagatatgactacattatactgtacaacgagtatgactcgtctcctactacgttccgacgtcggacacgagtggactaagacgaaacgtacgtggtcgactacgac

SEQ ID NO: 412728 - DNA, 737 bp, Homo sapiens
  misc_feature: GZ8MTXP02HR5JU.11.73.G07.1.454.CMB.2.raw
  modified_base (306)..(306): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaggtgtccatgtggcgtgcacctagtggagtcgtgggggagcttggtacagcctgggacggtccctgagactctcctgtgcacgcctgtggatacatctttacaaaagtttcgaaaagtgagtcgtcggggtcccnccgtaggccgtccggtaggggaacgggggtccggtagggttggtattttcgaaattaccgattcgtaaggttaggttacggttacggtaaaccttaccgtttaggttaactgtagaccgtaacgtaccgttcgtagggtaacggaacggggtcccgtaactttcccgaacctacttcccgtacccgaaggaacgaccgaaacccgtacccgaaagtaaactttccgtaaccgtttgttttaccgtacgtaacctaaaagttacgaaaccacggtaccgtaagggacggaaacggaacgggtaaacgggtacgttaaccgggtattttaaaccgtttaaacgttaggtttaggtcggcgttaccgacgttaaccgaaacgtaaagggtaaaaaccgggccgggttacggtacccgttaggggttttcggggg

SEQ ID NO: 412729 - DNA, 694 bp, Homo sapiens
  misc_feature: GZ8MTXP02GHCJ0.11.73.G07.1.454.CMB.2.raw
  modified_base (176)..(176): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtntccactgtggcgtgcacctagtggagtcgtgggggagtcttggtacagcctgggaccggtccctgagactctcctgtgcagcctctggatacattcttactaaaagtttcgaaatgagcgtgggtccgccgaggcctccggtagggggaacggggccggaggtggtatttcatacatcgagtagtagtacggtaactacttagtaactgtgacagtactcgtaggtacggaacgggtccgtacttaccaccgtactcctacccgaacgacgaaccaaaccgaccaaaacgtaactttaccgtaacgtttcgtttacgtagtaacctaaaacgtacgaaaccgtacgtacccgtaggaaacggacggaaacggaaacgggtaaacggttaaccgggttactttaaacgttttaaaccgttacggtttagtcgggaccgtacggtaacgttaaccggaaacgaaaagggtaaaaacgggtccggggttacggtaacccggtttaggggttttacgggggg

SEQ ID NO: 412730 - DNA, 546 bp, Homo sapiens
  misc_feature: GZ8MTXP02F7UBP.11.73.G07.1.454.CMB.2.raw
  modified_base (298)..(298): a, c, t, g, unknown or other
  modified_base (354)..(354): a, c, t, g, unknown or other
  modified_base (380)..(380): a, c, t, g, unknown or other
  modified_base (436)..(436): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactatttagaaggtgtccactgtggcgtgcacctagtggagtcgtgggggagcttggtacagcctggaccggtccctgagactctcctgtgcagcctctggatacatcttacaaaagtttcgaaatgagctgggtccncaggctccgtggggacggggccgagtggatttcatacatcagtagtagtggtaacnccttgtactatgcaagtacctcttgnggaaacgggcgattccaccatctaccagacgacaacgacaaagattcactgtttcngacaaatagaacagctgagagtacgaggatacggacttagtttactattcgtagcgtacgagtaacgaacgaaaggtaaaacggtcggtacggaccgttaggttcggggg

SEQ ID NO: 412731 - DNA, 603 bp, Homo sapiens
  misc_feature: GZ8MTXP02H8E6O.11.73.G07.1.454.CMB.2.raw
  modified_base (261)..(261): a, c, t, g, unknown or other
  modified_base (355)..(355): a, c, t, g, unknown or other
  modified_base (383)..(383): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggctgcacctagtggagtcgtgggggaggcttggtacagcctgggacggtccctgagacttctcctgtgcagccctntggatacatcttacaaaagtttcgaaattgacgtcgtcgggtccgccaggcctccggtgggggaaacggggccggaggtggtatttcgataacntcaagtagtagtgtaactacttgtactntgacagactcgtggtagacgggccgtatcaccactactaccaggaacaaccgaaaccgacctaaagtaacttacctactttacgtttctagtactaaagtacgaaacacgtccgagaggtaaaccgagtaacgggtaatacggactttattacttagttgtacgcgtagactaacggaacaaaggtaaaacgtcggttacggaccgttaaggttcggggg

SEQ ID NO: 412732 - DNA, 545 bp, Homo sapiens
  misc_feature: GZ8MTXP02F86KT.11.73.G07.1.454.CMB.2.raw
  modified_base (354)..(354): a, c, t, g, unknown or other
  modified_base (364)..(364): a, c, t, g, unknown or other
  modified_base (450)..(450): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggacggtccctgagactctcctgtgcagcctctggatacatcttacaaaagtttcgaaaatgagctgggtccgccaggctccgtggggaaggggccgagtggatttcatacatcagtagtagtgtaacnccttgtactntgcagactctgtagacggccgattcacatctccagagacaacgaccaaagaattactacttgtttctgacaaatagaacacgtccngaagagaacgagaagtacggtattatttacttattacgtgtcgacgtacgcgaaacaaggaaaaacgcgggtacggtaccgtaggtttacggggg

SEQ ID NO: 412733 - DNA, 578 bp, Homo sapiens
  misc_feature: GZ8MTXP02FX4KP.11.73.G07.1.454.CMB.2.raw
  modified_base (197)..(197): a, c, t, g, unknown or other
  modified_base (288)..(288): a, c, t, g, unknown or other
  modified_base (415)..(415): a, c, t, g, unknown or other
  modified_base (487)..(487): a, c, t, g, unknown or other
  modified_base (500)..(500): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccatccctccctgtctgcatctatagganacagatcaccatcacttgccaggcgagtcaggactaattaagaaacttaatttaaagtggtatcggacacggccgaaccgaaggggaaacnccccgtgacgcctactgtactcgtacgatcggaccgttactaaagtttacggaaacacggtacggtaccccccacggtaggttcgaggtaggaaggttggatcgtagggtactacgttacctttacnctaccaaccatcgaacgcagtccctgacacgtacctaggaaatattagttacaactaactattattacgtanaactaatagtatntactccgtactcttactaaccggtttccgacccgtaggaccaggacgtgaactgtaaacgaactagtgacgctagacc

SEQ ID NO: 412734 - DNA, 732 bp, Homo sapiens
  misc_feature: GZ8MTXP02HXJ9L.11.73.G07.1.454.CMB.2.raw
  modified_base (254)..(254): a, c, t, g, unknown or other
  modified_base (269)..(269): a, c, t, g, unknown or other
  modified_base (412)..(412): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctcctgtctgcatctataggagacagagtcaccatcacttgccaggcgagtcaggacattaagaacttattaatgtatcggnagcgacgaggaaacncccctagacgcctactgactactacgatcgaccgtactaaagttacggaaacaggaccggtacccccgaacggtaggttcgaaggtggtaaacggtgggtaccgttcgggtaacggtaaccgtacggtttaacccttttaccncttaacccaaacctaacgttaccgaacgccgaaccggtacccgttcggaccgtaacgggtacccgttaaagggaaaaccggttaatttaaactttaccggaaactttaaaacccgtttaaattttaaacctttaccggttaacgttaaaccgaaacttaaaggtttatacggttaaactttccgttacctttacccgttagttaacccggttttccccggacccggtttaggggaaaccagggttaaaccgtagggaacctaaagggttaaaccggaaaaaccgttacggtacggttcgggtaaccttacggtaaccccg

SEQ ID NO: 412735 - DNA, 586 bp, Homo sapiens
  misc_feature: GZ8MTXP02JLUII.11.73.G07.1.454.CMB.2.raw
  modified_base (301)..(301): a, c, t, g, unknown or other
  modified_base (365)..(365): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctgggaccggtccctgagactctcctgtgcagccctctggatacatcttacaaaagtttcgaaatgagctgggtccncaggctcgtggggaaggggccgagtggatttcatacatcagtagtagtagtaactcttgtactntgacagactcgtggtagaacgggccgattacaccatcctaccagacgaacaacgaccaaagtaacttactacttgtttactagtactaaatacgaaacgacgactaggaacgaggaacggaggaacgtaaccggtacttaagtttaacttagtttcgtacgtacgtacgacgtaacgaacgaaaggtaaaacggcggtacggtaccgtacggtttcggggg

SEQ ID NO: 412736 - DNA, 572 bp, Homo sapiens
  misc_feature: GZ8MTXP02GUREH.11.73.G07.1.454.CMB.2.raw
  modified_base (300)..(300): a, c, t, g, unknown or other
  modified_base (444)..(444): a, c, t, g, unknown or other
tcagcgagagataccacgaccggtgctcgatttagctctacgctcaggggatctcagagaggtgccttagccctggattccaagtcatttccacttggtgatcagcactgaacacagaggactcaccatggagttggggctgtgctgggtgctccttgttactattttagaaggtgtccactgtggcgtgcacctagtggagtcgtgggggagcttggtacagcctgggaccgtccctgacgactctcctgtgcagcctctggatacatcttacaaaagtttcgaaatgagctgggtccnccgaggcctccgtggggaacggggccgagtggatttcatacatcgagtagtagtcggtaactccgttgactatgacagactctaggtagacgggctattaccacacttcacccagacgacaacgccaaagtattcacttgttcngacaaatgaaaccagtcctagaagacggacgtaggaagtaccggtacttatttaacgtagttggtacgcgaccgtaagtaaccgaagaaaacggaaaagtcgggtacgtccggttaaggtttcggggg

SEQ ID NO: 412737 - DNA, 649 bp, Homo sapiens
  misc_feature: GZ8MTXP02GY5ZG.11.73.G07.1.454.CMB.2.raw
  modified_base (260)..(260): a, c, t, g, unknown or other
  modified_base (300)..(300): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactatttagaaggtgtccatgtggcgtgcactagtggagtcgtgggggagtcttggtacagccgtgggaccggtccctgacgactctcctgtgcagcctntggatacatcttacaaagttcgaaatgagcgtcgggtccncgaggcctccggtaggggaacggggccgaggtcggtattcatacatcgagtagtagtacgtaacctcgtttagtaactgtcgacagtacttcgtaggtagggaacgggtccgtataccacctactcctaccgagacgaacaaccgacctaaagtaacttacctactttcgttactagactaaagtacgaaacgacgtaccgtaggaacggaacggaacggtaaggtaacgttaacggtacctttaaagtttaacgtttagttacggttcgaccggtacgtaacgtaaccgaaaacggtaaaacggaaaaacgggtccgggtacggtacccggttaacgggtttcggggg

SEQ ID NO: 412738 - DNA, 537 bp, Homo sapiens
  misc_feature: GZ8MTXP02GT1KO.11.73.G07.1.454.CMB.2.raw
  modified_base (274)..(274): a, c, t, g, unknown or other
  modified_base (398)..(398): a, c, t, g, unknown or other
  modified_base (420)..(420): a, c, t, g, unknown or other
  modified_base (449)..(449): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctccctgtctgcatctataggagacagagtcaccatcacttgccaggcgagtcaggacattaagaactatttaaattggtatcggcagcgacgagggaaacncccctgacgctcctgatctacgatcgcgtacctaagtttacggaaacacggtacggtccccccaacgggacggtttacagggttaggaaaggtggagttccgtaggggaactagtacctttacnctacaccatcagcacgcctgcngctagagtatatgactaatattattactntacaatagtatagtctacgtctactactacgtttccggcctagggacctagagtagacaagtacgaaacgtgagtcggtactacgacc

SEQ ID NO: 412739 - DNA, 593 bp, Homo sapiens
  misc_feature: GZ8MTXP02JKIVK.11.73.G07.1.454.CMB.2.raw
  modified_base (259)..(259): a, c, t, g, unknown or other
  modified_base (299)..(299): a, c, t, g, unknown or other
  modified_base (356)..(356): a, c, t, g, unknown or other
  modified_base (365)..(365): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagactctcctgtgcagcctcnggatacatcttacaaaagtttcgaaatgagcgtgggtccncgaggctccgtggggaaggggccggagtgatttcatacatcagtagtagtggtaacncttgtactntcgactagactcgtggtacggaaacgggccgtattaccaaccctacttcctacccgagaacgaaccaacgaccaaagtaacttacacttgtttactagactaaatagaaaccagacctaggaacgagaacggaaggacgtacggtacttaactttactagttacgtcgacgtacgagtaacgaacgaaacggaaaaacggcggtacggtaccgttaggtttacggggg

SEQ ID NO: 412740 - DNA, 529 bp, Homo sapiens
  misc_feature: GZ8MTXP02F0UH9.11.73.G07.1.454.CMB.2.raw
  modified_base (267)..(267): a, c, t, g, unknown or other
  modified_base (299)..(299): a, c, t, g, unknown or other
  modified_base (365)..(365): a, c, t, g, unknown or other
  modified_base (407)..(407): a, c, t, g, unknown or other
  modified_base (433)..(433): a, c, t, g, unknown or other
  modified_base (445)..(445): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggaggcttggtacagcctgggacggtccctgagactctcctgtgcagcctctggatacntcttacaaaagtttcgaaatgagctgggtccncaggctccgtggggaacggggccggagtggatttcatacatcagtagtagtgtaacacttgtactntgcagactcgtgtggaagggccgattccaccatcctccaganacaacgccaaagattacactgtttcngataaatgaacngctgagagacgagatacggctatttactattgtcgtacgcgatcgacgaaacgaaaaggcggtacggaccgtaggtttcggggg

SEQ ID NO: 412741 - DNA, 618 bp, Homo sapiens
  misc_feature: GZ8MTXP02HYP9B.11.73.G07.1.454.CMB.2.raw
  modified_base (364)..(364): a, c, t, g, unknown or other
  modified_base (392)..(392): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccatgtggcgtgcacctagtggagtcgtgggggagcgttggtacagccgtgggaccggtccctgacgactctccgtgtgcacgtcctcgtggaactacgattcttactaaaaagtttcgaaatggagcgtcgggtcccgccaggtccgtccggtggggaacggggccggtaggtggtatttcgatanatcagtagtagtagtaactcttgtactntcgacagtactctgtaggaacgggcctagtccacgtactcctacaagacgacaacgaccaaagtaacttactacttagtttacttagactaaactagaacacggacctaggagaacggacgaaggtactaacgggtacttttaagtttaacttagttagtcggaccgacgtacgtaaccggaacgaaaaggaaaacggcggtacggtaccgttagggtttcggggg

SEQ ID NO: 412742 - DNA, 536 bp, Homo sapiens
  misc_feature: GZ8MTXP02FMVB6.11.73.G07.1.454.CMB.2.raw
  modified_base (322)..(322): a, c, t, g, unknown or other
  modified_base (337)..(337): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaatgtatcggcagcgacaggaagcccctgagctcctgatctacgatgcgtccaatttggaaacagaggtcccccacgngtcagtggaagtggntcgtgggacagtactttactctcaccatcagcagccctgcagcctgaacgatattgacaacattaattactgtacaaactagtatgatcgtctcctactaactttccgggacccttcggggaacccagggtacgttacggggaacctaagtaacggtaaaaaccggtaaaccgttcggttaggaccgtttggaaccccg

SEQ ID NO: 412743 - DNA, 513 bp, Homo sapiens
  misc_feature: GZ8MTXP02JD3AI.11.73.G07.1.454.CMB.2.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacataagaactattaaatggtatcggcagcgaccgaggaaacgcccctgacgctcctgatctacgatgcgtccaattggaaacagaggtcccccacgagttcagtggaagtggatcgtagggacacgtactttactctcacatcagcagcctgcagcctagagataatgacaacatattactagtacaactagtaatgatcgtactctacaactttccggcctacggggaccaggtacggacgtaacgaactaacggaaaacgactagttacggacttacggaccc

SEQ ID NO: 412744 - DNA, 519 bp, Homo sapiens
  misc_feature: GZ8MTXP02JGL7N.11.73.G07.1.454.CMB.2.raw
  modified_base (252)..(253): a, c, t, g, unknown or other
  modified_base (348)..(348): a, c, t, g, unknown or other
  modified_base (514)..(514): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacatagaactattaattgtatcggnngcgacagggaaagcccctgagctcctgatctacggatcgcgtccaaatttggaaacacggacggtccccacgaggttcaggttggaaggtgagtntggggacagtactttactctcaccatcagcagcctgacagccttagagattattgacaactattattactgtaccaatagtaatgtatcgtacctccttactaactttccgggcccttagggacccgagtaggtcggactaagtacgaaaacgactaggtgacgtnacccg

SEQ ID NO: 412745 - DNA, 481 bp, Homo sapiens
  misc_feature: GZ8MTXP02FP6O3.11.73.G07.1.454.CMB.2.raw
  modified_base (392)..(392): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggttccagatgtgacatccagttgacccagtctccatcctccctgtctgcatctataggagacagagtcaccatcacttgccaggcgagtcaggacattaagaactattaaattggtatcggcagcgaccaggaaagcccctgagctcctgatctacgatgcgtccaatttggaaacagaggtccaccgagttcagtggagtggatctgggacagactttactctcacatcagcagctgcagctgagatattagcaaanatattactagtacaactagtatgtatcgtactctctaattcggcctggaccagacgtacggacataagaaacgaactgtgactgctaac

SEQ ID NO: 412746 - DNA, 508 bp, Homo sapiens
  misc_feature: GZ8MTXP02J11P9.11.73.G07.1.454.CMB.2.raw
  modified_base (193)..(193): a, c, t, g, unknown or other
  modified_base (243)..(243): a, c, t, g, unknown or other
  modified_base (255)..(255): a, c, t, g, unknown or other
  modified_base (297)..(297): a, c, t, g, unknown or other
  modified_base (389)..(389): a, c, t, g, unknown or other
  modified_base (398)..(398): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctatagganacagagtcacatcacttgcaggcagtcagacatagactattaatgatcgnagcgacaggaanccctgagctcctgatctacgatgcgtaccaatttcggaaacnggtacggtcccccacgagttcagtggaagttggatcgtaggggacagtacttactctcaccatcagcagcctgcagctagagatatgacacntatactganaactagatgatcgtactctacaacgtttccggcccttaggggaccctaggacgttacgggaaccaagttaacggtaaaacccgacgttaggtacgggaccgttaccgacg

SEQ ID NO: 412747 - DNA, 559 bp, Homo sapiens
  misc_feature: GZ8MTXP02FHQU3.11.73.G07.1.454.CMB.2.raw
  modified_base (299)..(299): a, c, t, g, unknown or other
  modified_base (355)..(355): a, c, t, g, unknown or other
  modified_base (363)..(363): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccatgtggcgtgcacctagtggagtcgtgggggagcttgggtacagcctgggacggtccctgagactctcctgtgcagcctctggatacatcttacaaaagtttcgaaatgagctgggtccncgaggctccgtggggaagggccgagtggtatttcatacatcagtagtagtgtaacncttgactngcagtactctgaggagggcgattccacatctaccagacacaacgaccaaagtattacacttgtttctacgacaaatgaaacacgaccgtagagaagacggacgaagtacggtattaatttactattcggtcgtcgacgagtaaccgaacgtaaaaggaaaaacggtcgggtacggaccgttaacgggtttcggggg

SEQ ID NO: 412748 - DNA, 677 bp, Homo sapiens
  misc_feature: GZ8MTXP02GRCD0.11.73.G07.1.454.CMB.2.raw
  modified_base (277)..(277): a, c, t, g, unknown or other
  modified_base (306)..(306): a, c, t, g, unknown or other
  modified_base (371)..(371): a, c, t, g, unknown or other
  modified_base (382)..(382): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccatgtggcgtgcacctagtggagtcgtgggggagtcttggtacagcctgggaccggtccctgagacctctcctgtcgcagccctgtggatacatcttanaaaagtttcgaaatgacgcgtcggggccnccgaggcctccggtaggggaacggggtccgaggtggtatttcatacatcagttagagtagtaacncgttagactgngcagtaccttcgtggtacgggaagggcccgtattaccacctactcctaccgaagaacgaaccaaaccgtaccaaagtaacttactaaccgtttgtttacctagaacctaaaagttacgaaaccgtacgtaccctagggaaacggaggaacggaacgggtaacgtaccgggttactttaacggttttaactacggttttaggtacgtaccggaccggttaacgtaaccggaaaccggaaaggtaaaaacggggtccgggtttaacggggtacccgtttaaggggttttccgggggg

SEQ ID NO: 412749 - DNA, 636 bp, Homo sapiens
  misc_feature: GZ8MTXP02I08BL.11.73.G07.1.454.CMB.2.raw
  modified_base (268)..(268): a, c, t, g, unknown or other
  modified_base (355)..(355): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactatttagaaggtgtccactgtggcgtgcactagtggagtcgtgggggagcttggtacagcctggacgtccctgagactctctgtgcagcctctggatacatcttanaaaagtttcgaaatgagcgtggtccgcaggctccgtaggggaaggggccggagtggatttcatacgatcagtagtagtcggtaaacncttgtactatgacagtactgtggtaggaacgggccgtattccgacctatcctccgaacgacgaacaacgaccaaagtaacttactacttcgtttactagtacctaaagtacgaaaccaacggtacctaggaaaggaacggaacggaaagggtaacgttaaacgggtacctttaaagttttaaccttaaaggtttggttacggtacgtacggtacgtaaccggaaacgaaaaggaaaaaacgggtccgggtacggggtacccgtttaaggggtttacggggg

SEQ ID NO: 412750 - DNA, 591 bp, Homo sapiens
  misc_feature: GZ8MTXP02JYCFL.11.73.G07.1.454.CMB.2.raw
  modified_base (255)..(255): a, c, t, g, unknown or other
  modified_base (263)..(263): a, c, t, g, unknown or other
  modified_base (295)..(295): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccatgtggcgtgcacctagtggagtcgtgggggagcttggacagcctggacggtccctgagactctctgtgcagcctntggatacntcttacaaaagtttcgaaatgagctgggtccncaggctcgtggggaacgggcgagtggatttcagtacatcaagtagtagtggtaacacgtttagactatggactaggacttcgtggtagaaacggggcctattaccacctatctaccgagacgaacaacgtaccaataacttacaacgttgtttacagacaaagtagaaaccgagtcccgtaggaagacggtaacgaggaacgttacggtacttaatttactagtttacggtcgacgtacgacgtaaccgaagaaaacggaaaacggtcggtacggtaccgttaagggtttcggggg

SEQ ID NO: 412751 - DNA, 683 bp, Homo sapiens
  misc_feature: GZ8MTXP02FRZDK.11.73.G07.1.454.CMB.2.raw
  modified_base (200)..(200): a, c, t, g, unknown or other
  modified_base (267)..(267): a, c, t, g, unknown or other
  modified_base (282)..(282): a, c, t, g, unknown or other
  modified_base (415)..(415): a, c, t, g, unknown or other
tcagcgagagataccacgaccggtgctcgatttagctctacgctcagggggcaggagtcagtcccaaccaggacacagcatggacatgacgggtccctgctcagctccgtggggctcctgctgctctgtcctctcaggtgccagatgtgacatccagttcgacccagtcctccatccctcctgtctgcatctagtagganacagacgtcaccatcacttcgccaggcgagtcgaggacaattaagaacttatttaagtggtatcggnagcgaccgaggaacncccctagacgctcctgactctacgactgaccgtacctaagtttacgaaacgtacggacgtccccccgaacggtacgttacgagggttaggaacggttgggtacgtcgtacgggacctacgttaaccttttacnccttaccaaacctatacccgaacggactaccggtccttacggaccgacgtacccgttaagggaaaagtattagttacaaacctaaataaacttaactttactacgttaacccaaaagtagtaacggttactacgttcccgttacccttaccgttaaccgtttacggttttaccccggaccggtttaccgggaaccctaagggtaacggttacgaaacgtaagtaaacggtaaaaaccggtcgtacgggttacgaccggttacgaaccc

SEQ ID NO: 412752 - DNA, 566 bp, Homo sapiens
  misc_feature: GZ8MTXP02G371W.11.73.G07.1.454.CMB.2.raw
  modified_base (278)..(278): a, c, t, g, unknown or other
  modified_base (290)..(290): a, c, t, g, unknown or other
  modified_base (383)..(383): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatccctccctgtctgcatctagtaggagacagacgtcaccatcacttgccaggcgagtcgagacattaagaacttaatttaaattggtatcggacagacgacaggaacncccctgagctcngatctacgatgaccgtacaatttacggaaacaggacgtacccccacgaggttacaggtcggaagttggatcgtaggggaacacgtactttacnctacaacgatacagactagcctagccgtacgccgttaggaaatattatacgaccaaatattaattactagacctaagtaagtatgtactcgtctacctactaacggtttccgaccgttacggaaccaggtacgttagaaccgtaagaacggtaaaacgtacgtaggtacgtacgtcgaaaccc

SEQ ID NO: 412753 - DNA, 662 bp, Homo sapiens
  misc_feature: GZ8MTXP02FIYM2.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtcactgtggcgtgcacctagtggagtcgtgggggagcttgggtacagcctgggacggtccctgagactctcctgtgcagcctctggatacatcttacaaaagtttcgaaatgagcgtgggtccgccgaggctccggtagggggaacggggccgaggtggtatttcatacatcgagtagtaggtaggtaacctaccgttgtaactagtcgactaggtaccttcgttaggtaggtaaacggggtcccgtacttacccgacctactcctaccgaacggacgaaccgaaaccgaccgaaagtaacttacacgttagtttctagtacaaatacgaaacgacgactaggaacggaggaacggtaacgggaacgtaaccggtacttaacttttaacgttagtttcggtacgtaccggacgtacgtaaccggaaaacggaaaacggtaaaaacggtccggggttacgggaccggttaacgggtttaccgggggg

SEQ ID NO: 412754 - DNA, 694 bp, Homo sapiens
  misc_feature: GZ8MTXP02GQM2D.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagtcttggtacagccgtgggaccggtccctgacgacctctcctgtgcagcctctgatacatcttataaaagtttcgaaatgacgtcgtcgggtcccgcgaggtccgtaccggtaggggggaaacgggggccggtaaggttcgggtaactttttacgaattaacgattacgtaaaggttaaggtaggttacggtaaaccctaccgtttagtaacttagtgacctagtaccttcgtggtacgggaacgggtaccctagtttacccacctacgtccctaccgaagaaccgaaccgaaaccgtaccaaaagtaacttacaacgtttcgtttactagaactaaagtacgaaaacgcgtaccgtaggaaacggacggaacggaggtaactacggtaacttttactttaacgttagttcgtcgtacgacgtaagtaaccgaaacgaaaaggtaaaacggtcgggtacggtaccgttagggtttacggggg

SEQ ID NO: 412755 - DNA, 577 bp, Homo sapiens
  misc_feature: GZ8MTXP02JQ20I.11.73.G07.1.454.CMB.2.raw
  modified_base (255)..(255): a, c, t, g, unknown or other
  modified_base (268)..(268): a, c, t, g, unknown or other
  modified_base (376)..(376): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatggtatcggnagcgacaggaacnccctgagctctgatcgtacgatgccgtaccaagtttaggaaaccaggacgtaccccccgacggtaggttcaggtagggaacgtggatcgtagggactagtactttacnctacacatcgagcacgctagacacgtacgtagaatacttagtacgactaactaatattacgtacgtactaaacgtagttatacgtactttaccgttaccttaccgttaacgttacggttcccggaccggtacgggacgtaacgtaggtacgaacgtaagtaaccggtaaaacggtacgttacggtacggtacctacgaccc

SEQ ID NO: 412756 - DNA, 533 bp, Homo sapiens
  misc_feature: GZ8MTXP02JGF54.11.73.G07.1.454.CMB.2.raw
  modified_base (297)..(297): a, c, t, g, unknown or other
  modified_base (358)..(358): a, c, t, g, unknown or other
  modified_base (366)..(366): a, c, t, g, unknown or other
  modified_base (375)..(375): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctgggacgtccctgagctctcctgtgcagcctctggatacatcttacaaaagtttcgaaatgagctgggtccnccaggcctcccgtggggaacggggccggagtggatttcatacatcagtagtagtggtaacncttgactngcagactgngtggaagggccgattcacatctacagacacaacaccaagaacttacacttgtttctagacaaatagaacagcctagacgagacgaggagtacggcttatttactattcgtcgcgcgatcgacgaaagaaaacggcggtacggccgttaggttcggggg

SEQ ID NO: 412757 - DNA, 636 bp, Homo sapiens
  misc_feature: GZ8MTXP02GXZ4X.11.73.G07.1.454.CMB.2.raw
  modified_base (194)..(194): a, c, t, g, unknown or other
  modified_base (278)..(278): a, c, t, g, unknown or other
  modified_base (283)..(283): a, c, t, g, unknown or other
  modified_base (410)..(410): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcgaggactaattaagaacttatttaaattggtataggcagcgaccgagggaaacnccccngacgtctcctgtactctacgatcggtacctactaaagtttaggaaaccacggtacggtaccccccgaaccgggtaggtttaccgagggtcggaagttggacgtcgtaggggaactagtacctttacncgtacaccatccgagcacgcctgacacgccgtagaacgtattaacgtacgaacctaaactagttaacttacgtacgtacaaacgtagttaactagtacttaccgtaccttaccgttaaccttaacggtttcccggaccccggttacggggaaaccctaggggtaacggtacggtaaacctaaggttaacggaaaacggtaccgttggtacggtacttacggaaccc

SEQ ID NO: 412758 - DNA, 546 bp, Homo sapiens
  misc_feature: GZ8MTXP02I5JIE.11.73.G07.1.454.CMB.2.raw
  modified_base (194)..(194): a, c, t, g, unknown or other
  modified_base (271)..(271): a, c, t, g, unknown or other
  modified_base (349)..(349): a, c, t, g, unknown or other
  modified_base (354)..(354): a, c, t, g, unknown or other
  modified_base (370)..(370): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgccaggcgagtcaggacattaagaacttaattaaatggtatcggcagcgacgaggaacnccctgagctctgatctagatcgcgtactaagtttaggaaacaggacgtcccccgacgtaggttcaggtaggaagtggngtcgngggacagtactttacnctaccacatcagcagcctgcagccgtagaacgattattcgacaaactattaattacgtagtaccaagtagtagtagtacgtcgttaccttcctacgtacgtttcccggaccgttacgggacctaggacgttcggaaacctaaggtaacgaaacgtacgtggtacgcgtacgaaccg

SEQ ID NO: 412759 - DNA, 558 bp, Homo sapiens
  misc_feature: GZ8MTXP02F2YE4.11.73.G07.1.454.CMB.2.raw
  modified_base (273)..(273): a, c, t, g, unknown or other
  modified_base (299)..(299): a, c, t, g, unknown or other
  modified_base (309)..(309): a, c, t, g, unknown or other
  modified_base (365)..(365): a, c, t, g, unknown or other
  modified_base (445)..(445): a, c, t, g, unknown or other
tcagcgagagataccacgaccggtgctcgatttagctctacgctcagggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctgggacgtccctgacgctctcctgtgcagcctctggatacatcttanaaaagtttcgaaatgagcgtgggccncaggctcggnggggaaggggccgagtggatttcatacatcagtagtagtagtaactcttagtactntgcagacttctggtagaagggccgattcacatcacagacacaacgaccaagaacttacacttgtttctagactaaagtanaacgagacctagagagacgaaggagtacggtacttaatttacttagttcggtacgtcgacgtacgtaacgaacgaaaggaaaacggtcggtacggaccgttaggtttcggggg

SEQ ID NO: 412760 - DNA, 561 bp, Homo sapiens
  misc_feature: GZ8MTXP02F90VU.11.73.G07.1.454.CMB.2.raw
  modified_base (175)..(175): a, c, t, g, unknown or other
  modified_base (258)..(258): a, c, t, g, unknown or other
  modified_base (300)..(300): a, c, t, g, unknown or other
  modified_base (365)..(365): a, c, t, g, unknown or other
  modified_base (374)..(374): a, c, t, g, unknown or other
  modified_base (383)..(383): a, c, t, g, unknown or other
  modified_base (458)..(458): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactatttagaaggtntccatgtggcgtgcactagtggagtcgtgggggagcttgggtacagcctgggaccggtccctgagactctcctgtgcagcctntggatacatcttacaaaagtttcgaaatgagtcgtgggtccncgaggctccggtagggggaacggggccggaggtggatttcatacattcgagtagtagtggtaacncttgtactntgcagactntggtaggaacgggctattccacatctacagacgaacaacgcaaagtactcacttgtttcagacaaatacgaaacncgactgaacgagaacgaggaataccggatttaattacgtattggtgccgtaggataaccgacgaaaaggaaaacggtcggtacggtaccgtacggtttggggg

SEQ ID NO: 412761 - DNA, 506 bp, Homo sapiens
  misc_feature: GZ8MTXP02FLUT8.11.73.G07.1.454.CMB.2.raw
  modified_base (151)..(151): a, c, t, g, unknown or other
  modified_base (174)..(174): a, c, t, g, unknown or other
  modified_base (305)..(305): a, c, t, g, unknown or other
  modified_base (356)..(356): a, c, t, g, unknown or other
  modified_base (367)..(367): a, c, t, g, unknown or other
  modified_base (466)..(466): a, c, t, g, unknown or other
  modified_base (469)..(469): a, c, t, g, unknown or other
  modified_base (475)..(475): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtnctcttgttactatttagaaggtntccactgtggcgtgcacctagtggagtcgtgggggagcttggacagcctgggacggtccctgagactctcctgtgcagcctctggatacatctacaaaagtttcgaaatgagcgtgggtccgcaggctcgngggaaggggccgagtgatttcatacatcagtagtagtgtaacacttgactngcagactctgngaagggcgattcacatctccagagacacgacaagaatacactgttctagacaaatagaacagactagagagacgagagtacgctattactatgtcgcgntanaacganaaagaaaacgcggtacgacgtacgttagggg

SEQ ID NO: 412762 - DNA, 587 bp, Homo sapiens
  misc_feature: GZ8MTXP02IFOWU.11.73.G07.1.454.CMB.2.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatccctcctgtctgcatctagtaggagacagacgtcaccatcacttgccgaggcgagtcaggaacaattaaagaacttaattaaattggtatcggacagcgaaccgaaggaaacgcccctgacgcctccgtagatatacgatgcgtactaaagttagaaacaggacgtacccccgacggtagtacaggtaggaagtggactcggtagggactagtactttactcctacacctatacagcacgcctgacacgtaccagaacgtatatacgaactaactaattaattacgtacgtacaaactagtaagtacgtacttccgtactacccttacgtacgtttccggacccgttacgggactacggtagtaacggaacgtaacgtaacggaaaacgtacgacggttacggacttacggaaccc

SEQ ID NO: 412763 - DNA, 690 bp, Homo sapiens
  misc_feature: GZ8MTXP02J2BX8.11.73.G07.1.454.CMB.2.raw
  modified_base (161)..(161): a, c, t, g, unknown or other
  modified_base (192)..(192): a, c, t, g, unknown or other
  modified_base (197)..(197): a, c, t, g, unknown or other
  modified_base (231)..(231): a, c, t, g, unknown or other
  modified_base (244)..(244): a, c, t, g, unknown or other
  modified_base (265)..(265): a, c, t, g, unknown or other
tcagcgagagataccacgaccggtgctcgatttagctctacgctcagggggcaggagtcagtcccaacaggacacagcatggacatgagggtccctgctcagctcctggggctcctgctgctctgtctctcaggtgccagatgtgacatccagttgacccngtctccatcctccctgtctgcatcatagganacagngtcaccatcacttgccaggcgagtcaggacatanaactattaatggntcggcagcgaccaggggaaancccctgagctcctgatctaacgattgacgttacctaaattttaggggaaccaggtacggttaccccccccaccggtaaggggttttccaagggttaggggaaacgttggggatttaccgttagggggaccctaaggttacctttttactcccttacaaaccccattacccaaggccagccccgttagtacctaacggaccccgttgaaaagggttaattaatttacggaaccctaaaactaacgtttaacgttaaacccttcggttaacccaaaaccgaggtttaatacggtaactttacccgggtttccttacccccgtttacctaaaacgtttttccccggggaccccttacggggggaaccctaagggtaaccggtaggacaacgttagaaaaaccgtaacgtgtacgggtcctacggaccc

SEQ ID NO: 412764 - DNA, 576 bp, Homo sapiens
  misc_feature: GZ8MTXP02IRYMP.11.73.G07.1.454.CMB.2.raw
  modified_base (301)..(301): a, c, t, g, unknown or other
  modified_base (380)..(380): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacaggcctggaccggtccctgacgactctcctgtgcagcctctggatacatcttacaaaagtttcgaaatgagcgtgggccncgaggctccgtggggaaggggccgagtggatttcatacatcagtagtagtcgtaactccttgtactgtgcagactgtgngaacgggctattcacatctccgagacgacaacgaccaaagtacttactacttgtttactagactaaagtacgaacgagtacgtagaagagaacggaggaacgtaacggtacttaatttacgttaattcggtgtacgacgtataacggaaacgaaacggtaaaacggtcgggtacggtaccgttaaggtttcggggg

SEQ ID NO: 412765 - DNA, 555 bp, Homo sapiens
  misc_feature: GZ8MTXP02H4BUH.11.73.G07.1.454.CMB.2.raw
  modified_base (297)..(297): a, c, t, g, unknown or other
  modified_base (435)..(435): a, c, t, g, unknown or other
tcagcgagagataccacgaccggtgctcgatttagctctacgctcaggggatctcagagaggtgccttagccctggattccaagtcatttccacttggtgatcagcactgaacacagaggactcaccatggagttggggctgtgctgggtgctccttgttactattttagaaggtgtccatgtggcgtgcacctagtggagtcgtgggggagcttggtacagcctggaccggtccctgagactctcctgtgcagcctctggatacatctacaaaagtttcgaaatgagctgggtccnccaggcctccgtaggggaaggggccggagtcggtatttcatacatcagtagtagtaggtaactccttagtactagtgacagactactggagtaacgggccgtatacacatctcagacacaacgaccgataatcacttntttctagacaaatgaaacacgctagagtagacgtaggatacggacttatttactaattcgtacgcgacgactaacgaacgaaacggaaaaacggcggtacggtaccgtaacggttggggg

SEQ ID NO: 412766 - DNA, 816 bp, Homo sapiens
  misc_feature: GZ8MTXP02ITWS6.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtaacgcgtcggtacggtccgtcgtagacgtcctcctcgtgtcgacgccgtcctcggagtactaactacttacctaaaagttaaacgtaataaggtagacgtcgggtccggtccgacggacgtccgtacggggaagggggaccggggacggtagggtacgtttactacgtaacactactaggtaagtaggtacggtaaacgtaaccttacggtttaacgtaacttgacacgtaacgttcctagttacgggaacgggaccgtaacctttagaacccctaactccttacccgaacggaagaaacccgaaacccgtaaccggaaactaaaacgtttactaaccgttcgtttttaaccgtacgtacgaaaactaacgggtaaaccaacggaccttacggaagggaaaacgaccgggtaaagggtaaacgtaacccgggtttaacctttaaagtttttaaaacccgtttaacgtttagggttcggaccccggtaaagtaccggtaaaaccgtaacccggtaaaaaacggggaaaaaacgggtaaacccgggggttccggtaaaacccgggtttaccggtttaagggggggttttttaccggggg

SEQ ID NO: 412767 - DNA, 648 bp, Homo sapiens
  misc_feature: GZ8MTXP02JJKUN.11.73.G07.1.454.CMB.2.raw
  modified_base (383)..(383): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgcgtgggtgctccttgttacttattttagaaggtgtccactgtggcgtgcacctagtggagtcgtgggggagtcttggacagccgtgggaccggtcctgacgctctctgtgcagcctctggatacattcttactaaaagtttacgaaatgacgtcgtgggtccgccgaggcctccggtaggggacggggccggagtggtatttacatactatcagtagtagtagtaactcttagtactgngacagtactcgtaggtaggtaacgggaccgtataccgtaccactcctacgaacgacgaaccaaaccgacaaacgtaacttacctactttacgtttacgtagtaaccaaagttacgaaaacgtcgtaccggagaaacggaacggaaccggaagtaacgtaacgggttaactttagttaaacgttagtttaacggcgtaccgtaccggtaagaaccggtaagaaaacggtaaaacggtcggtacggtaccggtaaggttttcggggg

SEQ ID NO: 412768 - DNA, 611 bp, Homo sapiens
  misc_feature: GZ8MTXP02FGK95.11.73.G07.1.454.CMB.2.raw
  modified_base (363)..(363): a, c, t, g, unknown or other
  modified_base (368)..(368): a, c, t, g, unknown or other
  modified_base (385)..(385): a, c, t, g, unknown or other
  modified_base (452)..(452): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagatcaccatcacttgccaggcgagtcagacataagaactattaatgtatcggcagacgacgaggaacgcccctagacgctcctgactactacgagtcgccgtacctaagtttacggaaacgacggtacggtacccccgaccggtagtacgaggtacggaagtgggntcggngggactagtactttacnctacacctatcagacagcctgccagaccgtagaaagtactagtcaactaactaattactttacgtanaactaaacgtaagttagtacgtacgtaccgttccttaccctaacgtttaccggtttacccgggtaccccggttacggggaaacccgtaagggtacggtaacgggtaaactaaggtaaacggtaaaaccggtaaacgtgggttacggactacgtaacccg

SEQ ID NO: 412769 - DNA, 664 bp, Homo sapiens
  misc_feature: GZ8MTXP02GDQ6B.11.73.G07.1.454.CMB.2.raw
  modified_base (259)..(259): a, c, t, g, unknown or other
  modified_base (296)..(296): a, c, t, g, unknown or other
  modified_base (363)..(363): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccatgtggcgtgcacctagtggagtcgtgggggagtcttggtacagccgtggacggtccctgacgactctcctgtgcagctntgatacatctacaaagtttcgaaatgagctgggtccncaggctccggtggggaacgggccggagtggatttcatacatcagtagtagtgtaacacttgtaactntgacagtacttcgtaggtaggaacgggtccgtattaccaccactacctaccaacgaacgaaccgaaacgaccaaaagaaactttacctaacgttacgtttacttaccggaataaaacggttacaaaaccgaacgtcccgttaaggaaacggaaggaacgggaaacggtaacgtaacggggtacctttaaagtttaaaccgttagtttaggtacggttaccggaaccgtaacgttaaccggaaacgaaaaggtaaaaaacgggtccgggtacggggtacccgttaagggttttaccgggggg

SEQ ID NO: 412770 - DNA, 680 bp, Homo sapiens
  misc_feature: GZ8MTXP02HAK16.11.73.G07.1.454.CMB.2.raw
  modified_base (394)..(394): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtcatgtggcgtgcactagtggagtcgtgggggagtcttggacagccgtgggaccggtccctggacgtacctctccgtgtcgcagtccctgtaggactacattcttaaagtaaagtttcgaaatgacgtcgtcgggccgccgaggtccgtaccggtagggggaacggggcggagtggtattacatacatcgagtagtagtacgtaactctttagactgngacagtactcgtaggtacgggaacggggtacctacttacccaaccctacttaccgtaccgaagaaccgaaacgaaaccccgtaactaaaacgttaactttaccgttactttacgtttaccaggtaaacctaaagtaacgaacgtacggaccgtaggaacggaaggaacgggaagacgttacggacttttaaagttacgttagttcggtacgaccgtacgtaaacgtaacgaaacggtaaaacgaaaacgggtcgggtaacggtaccgggttagggttttacggggg

SEQ ID NO: 412771 - DNA, 696 bp, Homo sapiens
  misc_feature: GZ8MTXP02IB2CY.11.73.G07.1.454.CMB.2.raw
  modified_base (257)..(257): a, c, t, g, unknown or other
  modified_base (297)..(297): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccatgtggcgtgcacctagtggagtcgtgggggagcttggtacagcctgggacggtccctgagctctcctgtgcagcctntggatacatcttacaaaagtttcgaaatgagctgggtccncgaggcctcggtggggaacgggcggagtggtatttcatacatcagtagtaggtacgtaactacctttagttactagtcgactagtaccgtcgtgggttacgggaaacgggtcccgtaattacccaccctacttacccgacccgaacgtacggaaaccaaaccgaacccgtaaaacgtaacttactaacctttacgtttacttacgaacctaaaagtacgaaaccgtacgtaccgtagaacggaacggaaccggtaagggtaacgtaacgggtacttttaaacgttttaaccgttagtttacggtacggtaccgtaccgtaaagtaaccggaaaacgaaaacggggtaaaaaaccggtcgggggtacgggttaacccggtttaacggggtttccgggggg

SEQ ID NO: 412772 - DNA, 656 bp, Homo sapiens
  misc_feature: GZ8MTXP02GT1HB.11.73.G07.1.454.CMB.2.raw
  modified_base (301)..(301): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctgggacggtccctgagactctcctgtgcagcctctggactacatcttacaaaagtttcgaaatgagcgtgggtccncaggcctccggtggggaacggggccggtagtggtatttcaatacagtcaagtagtagtaggtaactccgttgtactagtgactagtactcgtaggtacggaaacgggtccgtattaccactactcctaacccgagaacgaaccgaaaccgaaccgaaacgtaacttacctaacgttcgtttaccgttagaaccgtaaaagtacgaaacctacgtacccgtaggaaaggaggtaacggaaggtaacgtaacgggtactttaagtttaaccttagttcggtacgaccgtacgtaacgtaaccggaaacgaaaacggtaaaaacggtccgggtacggtaccgttaggtttaccggggg

SEQ ID NO: 412773 - DNA, 714 bp, Homo sapiens
  misc_feature: GZ8MTXP02F93CF.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagaggactcacatggagttggggctgtgctgggtgctcttgttactatttagaagtgtccatgtggcgtgcactaggtggagtcgtgggggagcttggtacaggccgtgggaccggtccctggacgacctctcctgtgcagcctcgtggatacattcttaactaaaagtttacgaaaatgagcgtcgggtccgccgaggccgtccggtagggggaacggggccggaagtggtactttcgaatacatacgaagttagtacggtaggtaaacctacgttagttaactagtgactagtaccttcgtagggtaacgggaacgggtacccgtaacttacccaacctactaccctaaccgaaacgaaccgaaaccgaaaccgaaccgtaaaagtaacttaccgtactttacgtttacgtaacgaacctaaaagtacgaaaacgacgtaccgtaaggaaacggaacggaacgggtaaaggtaacgttaaccggtactttaaacgtttaacgttaagtttcggtacgtaccggacgtaacgtaacgtaaaacggaaaacggtaaaaacgggtcggggttaacggtacggtttaacgggtttcggggg

SEQ ID NO: 412774 - DNA, 597 bp, Homo sapiens
  misc_feature: GZ8MTXP02HWYVI.11.73.G07.1.454.CMB.2.raw
  modified_base (262)..(262): a, c, t, g, unknown or other
  modified_base (301)..(301): a, c, t, g, unknown or other
  modified_base (346)..(346): a, c, t, g, unknown or other
  modified_base (374)..(374): a, c, t, g, unknown or other
  modified_base (380)..(380): a, c, t, g, unknown or other
  modified_base (385)..(385): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactatttagaaggtgtccatgtggcgtgcacctagtggagtcgtgggggagtcttggtacagccgtgggaccggtccctgacgactctcctgtgcagcctcngatacatcttacaaaagtttcgaaatgagcgtgggtccncgaggtcctccggtggggaacggggccggtagtggtattcatacntcgagtagtagtcgtaactcttagactntgacanccttntggtagaaacgggccgtattaccacctatactaccgagaacgaacaacgaccaaagtaacttactaacttcgtttactagaacaaagtacgaaacagacctaggagaaggacgaggaacgtacggtactttaaacgtttaactagttgtacgtcgacgtacgtaacgaacgaaaaggaaaacggtcggtacgtacggtttacggttcggggg

SEQ ID NO: 412775 - DNA, 683 bp, Homo sapiens
  misc_feature: GZ8MTXP02FS02R.11.73.G07.1.454.CMB.2.raw
  modified_base (176)..(176): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggaattggggctgtgctgggtgctccttgttactattttagaaggtntccatgtggcgtgcacctagtggagtcgtgggggagcttggtacagcctgggacggtccctgagctctctgtgcagcctgtggatacattccttacaaaagtttcgaaatgagtcgtcgggtccgcaggcctccggtaggggaacggggccgagtggatttcaatacatcaaggttagtagtaggtaactaccttgtactgtgacctaagtaccttcgtaggtaggaacgggaccgtattaccacctatcctaccgagacgaacgaaccgaccgaaacgtaacttacctacgttacgtttactagtacctaaagtacgaaaccgtacgtacccgtaggaacggaacggtaacggaacgggtaacgttaaaccgggttactttaaacgtttttaaacgttaacgtttacggttacggtaccggtaacgtaacgttaaccggaaaacgtaaaacgggtaaaaacggggtccgggttacggggtacccggtttaaggggtttacgggggg

SEQ ID NO: 412776 - DNA, 614 bp, Homo sapiens
  misc_feature: GZ8MTXP02IECVL.11.73.G07.1.454.CMB.2.raw
  modified_base (304)..(304): a, c, t, g, unknown or other
  modified_base (347)..(347): a, c, t, g, unknown or other
  modified_base (375)..(375): a, c, t, g, unknown or other
  modified_base (480)..(480): a, c, t, g, unknown or other
  modified_base (493)..(493): a, c, t, g, unknown or other
  modified_base (538)..(538): a, c, t, g, unknown or other
  modified_base (552)..(552): a, c, t, g, unknown or other
  modified_base (559)..(559): a, c, t, g, unknown or other
tcagcgagagataccacgaccggtgctcgatttagctctacgctcaggggatctcagagaggtgcccttagccctggattccaaggcatttccacttggtgatcagcactgaacacagaggactcaccatggagttggggctgtgctgggtgctccttgttactattttagaggtgtccactgtggcgtgcacctaggtggagtcgtgggggagtcttggtacagccgtggaccggtccctgagctctccgtgtcgcagcctgtggatacatcttacaaaagtttcgaaatgagcgtgggtccncgaggctccgtaggggaacggggccggtagtggtattcatacntcgagtagtagtacgtaactcttgactntgcacgtactcgtaggacgggaacgggccctattcccgacctattcccgaacaagaaccacgaaacccgacaaaagtactttacgaactttggtttacacgtaanaaagtaacgaccngaccgtaggaacgacggaagacgtataccggttattacgttttanagttcggcgaccgngtaaacnccggaaacgtaaaaggtaaaacggtcgggtcgtaaccggtttagggtttcggggg

SEQ ID NO: 412777 - DNA, 632 bp, Homo sapiens
  misc_feature: GZ8MTXP02JIR44.11.73.G07.1.454.CMB.2.raw
  modified_base (264)..(264): a, c, t, g, unknown or other
  modified_base (280)..(280): a, c, t, g, unknown or other
  modified_base (304)..(304): a, c, t, g, unknown or other
  modified_base (367)..(367): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctccctgtctgcatctagtaggagacagacgtcaccatcacttgaccaggcgagtcaaggacaattaagaacttatttaaagtggtatcggnagcgacgagggaaacncccctgacgctccgtgatcaacgntcgccgttaccaagtttacggaaactcggacggtacccccacggtagttacaggtggaatggngtcgagggactagtctttaactctacgaccatcacgtcacgtcccgtagccagcctagaaagtacttagttgaaccctaaagtacttaacttacggtactaacccgtaaacgtaggttaattacggtaacttccggttaccttaccccggtaacgttaacccggttcccgggtaccgttacgggacccggtaaaggtacggttcggaaacccttaaggaacggtaaaacccgtaggttacggtacggtacccgttcggaaacccg

SEQ ID NO: 412778 - DNA, 556 bp, Homo sapiens
  misc_feature: GZ8MTXP02GC56J.11.73.G07.1.454.CMB.2.raw
  modified_base (375)..(375): a, c, t, g, unknown or other
  modified_base (443)..(443): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacaattaaagaacttaatttaaatggtatcggacagacgaccgagggaaacgcccctagacgtcctcctagactcgtacgatcgccgtacctaaagtttaggaaacaggtacggtacccccgacggtagttacgaggtaggaagtggntcgagggactagtacttactactacacctatacgagcacggcctagccagacctagaacgtattagtnaactaactatacttactagtacaatagtatagtactcgtctactacttacgttccggccgtacggaccagtacgtacggtaacaagtacgaaacgtacgtggtcgcctagacc

SEQ ID NO: 412779 - DNA, 548 bp, Homo sapiens
  misc_feature: GZ8MTXP02GCDJ2.11.73.G07.1.454.CMB.2.raw
  modified_base (274)..(274): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagatcaccatcacttgccaggcgagtcaggacaattaagaacttaatttaaatggtatcggcagcgacgagggaaacncccctgacgctcctgatctacgatcgctacctaattaggaaacagtacggtcccccacgtaggtcaggtggaagtggatcgtagggacagtactttactctacaccatcagcagcctgacacgacgtagaagtatattcgaactaactattacttaactgtaaccaagtagttaatgtacttccgtacttaccctacttaacgtttcccggacccgttagggaacctaggagtacggaaactaagtaacgaaacgtactggtcggactacgacc

SEQ ID NO: 412780 - DNA, 572 bp, Homo sapiens
  misc_feature: GZ8MTXP02IR4X1.11.73.G07.1.454.CMB.2.raw
  modified_base (360)..(360): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactatttagaagtgtcactgtggcgtgcacctagtggagtcgtgggggagcttggtacagcctggacggtccctgagactctcctgtgcagcctctggatacatcttactaaaagtttcgaaatgacgtcgtgggtccgccgaggcctccggtggggaaggggccggagtggatttcatacatcagtagtagtggtaacnccttgtactatgcagactcgtagtgaagggcgtatcaccatcctcacgacgaacgaacgtaccaaagtacttaccgtacttagtttctagacctaaatacgaacagctacgaaggagacggagacgtacggtactttaagtttacgtaattgtcgcgtacgtataacgtaacaaggaaaaacggcggtacggtacccgttagtttacggggg

SEQ ID NO: 412781 - DNA, 753 bp, Homo sapiens
  misc_feature: GZ8MTXP02I35A3.11.73.G07.1.454.CMB.2.raw
  modified_base (195)..(195): a, c, t, g, unknown or other
  modified_base (272)..(272): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctccctgtctgcatctatagganacagagtcaccatcacttgccaggcgagtcaggacattaagaactatttaaattggtatcggcagcgacagggaacncccctagacgctcctgactctacgatcgcgtacctaaagtttacggaaaacacggtacggtacccccgaacccggtagggtttaccgaaggttagggaaacggttgggagttccggtagggggaacctaacgggttaaccctttttaacctccttaacccaaccctaagttacccgaacggaccaacggtcccgttacggtacccgaacggtaccccgttaaggaaaacgtaattaaacgtttacggaaaccctaaaaccgttaaatttaaaccgttttaaccttacggttaaaccccaaaacgtaacgtttaaacgtaggttaacctttcccggtttacctttacccctttaaccgttaaaaccggtttttccccggggacccccggtttacgggggaaaccctaaggggtaacggttaacgggaaacctaaacgtaacggtaaaaccgtaaacggttggtaccgggtcttacggaaccc

SEQ ID NO: 412782 - DNA, 519 bp, Homo sapiens
  misc_feature: GZ8MTXP02FWYIN.11.73.G07.1.454.CMB.2.raw
  modified_base (195)..(195): a, c, t, g, unknown or other
  modified_base (254)..(254): a, c, t, g, unknown or other
  modified_base (269)..(269): a, c, t, g, unknown or other
  modified_base (277)..(277): a, c, t, g, unknown or other
  modified_base (329)..(329): a, c, t, g, unknown or other
  modified_base (340)..(340): a, c, t, g, unknown or other
  modified_base (343)..(343): a, c, t, g, unknown or other
  modified_base (368)..(368): a, c, t, g, unknown or other
  modified_base (371)..(371): a, c, t, g, unknown or other
  modified_base (393)..(393): a, c, t, g, unknown or other
  modified_base (398)..(398): a, c, t, g, unknown or other
  modified_base (422)..(422): a, c, t, g, unknown or other
  modified_base (430)..(430): a, c, t, g, unknown or other
  modified_base (436)..(436): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctcctgtctgcatctagtagganacagagtccaccatcacttgccaggcagtcaggacattaagaactattaatgtatcggnagcgacgaggaaacncccgtagngacctcagtactctacgatgctactaattagaacagacggtccccacgtgtnagtggaagtgngtngggactagtactttactctacaacntanagacaggccctgacagccgtanaaagnttaatcgataactattattaacgntaaccaanagtatnacttctactctacgtacttccgaccgttaggaccaggtacgtaggacaagttaccgaaaagtaccggagttcgcaggtaaccc

SEQ ID NO: 412783 - DNA, 793 bp, Homo sapiens
  misc_feature: GZ8MTXP02H4R20.11.73.G07.1.454.CMB.2.raw
  modified_base (485)..(485): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtcctccacttccctccctgtctgcattctagtaaggagacagacgtccaccatcactcgccgagggcgagtacgacggtaactaattaaagtaactttaatttaaaggttggtaactcggacacggaccgaaccggaaggggaaccgcccctaggaccgtctccgtagtactcgtaacgattacggtaccttaaccgtaaagtttacgggaaaaccgtaacggtacccggtacccccccggtaacggtacgggttaacgaagggttaggggaaggttgggtacgtcggggtaacgtaaccgttaacgttaacccgtttaccncccttaaacccacccgttaagaccgacgtaccaccgtccgtacggactaccgtaacgtaaagggtaacttacttacgttaacaaacttaaactttaactttaaccttacggttaactaaaccgtaaagttaacggtttactacggtttaccttacccgttacccgtttaaccccggtttaacggttacccggggtttacccccggggaaaccggtaaacgggtaacggttaacgggtaaacggtaacgtaaacggtaaccgtaaaacgggttacggttacgggtacgtaccgtccgtaacccttaccg

SEQ ID NO: 412784 - DNA, 645 bp, Homo sapiens
  misc_feature: GZ8MTXP02IKOFG.11.73.G07.1.454.CMB.2.raw
  modified_base (198)..(198): a, c, t, g, unknown or other
  modified_base (420)..(420): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccatccctccctgtctgcatctagtagganacagagtccaccatcacttgccgaggcgagtcaggactaataagtaacttaattaagttgtatcggacacggccgaacgacgggaaccgcccctgacgtctctgactcgacgtactcgacgttacctaagttaacggaaactaggaccggtaccccccgacggtaggttacgaggttagggaaggttacggtgtcggtaggggtaactacgttacctttacncctacaactatacgacgcacgcctgacctacgaccgtaaggaatactagtacgtaacaacttaacttacttaccgtagtaacgtaactagttagtacgtacgttaccgttcctaccgttaacgttaccggtttcccggacccgggttaacgggaaccctagggtaacggtacggaaacgtaaggtaaccggaaaaccgttcgtacgggtcgtaccgtacggtacc

SEQ ID NO: 412785 - DNA, 655 bp, Homo sapiens
  misc_feature: GZ8MTXP02GLNF7.11.73.G07.1.454.CMB.2.raw
  modified_base (245)..(245): a, c, t, g, unknown or other
  modified_base (249)..(249): a, c, t, g, unknown or other
  modified_base (262)..(262): a, c, t, g, unknown or other
  modified_base (391)..(391): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagatcacatcactgccaggcgagtcagacattaagactattaatggtancggnagcgacaggaacnccctgacgctctgatctacgatcgacgtctaagttggaaacacggtacggtccccccacggtagtacaggtggaagtgggatcgtagggactagtaccgtttctacgtacacccataccgagtcgaacncccgtgacacgtcctaaggaacgtagttaacgttcgaaacctaaacgttacttaacgtttaaccgtacgttaaccaaaacgtaggtttaaacgttacggttaaacctaccggttttcccgttaccctttaaccgttaaaaccgggtttttcccggggacccccgttaagggggaaacccttaacgggaacgggtttacgaacccgtaaagtttaaaaccggaaaaccgttacggttacgtacggggtaccttacggtaaccccg

SEQ ID NO: 412786 - DNA, 591 bp, Homo sapiens
  misc_feature: GZ8MTXP02HZUJP.11.73.G07.1.454.CMB.2.raw
  modified_base (194)..(194): a, c, t, g, unknown or other
  modified_base (249)..(249): a, c, t, g, unknown or other
  modified_base (380)..(380): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatccctcctgtctgcatctatagganacagatcaccatcacttgccaggcagtcagacattaagaactattaatgtatcgnagcgacaggaacgccctgacgtctcctagactctacgatcgacgtacctaaagtttaggaaaactaggacgttacccccgacggtaggttcgaaggtggaaagttggatcgtagggacagttacctttacnctacacatacagcagtcctgaccagtcctagaagtatacttagacaaactattacttacgtagtaccaagtaattagtggtaacttccgtaccttacccttacgtaaacgtttcccgggaacccctgggggtaaaaccctacgggtaaggtaccgggaaaactaacgttaaacggaaaaccggtacgtacggtacggtacgttacgaaccg

SEQ ID NO: 412787 - DNA, 530 bp, Homo sapiens
  misc_feature: GZ8MTXP02JROMD.11.73.G07.1.454.CMB.2.raw
  modified_base (196)..(196): a, c, t, g, unknown or other
  modified_base (323)..(323): a, c, t, g, unknown or other
  modified_base (349)..(349): a, c, t, g, unknown or other
  modified_base (353)..(353): a, c, t, g, unknown or other
  modified_base (368)..(368): a, c, t, g, unknown or other
  modified_base (390)..(390): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctccatccctccctgtctgcatctatagganacaggatcacatcacttgccaggcgagtcaggacattaagaacttaattaagtggtatcggcagacgaaccgagggaaacgcccctgacgctcctgactactacgatcgactactaagttagaaacncgacgccccgacgagtcagtgagtgntcgnggactagtacttacnctccgacatcacgcacgtcctnaccgagtccgtagaaagattatacgaccaatatattctagtaacaagtatacagtcttactctactactacgttccggacccgtaggacctaggacgtacggtacaaggtacgaaacgtacggtcgtacggactacgacc

SEQ ID NO: 412788 - DNA, 601 bp, Homo sapiens
  misc_feature: GZ8MTXP02GSOZH.11.73.G07.1.454.CMB.2.raw
  modified_base (194)..(194): a, c, t, g, unknown or other
  modified_base (263)..(263): a, c, t, g, unknown or other
  modified_base (282)..(282): a, c, t, g, unknown or other
  modified_base (396)..(396): a, c, t, g, unknown or other
  modified_base (582)..(582): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctatagganacagagtcaccatcacttgaccaggcgagtcaagggactaattaagaacttaatttaaatggtatcggnaggccgaacgagggaaacncccctagacgcctcctagtactacagatcgtactactaaagtttaggaaacaggacggtacccccacggtacgttcgaagtggaacgtggatcgtaggggactagtactttacnctacacatacacgcagcctagcacgcctagaaacgtattaagttgaacctaaatactaatttactagaacctaaagtagttaaacgtgtaactccgtttacaccccgttagttaaccgtttcccgggacccgttagggaaaccgtaggttaacgcgggtaaactaagtaaacgaaaacgttaacgnggttcggacttacgaaccc

SEQ ID NO: 412789 - DNA, 827 bp, Homo sapiens
  misc_feature: GZ8MTXP02ISZ9Z.11.73.G07.1.454.CMB.2.raw
  modified_base (276)..(276): a, c, t, g, unknown or other
  modified_base (307)..(307): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggacagccgtggaccggtccctgacgtactctcctgtcgcagcctctggatacatcttanaaaagtttcgaaatgacgtcgtcgggtcccncgaggtcctccggtggggaacggggcccggtaggttcgggtaactttcaaagttaccaagttccgtaaggttaaggttacggttacggttaaaaccttacccgttttaggtaaaccttaggtcgaccgtaacggtaccctttcggtaggggtacgggtaaacggggtacccgtaacttacccgtaaccctacgttacccgtacccgaaacggaacccggtaaaaccgtaaaccccgaacccgtaaaaacgttaacctttaacccgttaaaccgttttaccggttttaacgtacggtaaaccttaaaacgtaaacggtaaaaccgtaccggtaccgttaggaaaacggtaacgggtaaaccgggaaacgggttaaacgttaaccggttaccgttttaaaagttttaaccgtttaggttacggttacggtaccgtaccggtaacgttaaccggaaaaccggtaaaaggtaaaaaccggggtcgggttaccgggtttaccgggttacggggttttaacggggg

SEQ ID NO: 412790 - DNA, 676 bp, Homo sapiens
  misc_feature: GZ8MTXP02FWI3X.11.73.G07.1.454.CMB.2.raw
  modified_base (151)..(151): a, c, t, g, unknown or other
  modified_base (483)..(483): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtnctccttgttactatttagaaggtgtccatgtggcgtgcactagtggagtcgtgggggagtcttggtacaggtccgtgggaccggtccctgacgtacctctcctggtgcacgcctcgtggatacattcttaactaaaaggtttacgaaagttgagtccgtcggggtcccaccgtacggcctccggagggggaacggggccggaggttggtatttacatacatcgaagttagtagtagtaacctcgttagtactgcgacagtacctgtaggtagggacggtccgtattaccgactactccacgagacaacaacgacaaacgtatacctacgttntttacgagtactaaagtacgaacgtagaccgtaggaacggaacggaacggtaacggtaaacgttaaccggttaacgttttaactttaaccgttaaggtttggtaccggtaccggtagtaaacggtaaccgaaaaggtaaaacgggtaaaaacgggtcggggtacggttaccggtttagggggttttacggggg

SEQ ID NO: 412791 - DNA, 634 bp, Homo sapiens
  misc_feature: GZ8MTXP02HYTQG.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttgggacaggcctgggacggtccctgacgctctcctgtgcagcctcgtggatacattcttacaaaagtttcgaaatgacgtcgtcgggtcccgccgaggccgtccggtggggaacggggccgtaggtgtatttcatacatcagtagtagtagtactcttagtactgtcgacagtactcgtgtagggaacggccgtagtccactactcctacgagacgaacaaccgacctaaagtacttactacgtttcgtttactacgtactaaagtacgaaacgtacgaccgtaggaacggaggtaaccggaaggtaacgttaccggtactttaaacgtttacgttaagttcggtacgcggtacgtaacgtaacgaaacgaaaaggtaaaacgggtcgggtacgggtacccgttaaggggtttcggggg

SEQ ID NO: 412792 - DNA, 713 bp, Homo sapiens
  misc_feature: GZ8MTXP02F7DE1.11.73.G07.1.454.CMB.2.raw
  modified_base (302)..(302): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctcttgttactattttagaaggtgtccactgtggcgtgcacctagtggagtcgtgggggagcttggtacagcctggacggtccctgagactctcctgtgcagcctctggactacatcttaacaaaagtttcgaaatgagcgttgggtcccncgaggtcctccggtagggggaacggggccggtagtcgggtatttcaagtacatcaagttagtagtagtaaacctacgtttgtaactagtcgactagtaccgttcgtagggttaacggaaacgggggacccttaacttacccgtaaaccctaacgttacccttacccgaaacggaccgaaaccgaaaaccggaccccaaaaagttaacctttaccttaaccgttaggtttttacccgaggtaacctaaaagtacgaaaccgtacgtacccgttaggaaacggacggtaaacggaagggtaaacgttaaccgggtacttttaaacggttttaacttagtttaggtcgtacggccttaacgaacgtaaacgaaaggtaaaacggtcgggtacggtaccgttaaggtttcggggg

SEQ ID NO: 412793 - DNA, 640 bp, Homo sapiens
  misc_feature: GZ8MTXP02IWQWW.11.73.G07.1.454.CMB.2.raw
  modified_base (337)..(337): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctgggacggtccctgagctctcctgtgcagcctctggatacatcttacaaaagtttcgaaatgagctgggtccgcaggcctccgtggggaaggggccggagtggatttcatanactcagtagtagtggtaacaccttgtactatgacagtactcgtcggtaggacgggaccgtattccgacctactacctacccaggaacaacgaaacccgaccaaagtaacttacctaacgtttcgtttaccgttgaactaaagttagaaaccacgtaccgtaggaaggaaggaaccggtaagaacggttaaaccgggtactttaaattttaacgtttaaagtttggttacggaccgtacgtacgtaacgaaaccgaaaggtaaaaaacggggcggtaccgggtaccggttacggtttcgggggg

SEQ ID NO: 412794 - DNA, 830 bp, Homo sapiens
  misc_feature: GZ8MTXP02G6KW4.11.73.G07.1.454.CMB.2.raw
  modified_base (255)..(255): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgcgtgggtgctccttgttactattttagaaggtgtccatgtggcgtgcactaggtggagtcgtgggggagcttggtacagccgtgggaccgtccctgagtactctcctgtcncacgtcctgtggatacattacttaacaaaagtttacgaaaatgacgtcgtcgggtcccgacacggtccgtaccggtagggggaaaccggggccggtaggttaggttaatttaccgaaattaaccgagttaccggtaaggtttaaggttaacggttaacggtaaaacccttacccgttttaaggttaaccctttggtacgtacccgtaaaggtaccgttcggttacgggtacggggaaaacggggtcccgtatttaacccgaaccgtaacttccgaacccgaagaaccgaaacaaacccggaactaaaacggtaactttaccggtaactttacgtttacccgtaagtaaacccgtaaaattaaccggtaaaaccgaaccgggtttaccaacggggtaaaagggaaacgggttaaaccgggaaaaggggttaaaccgtttaacccggggttatttaaacggtttttaaactaggtttacggttacggtaccggtacctaacgttaaccgggaaaagtaaaaccgggtaaaaacgggtcggggtacgggtaacccggtttaggggttttaccgggggg

SEQ ID NO: 412795 - DNA, 534 bp, Homo sapiens
  misc_feature: GZ8MTXP02GQDJC.11.73.G07.1.454.CMB.2.raw
  modified_base (258)..(258): a, c, t, g, unknown or other
  modified_base (297)..(297): a, c, t, g, unknown or other
  modified_base (363)..(363): a, c, t, g, unknown or other
  modified_base (493)..(493): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctggacggtccctgagactctcctgtgcagccctntggatacatcttacaaaagtttcaaatgagctgggtccncaggctccgtggggaaggggccgagtggatttcgatacatcagtagtagtggtaacacttgtactntgcagactcgtgtaggaacgggccgagttcaccatctccagacgacaacgacaagtaacttcacttgtttctgactaaagtagaaacagcctagagagacgagagtacggattatttactattcgtgcgngatcgaacaagaaaacggcggtacgaccgtaggttacgggg

SEQ ID NO: 412796 - DNA, 610 bp, Homo sapiens
  misc_feature: GZ8MTXP02FYDWK.11.73.G07.1.454.CMB.2.raw
  modified_base (260)..(260): a, c, t, g, unknown or other
  modified_base (274)..(274): a, c, t, g, unknown or other
  modified_base (370)..(370): a, c, t, g, unknown or other
  modified_base (381)..(381): a, c, t, g, unknown or other
  modified_base (452)..(452): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtctgggggagcttggtacagcctgggaccggtccctgacgactctcctgtgcagcctnggatacatccttanaaaagtttcgaaatgagcgtgggtccgcaggtctccggtggggaacggggccggagtggtatttcatacatcagtagtagtagtaactctgtactntgctagacctntggtagaaacgggtcctattacccacacgtctacccgagacgaacaaacgaccaaagtaactctaccgttntttacagacctaaagtagaaacgtcgacgtacgaaggacgtaacggaaggtaacgtaccggttattaactttaacgtaagtttggtacgtacggacgtaagtaaccgaaacgtaaaaggaaaacggtcggtacgggtaccgtacgggttttacggggg

SEQ ID NO: 412797 - DNA, 652 bp, Homo sapiens
  misc_feature: GZ8MTXP02GERK9.11.73.G07.1.454.CMB.2.raw
  modified_base (370)..(370): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctggacggtccctgagctctcctgtgcagcctctggatacatcttacaaaagtttcgaaatgagcgtgggtccgccaggcctccgtggggaacggggccggagtggatttcatacatcgagtagtagtaggtaactacttgtactntgcagtactcgtagtggaacgggcctagttaccacctatcctccgagacgaaccaaccgaccaaagtaacttactacgttacgtttactacgtactaaagtacgaaacgacgacctaggaacggaacgaacgggaaggtaacgttacgggtaccttttaagttttaaccgttaagtttacggtacggtacccggtaacggtacggttaaaccggtaaaccggaaaaggtaaaaacgggtccggggttaaccgggtacccggtttaaggggttttacgggggg

SEQ ID NO: 412798 - DNA, 705 bp, Homo sapiens
  misc_feature: GZ8MTXP02F8K9A.11.73.G07.1.454.CMB.2.raw
  modified_base (193)..(193): a, c, t, g, unknown or other
  modified_base (699)..(699): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctcctgtctgcatctatagganacagagtcaacatcacttgccaggcgagtcaaggactaattaagaacttaatttaatagtatcggacagacgacgaagggaaacgccccgtagactctacctgactacgtacgtaactgaccgttaccgtaaatttaacgggaaaactacggtaaccggtaccccccgtaaaccggtacgggttaccgtaaagggtagggtaaacggttagggtacgttacggtaggggaaactaacggttaacctttttaacctcctactaaacccaacttaccgaaacggcaaacgtcccgttaacggcccgtaacgacccgtaggtaaaacgactttaaaggtaccaactaaaacctatttaaactttaacgtagtaaccaaacgtaaggttaatagtacttacgttaccttaccccgttaacgtaacgttttcccggacccggttaacgggaacccgtacggttacggacggttaaccaagttaacgaaaccgtaagtcgttacggccgtanaacccg

SEQ ID NO: 412799 - DNA, 505 bp, Homo sapiens
  misc_feature: GZ8MTXP02JFGTW.11.73.G07.1.454.CMB.2.raw
  modified_base (192)..(192): a, c, t, g, unknown or other
  modified_base (275)..(275): a, c, t, g, unknown or other
  modified_base (387)..(387): a, c, t, g, unknown or other
tcagcgagagataccacgaccggtgctcgatttagctctacgctcaggggcaggagtcagtcccaaccaggacacagcatggacatgagggtccctgctcagctcctggggctcctgctgctctgtctctcaggtgccagatgtgacatccagttgacccagtctccatcctcctgtctgcatctatagganacagagtcaccatcacttgccaggcgatcaggacatagactattaatggtatcggcagcgaccaggaaagcccctgagctccngatcacgatgcgtccaagtttgaaacagacgtccccacgtggttacagtggaagtggatctgggacagtacttacgctcacatcagcagcctgcagcctagagtataagttnacaactattattactatacaactagtatagtcgttccgtcgtactacgtacgtttccggacccgtaggacctaggtacgtacgaactaagtaacgaaacgtacgtagtacggctacgc

SEQ ID NO: 412800 - DNA, 602 bp, Homo sapiens
  misc_feature: GZ8MTXP02HRMH4.11.73.G07.1.454.CMB.2.raw
  modified_base (354)..(354): a, c, t, g, unknown or other
  modified_base (363)..(363): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactatttagagtgtccatgtggcgtgcacctagtggagtcgtgggggagcttggtacagcctgggacgtccctgagactctcctgtgcagcctctgatacatcttacaaaagtttcaaatgagcgtcgggtccgcgaggcctcggtggggaacgggccggagtggtatttcatacatcgagtagtagtgtaacncttgtactntgcagacttctaggtgaacgggtccgattaccactagtctaccgagacgacaaccgacaaagtactactacgttcgtttacttagaactaaagtacgaacgaacgtacctaggaggaaggaccggtaagaacgttaccggtacgtttaaacgtttacgtagttacgttggaccgtaggacttaaccggaagaaaacggtaaaaacggcgggttacggtaacccggttaggtttcggggg

SEQ ID NO: 412801 - DNA, 850 bp, Homo sapiens
  misc_feature: GZ8MTXP02H9UKX.11.73.G07.1.454.CMB.2.raw
  modified_base (389)..(389): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtctcactcctccctgtctgcatctagtaggagacagagtcacatcactgccgaggcgagtacgagggtaactaagttaaagtaacttaagtttaaaagttggtaactcgggacaacggccggaaaccgaaggggaaacccgtcccccgtaggaaccgtccttaccgtaggaacttcgtaaacggagttcggaccgtttaaccgtaaaggtttacgggaaaaaccncgggtaacccggtacccccccgaaaccgggttaaggggtttaccaagggggtttacggaaacggttgggtacgttaccgggttagggaaacccgtttaacggtttaacctttttaacccgaccttaacccaaaccccgttaacgtaccggaacgtacccgtacgtacccgttacggtaccgtaaccggttaccgtaaaggtaaacgttaacgttaacggtttaaccgtaaaaccttaaaacgtttaacgtttaaacgtttaaccgttaacggttaaacctaaaaggttacggtttaacgttacggttaccgttcccgtttaacccgttaacccgtttaacggtttaacccggtttcccgggacccgggttaacggggtaaccgttaacgggtacggtacgtaaaccgtaaacggtaaccggtaaaacggttacggtcggtaaccggtacttaaccggaccc

SEQ ID NO: 412802 - DNA, 642 bp, Homo sapiens
  misc_feature: GZ8MTXP02IUFD8.11.73.G07.1.454.CMB.2.raw
  modified_base (256)..(256): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcgttggtacagccgtggaccggtccctgagactctcctgtgcngcctcgtggatactatcttaacaaagtttacgaaatgagcgtcggtccgccacggtctcggtggggaacggggccggagtggtatttcatacatcagtagtagtagtaactaccttagtactgtcgacagtaccttcgtaggtagggaacgggtaccgtacttccgaccctacgtacctaccacgacgaaaccgtaaccgaccaaagtaaacttacctacttcgtttactagaactaaagtacgaaacgacgaccgtaggaacgaggaacgggaggtaacgttaaccggtactttaacgtttacgttagttacggtcgtacgacgtaacgtaacgaaacgaaaaggtaaaaacggtcggtacggtaccgttacgggtttacggggg

SEQ ID NO: 412803 - DNA, 661 bp, Homo sapiens
  misc_feature: GZ8MTXP02H5RX5.11.73.G07.1.454.CMB.2.raw
  modified_base (283)..(283): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctcactcctccctgtctgcatctaataggagacagagtcacatcacttgccaggcgagtcaggacaattaaagaacttatttaaagttggtatcggacacgacgaaccgaagggaaacnccctagacgcctaccgtgactctaacgatacggaccgttactaaagtttaggaaaacaggacgtaccccccgacgtaggtttacaagggttaggaaggtgggtatacggttacgggaactacgttactttaccctactacccaacccagttaccaagacccgaacgcccgttgaccgtaacgtaccctaagtacgaatttaacgttgtaaaccaacttaattaacttaacgtgttaaaccgaataagttagacggttacttaccggtaccttacccgttacgtaaaccgttttcccggacccgtacggggtaccaagggtaacgttacggaataacgttaacggaaaaacgttaccgtagtacggtactaccggaccg

SEQ ID NO: 412804 - DNA, 703 bp, Homo sapiens
  misc_feature: GZ8MTXP02FI1VB.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagccgtgggaccggtccctgagactctcctgtgcagcctctgatacatcttacaaaagtttcgaaatgagcgtcgggtccgaccgaggcctccggtaggggaacggggccggtaaggtggtattttccgaatacagtcgaaggttaaggttacggtaggttaaaccttaccgtttaggtaacttacgtcgacgtaacgttaccttcgttagggtacgggaaacgggtacccgtaacgtttacccaaaccctaacgttccctaacccgaaaggaaccgaaacccgaaaccgaaccgtaaaagtaactttacctacgtttagtttacctagtaacctaaaagtagaaacccgagtaccctaggaacgaaggaacgaaggtacgtaacggtactttaagtttacttagttacgtcggtacgacgtaacgtaacggaaaacgtaaaaggaaaacggtcgggtacggtaccgttagggtttcggggg

SEQ ID NO: 412805 - DNA, 782 bp, Homo sapiens
  misc_feature: GZ8MTXP02ICUJK.11.73.G07.1.454.CMB.2.raw
  modified_base (258)..(258): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggacagccgtggacggtccctgagactctcctgtgcagcctntagactacattccttaactaaaaggtttcgaaattcggagtcgtcggggtcctaccgagggtcccttccgggtagggggaaacgggggtcccggtagggttggttactttaccgaaagttacctagttacgtaaggtttacggtaacgggttacggttaaactaccttttaggtaaccttagttcgacgtaacggttaccttcggtacgggtacgggtaaacgggtacccgtaacttacccgaacccgtaacctttcccgtaaccccgtaaaggaaccgtaaacccggaaaacccggaccccctaaaaggtaaacttttaccctaaaccgttttccgtttaccgttaggaaacttaaaacgtacccggaaaccgtacgttacccggtaaggaaggtaacccgggaaggtaaacgggtaaacgttacgttaccgtttaatttaaaccgttgttaaggtccgacgttaccgagtaacgtaaccgaaaggtaaaacggtcgggtaacgtcgtttagggtttcggggg

SEQ ID NO: 412806 - DNA, 619 bp, Homo sapiens
  misc_feature: GZ8MTXP02GQQLZ.11.73.G07.1.454.CMB.2.raw
  modified_base (243)..(243): a, c, t, g, unknown or other
  modified_base (251)..(251): a, c, t, g, unknown or other
  modified_base (512)..(512): a, c, t, g, unknown or other
  modified_base (519)..(519): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagtcttggtacagccgtgggaccgtccctganctctctgngcagcctcgtggatacattcttaactaaaagtttcgaaaatggagcgtacgggtcccaccgaggccgttccggtagggggaacggggtcccggtaggtgggtattttaccgaattaacagttacgtaaggttagtaacggttacggtaaacctacgtttagaacttgtgacagtactgtggtaggacgggtcctattaccactactcacagactaacaaccgtactaaagtacttctacgttcgttactagaacttaaaancgaaacncgtacgtagaacggagagagtacgtacgtacttacgttatacgtgtacgctagagtaacgaataaacggaaacgtcggtacgtaaccgtgggtttacggg

SEQ ID NO: 412807 - DNA, 682 bp, Homo sapiens
  misc_feature: GZ8MTXP02G4CDK.11.73.G07.1.454.CMB.2.raw
  modified_base (196)..(196): a, c, t, g, unknown or other
  modified_base (289)..(289): a, c, t, g, unknown or other
  modified_base (347)..(347): a, c, t, g, unknown or other
  modified_base (441)..(441): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgaccagtcctccatccctcctgtctgcatctagtagganacagactcactatctactgccgaggcgagtcgaaggactaattaaagtaacttaagtttaaagtggatcggacagaccgaacggaaggaaccncccctggactctacagtctacgtaacgctacggtacctaacgttaagtaacggaaacncgggttaccgaccccccgtaaacggttggttacgaaggggttgggaacgttacgggacgttcgaaggggaacttaccgtttaccttttaacccncctacaaccgtacgtaccgaacgccgtaccgccgtacgacgtaaccgtacgtaaagtaagttacttacgtacgaaaacttaacgttaattacctttacgaacgtaaacctaagttagttacgtaacgttacctttaccgtaccgttacccgttaacggttaccggtccccggtaacggtacggaacgtacggtacgtacgaacgtaaggaaccgaaacgttaggtcgacgtacacgtaccg

SEQ ID NO: 412808 - DNA, 847 bp, Homo sapiens
  misc_feature: GZ8MTXP02JAVDR.11.73.G07.1.454.CMB.2.raw
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcaccgtagtggagtcgtgggggagtcttggtacagcctgggaccggtccctggacgtctctcctgtcgcagcctctggatacatcttactaaagtttacgaaatgacgtcgtcgggtccgccgtacggccgtccggtaggggaacggggcccgggtaagggtggttactttcgaacgttaacctacgttaccgtaacggttaggttaacgggtttacggtaaaccttacccgtttacggttaacttagttacgacctaacgtaccgtttcgttacggtacgggaaacggggtacccgtaaacgtttacccaaccctacttacccttaccgtaacggaaccgaaacccgaaacccgtaaacccgtaaaggttaaacctttaccgttaaccgttttacggtttacccgttacgtaaacgtaaaacggttaacgtaaaacccgtacggtacccgttaagggaaacggtaacggaaaccggggtaaaggtaaacccggttaacgggttaaccgttttaacttttaaaccggtttaaggtttaccggtttacggtaaccgggttaccgtaaacggtaaccggtaaaaacgggtaaaacgggtaaaaacgggtacccgggggttaacggtttacccgggttaacggggtttttacccgggggg

SEQ ID NO: 412809 - DNA, 599 bp, Homo sapiens
  misc_feature: GZ8MTXP02HGKEI.11.73.G07.1.454.CMB.2.raw
  modified_base (263)..(263): a, c, t, g, unknown or other
  modified_base (277)..(277): a, c, t, g, unknown or other
  modified_base (282)..(282): a, c, t, g, unknown or other
  modified_base (300)..(300): a, c, t, g, unknown or other
  modified_base (322)..(322): a, c, t, g, unknown or other
tcagcgagagataccacgaccggtgctcgatttagctctacgctcgagggggcaggagtcagtcccaaccaggacacagcatggacatgagggtccctgctcagctcctggggctcctgctgctctgtctctcaggtgccagatgtgacatccagttcgacccagtctccatccctcctgtctgcatctataggagacagacgtacaccatctacttgccgaggcgagtcgaggacaattaagaattaattaagtgtatcganagcgacgaggaacncccgngacgctctgactctacgntcgcttactaagttacgaaacnggtaccgaccccgacggtagtcaggtacggagtgcgtcgacggactacgttactttctaccgacactatacagaccgtacgcccgtagacccgaacgtaccgtaaggtaaacgtacgttaacttacgaactaaacttattaacttactacgtaacctaagtagtatacgtacttctactccgtaacgttaccgtttaccggaccgttacgggaccgtaagtacggtaacgaccgtaagtaacggtaaacgtacggtggtaccgacggttacgaaccg

SEQ ID NO: 412810 - DNA, 720 bp, Homo sapiens
  misc_feature: GZ8MTXP02I9WD4.11.73.G07.1.454.CMB.2.raw
  modified_base (197)..(197): a, c, t, g, unknown or other
  modified_base (300)..(300): a, c, t, g, unknown or other
  modified_base (455)..(455): a, c, t, g, unknown or other
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttcgacccagtcctccatccctccctgtctgcatcagtagganacagatccactatcgacttcgaccgaggcgagtcaggtaactaagttaaacgaattaagttaagttggtaatccggacaacggccgaaccgaagggtaaaccnccccgtagacgtccgtcctaggtactcgtaacgacttcggtccgttaacctaaagttacggaaaacgtacgggtacgtaccccccccgtaaggtcggttaacagggtacgggaacgttgagttcggaacggggacttaccgttacttttaacccncctaacccaacgtagtacgacgacgtacgtccgtacgacccgtacgtacgtaaagaagttacgttacgtactaaacctaaacttacttaaccgtttacgtaacgtaaacgtaacgtaggttacgttacgtaccgttaccgttaccttaacccgttaacgttaccgggttcccggaaccgggtacggtaaaccgtacggtaacggtacgtaaaacgtaacggtaaaacgtaaaaccggtacgtggtacccggtacgtaacgtaccg

SEQ ID NO: 412811 - DNA, 490 bp, Homo sapiens
  misc_feature: GZ8MTXP02JZXN5.11.73.G07.1.454.CMB.2.raw
tcagcgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactattaaatggtatcggcagcgaccagggaaagcccctgagctcctgatctacgatgcgtccaatttggaaacagaggtcccccacgagttcagtggaagtgggatctggggacagactttactctcacatcagcagccctgcagcctgaagatattgcaaacatattactgtcaaacagtatgatcgtctctcgaatttcggaccctgggaccagagtggaacaagtcgaaaacggaactgtcggactgacc

SEQ ID NO: 412812 - DNA, 652 bp, Homo sapiens
  misc_feature: GZ8MTXP02HLNQD.11.73.G07.1.454.CMB.2.raw
  modified_base (190)..(190): a, c, t, g, unknown or other
  modified_base (257)..(257): a, c, t, g, unknown or other
  modified_base (320)..(320): a, c, t, g, unknown or other
  modified_base (403)..(403): a, c, t, g, unknown or other
  modified_base (407)..(407): a, c, t, g, unknown or other
  modified_base (412)..(412): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtncacctagtggagtcgtgggggagtcttgggacagcctgggacggtccctgacgtactctccgtgtcncacgcctgtggactaactactcttataaaaggtttacgaaatggacgtccgtcggggtacccncgacgggtctcccggtaggggaacggggccggtaggtggtactttcgataccagttacaggttagtagtacgtaactcgttanactntcganacgcttgtggacgtacgggtaccgtatccgaacctacttaccgtaccgaaggtacgaacgtaaaccgaaccgaaagtaacttactacctttcgtttctacgactaaacgtacgacgtacgacgtacgaacggagaacgaagtacgtaacgtactttacgttacgtagttcgtacgtacgtaccgtagaacgtaacgaaacggaaaacgggtcggtacggtaccgttacgggtttacgggg

SEQ ID NO: 412813 - DNA, 717 bp, Homo sapiens
  misc_feature: GZ8MTXP02I0AFJ.11.73.G07.1.454.CMB.2.raw
  modified_base (368)..(368): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttgggctgtgctgggtgctccttgtactatttagaaggtgtccacgtgtggcgtgccaccgtaggtggagtcgtgggggagcttggtacagcctggaccgtccctgacgactctccgtgtcgcacgcctctggataccgatcttacaaaaggtttcgaaatgaacgtcggtcgggtaccgccgaggtcctccggagggggaacggggcccggtagtcgggtatttacgaatacgnttacgaggttacgtagtaacggtaacctccgtttagtaccttagcgtactacgtacttcgtaggtagggtaaccgggacgtacgttaccaaccgtactaccttacgaacgaaccgaacgaaccgaaccgtaaactaattaccgtacttaggtttccttagactaaaacgtacgaaaccgtaacgtaccgtaggaacggtaacggaacggtaacggtaaacgttaaccggttacgtttaaacggtttaaacttacggtttacggtacgtaccggtagtaacgtaacggaaaacgtaaacggtaaaaacggtcggggtaaccgtttacccggttaagggttttaacggggg

SEQ ID NO: 412814 - DNA, 644 bp, Homo sapiens
  misc_feature: GZ8MTXP02HPYYU.11.73.G07.1.454.CMB.2.raw
  modified_base (269)..(269): a, c, t, g, unknown or other
  modified_base (357)..(357): a, c, t, g, unknown or other
tcagcgagagataccacgaccggtgctcgatttagctctacgctcaggggatctcagagaggtgccttagccctggattccaaggcatttccacttggtgatcagcactgaacacagaggactcaccatggagttggggctgtgctgggtgctccttgttactattttagaaggtgtccactgtggcgtgcacctagtggagtcgtgggggagcttggtacagcctgggacggtccctgagacgtctccgtgtgcagcctctggatacntctcaaaagttcgaatgagctggtccgcaggctccgtggggaaagggccgagtcggatttcagtacatcgaggtagtaggtgtaaacnccgtttaggtaacctagtcgacacggtaccttctggtagaacgggtaccgtattacaccatacctccaacgaacgaacgaaccgaccgaaacgtattaccgtacttacgtttacgtagtacaaaagtacgaaacgacgtacctaggaaccggtagaaccggaaagggtaagtaacccggggtacttaaacgttttaacttaacttggttacgtaccggaccggtacttaaccgaaacgaaacggtaaaaacgggtcggtacgggtacccgttaaggtttcccggggg

SEQ ID NO: 412815 - DNA, 696 bp, Homo sapiens
  misc_feature: GZ8MTXP02F4JDB.11.73.G07.1.454.CMB.2.raw
  modified_base (143)..(143): a, c, t, g, unknown or other
  modified_base (151)..(151): a, c, t, g, unknown or other
  modified_base (213)..(213): a, c, t, g, unknown or other
  modified_base (265)..(265): a, c, t, g, unknown or other
  modified_base (268)..(268): a, c, t, g, unknown or other
  modified_base (272)..(272): a, c, t, g, unknown or other
tcagcgagagataccacgaccggtgctcgatttagctctacgctcaggggatctcagagaggtgccttagccctggattccaaggcattttccacttggtgatcagcactgaacacagaggactcaccatggagttgggctgngctgggtnctccttgttactattttagaaggtgtcactgtgcgtgccacgtagtggagtcgtggggggancttagggtacagcctgggaccgtccctgagactctcgtgtgcagccgttacnggntaanatacctttataaaaacgtttcgaaaatggtaacgcgttacgggttccgaccgacggactccggtaggggaaacgggggtccggaagttgggtactttttaccattaaccgtaagttctaaaggtagtttaggtaacggttaaactaccgtttacgtaactttagcgtacgacgttacgtacgttaggacgggtaacggcctaagttacacgttaacgtaccaaccgtaagacgaaaccaacgtaacgtaaaagtacgtttacctagtttccgtttatagaactaagtaacgtaacacggactaggaagacgaagtaggtaacttacgtaatttacgtaacgttggttcgtacgaccgtaggtaaccgaaacgtaaacgaaaacggtaaacggtacggtcggtaaccggttagggtttaccgggg

SEQ ID NO: 412816 - DNA, 579 bp, Homo sapiens
  misc_feature: GZ8MTXP01EJTIR.9.25.C03.1.454.CMB.2.raw
  modified_base (233)..(233): a, c, t, g, unknown or other
  modified_base (468)..(468): a, c, t, g, unknown or other
tcagtgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagccaccctcggtgtcagtggcccctggaaagacggccagcataacctgtgaggganacaaacaattaaaacaaataatgtgcatggtaccagcagaagccaggccaggcccctgtcctggtcgtctttgatgatagtcgaccggccctgagggactccgtgagcgtacttctctggcctacccaaacttcgtgggaaaccacgggcccaaccctgaacccatcgaggcggggtacgaaggccggggatggaacggccgtatacttcgtgtcagctggggtgggtattcgtnatgagtgggtaggtgggggtaattcggtcgggcgggaacgggccgagggcttcggacccgtacgttaagttcacgcccgaaggcctcgccccgttcggtccttccgttccg

SEQ ID NO: 412817 - DNA, 477 bp, Homo sapiens
  misc_feature: GZ8MTXP01EYROP.9.25.C03.1.454.CMB.2.raw
  modified_base (320)..(320): a, c, t, g, unknown or other
  modified_base (431)..(431): a, c, t, g, unknown or other
  modified_base (440)..(440): a, c, t, g, unknown or other
  modified_base (472)..(477): a, c, t, g, unknown or other
tcagtgatacgtctcacgaccggtgctcgatttagtagtgtagatttgggtttgggaacctatgaacattctgtcagtggcccctggaaagacggccagcataacctgtgagggagacaacattaaaacaaataatgtgcattggtaccagcagaagccaggccaggcccctgtcctggtcgtctttgatgatagtgaccggccctcagggactccctgagcgattctctggctccaactctgggaacacggccacctgacccatcaggcggggtcgaagccggggatgaggccgactattctgtcagctgtggattctnatgatgggtaggtgggggaatcgttcggcggagggaccccagggctgaccgtccgtaaagtcaagccccaagggcctcgcccccgtcggcacctctcgttccccaccctcncagtacgtntcactgacgcgggactggcgaaggcgcatagnnnnnn

SEQ ID NO: 412818 - DNA, 638 bp, Homo sapiens
  misc_feature: GZ8MTXP01DDJ0K.9.25.C03.1.454.CMB.2.raw
  modified_base (354)..(354): a, c, t, g, unknown or other
tcagtgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagccacctcggtgtcagtggcccctggaaagacggcagcataacctgtgaggagacaaacaattaaaaacaaataatgtagcattggtaccagcaagaagccaggccacggcccctgtcctggtcgtctttgatgatagtcgaccggccctcgagggactcccgtgagcgtacttccntcggctaccgaaacttcgtcggggaacaccgggacccacccgtgaccagtcgacggcggggtacggaacggccggggagtggacggccgtacttactttcgtgtcgacgtcgttggggttcggggtatttccgtacgtagttgtaggttgggtaaggggtgggggtaacgttccggttcggggcggggtaacggggaccggacgggtcgttacggtacccgttacgttaacgttccgacggcccgaacggccgtccggccccgttccggtccttaaccgttccg

SEQ ID NO: 412819 - DNA, 507 bp, Homo sapiens
  misc_feature: GZ8MTXP01EN8SP.9.25.C03.1.454.CMB.2.raw
  modified_base (497)..(507): a, c, t, g, unknown or other
tcagtgatacgtctcacgaccggtgctcgatttagtagtgtagatttgggtttgggaacctatgaacattctgtcagtggcccctggaaagacggccagcataacctgtgagggagacaacaattaaaacaaataatgtgcattggtaccagcagaagccaggccaggcccctgtcctggtcgtctttgatgatagtgaccggccctcagggactccctgagcgattctctggcctccaactcgtagggaacacggccaccctgaccatcaggcggggtcgaaggccggggatggaggccgactatttctgtcagctggtggattctcatgatgggtaggtgggggaatcgttcgggcggaggggaccccagggctggacccgtcctaaaagtcaacggcccaaagggcctccgccccccgtgggtccacctcctcgttcccccgccctcctcacgtacgtactcaccgtgacgcgggctggacgaaggcgcagagnnnnnnnnnnn

SEQ ID NO: 412820 - DNA, 734 bp, Homo sapiens
  misc_feature: GZ8MTXP01DE5PZ.9.25.C03.1.454.CMB.2.raw
  modified_base (231)..(231): a, c, t, g, unknown or other
tcagtgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagccaccctcggtgtcagtggcccctggaaagacggcagcataacctgtgagganacaacaattaaaacaataatgtagacattaggaccagcagaagcaggccaggcccctgtcctggtctctttgatgatgtcgaccggccctcgagggtactccccgtaggacgtcgtactttcctacgttcgggacccttaccctaaaaacccgttccggttaacggggggaaaaccctaccccggggacccctaaaccccccgtagaacccccgtaaacgtccggacggggtaccgggggtaccgggaaacgggacccgggggtagtacgggacgggtacccgtacgtttacgttacgttcgtcgtaacggtccggttgggggtacggggttaacgtttccgtacgtaagttagggtaggttagggggttaacgggggttgggggttaaacgttccggggttaccgggggcgggaacggggaccgttacggggtcgttacggtacccgtacgttacgttccgacgcccgacggccgtccgccccgttcggtccttcgttcccg

SEQ ID NO: 412821 - DNA, 551 bp, Homo sapiens
  misc_feature: GZ8MTXP02JN2A8.9.25.C03.1.454.CMB.2.raw
  modified_base (532)..(532): a, c, t, g, unknown or other
  modified_base (534)..(551): a, c, t, g, unknown or other
tcagtgatacgtctcacgaccggtgctcgatttagtagtgtagatttgggtttgggaacctatgaacattctgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcaggcggggtcgaaggccggggatggaggccgatatttctgtcagctggtggtattctcatgagtgggtaggtgggggaattcgttcggggacgggaggggaccccgagggtcctacggtacccgttacctaaaggtcacggtccccgaaagggcctccggccccccgtcgggtcccaccgttcctccggtttcccccgccccttccgtacacgtacgtactccaccgtggacggccgggtctcgggacgaacgggccgacaagtagngnnnnnnnnnnnnnnnnnn

SEQ ID NO: 412822 - DNA, 644 bp, Homo sapiens
  misc_feature: GZ8MTXP02G0OYP.9.25.C03.1.454.CMB.2.raw
  modified_base (233)..(233): a, c, t, g, unknown or other
tcagtgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagccaccctcggtgtcagtcggcccctggaaagacggccagcataacctgtgagganacaacaattaaaacaaataatgtgcattggtaccagcaagaagccaggccacggcccctgtcctggtcgtctttgatgatagtcgacccggccctcgagggactcccgtgagcgtattctctggcctaccaacttcgtcggggaaaccaccggcccaacccgtgaacccagtccgacgggccggggtacggaacggccgggggagtcggacggccgacgttacgtttcgtagtcgagtcgtaggtgggtacttcgtacgtagtgtagtaggggttagggtagggggtaacgttcggttcggggacggggtaacgggaccggagggtcgtacggtaacccggtccgtaaacggtccgaaccggaacccgaaaacgccgttacccggcccccgtccggtaccaccgtttcccg

SEQ ID NO: 412823 - DNA, 460 bp, Homo sapiens
  misc_feature: GZ8MTXP02FOL5Y.9.25.C03.1.454.CMB.2.raw
  modified_base (376)..(376): a, c, t, g, unknown or other
  modified_base (455)..(460): a, c, t, g, unknown or other
tcagtgatacgtctcacgaccggtgctcgatttagtagtgtagatttgggtttgggaacctatgaacattctgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcggggtcgaagccggggatgaggccgactattctgtcagctgtgggattctcatgatggtagtgggggaatcgttcggcggagggaccccaggctgaccgtctaagtcngcccaaggctcgccccctggtcactctcgttcccaccctcctcagacgtatcactgagcgggctggcaaggcgcatagnnnnnn

SEQ ID NO: 412824 - DNA, 706 bp, Homo sapiens
  misc_feature: GZ8MTXP02JW0TR.9.25.C03.1.454.CMB.2.raw
  modified_base (236)..(236): a, c, t, g, unknown or other
  modified_base (273)..(273): a, c, t, g, unknown or other
tcagtgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagccaccctcggtgtcagtcggcccctaggaaacgacggccagcataacctgtgaggganacaacaattaaaacaatatgtgcatggacagcagacncaggccacggcccctgtcctggtcgtctttgatgatagtcgacccggcctgaggactcccgtggacgtcgtactttccgtcgtcggccctaccgaaacgttcggtacggggaaaccaccgggaccccaccccgtgaaccctagtccgacggggtccgggggtacggaacgggccgggggtagtcgggacggtcccgtaacgtttacgtttcgtcggtacgtacggtcgttgggttaggggtacttccgtacgtaagtaggtaaggttaggggttaacggggtagggggtaacgttccggttacgggggaccggggtaacggggtacccgaggggtaccgtacgggtaaccccgttaccgtaacggtcccgaaccggtaacccgaacggtcccgtacccggtcccccggtccgggtaccctaccggtttccccg

SEQ ID NO: 412825 - DNA, 741 bp, Homo sapiens
  misc_feature: GZ8MTXP02HGFT7.9.25.C03.1.454.CMB.2.raw
  modified_base (231)..(231): a, c, t, g, unknown or other
  modified_base (236)..(236): a, c, t, g, unknown or other
tcagtgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagccaccctcggtgtcagtggcccctggaaagcggcagcataacctgtgaggganacaanaattaaaacaaataatgtgcagttggtaccagcagaagccaggccaggcccctgtcctggtcgtctttgatgatagtcggaccggccctgagggtactcccgtgacggtcgtacttcctcgtacggtcctaccgtaaaccgtcgtacggggaaaccctaccggggaccccaacccccgttcggaacccctagttacccgggaaacgggggcccggggggttaaccgaaacgggggccccgggggaagttacggggaaccggggtacccgtaacgtttacttttccggtacggtccgaaggtccgttagggtcgggtactttcgtacgtagtgtaaggttggggttaaggggtagggggtaaacttcggggttcgggggaccggggtacggggaaccgtcgggtaccgttacggaaccccggttacgtaaacgggttccgaaacccgggaacccgtaacggttcccggacccggtcccccgtcgggttacccaccggtttcccccg

SEQ ID NO: 412826 - DNA, 660 bp, Homo sapiens
  misc_feature: GZ8MTXP02JMFGK.9.25.C03.1.454.CMB.2.raw
  modified_base (243)..(243): a, c, t, g, unknown or other
  modified_base (419)..(419): a, c, t, g, unknown or other
tcagtgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcacgcccaccctggtgtcaggtcggcccctaggaaacgaccggccagcaataaccgtgtggaaggganaacaaactaattaaaaacaaataatgtgactagttcggaaccagcaagaacgccgaaggccacggcccctgtcctggtctctttgatgataggtcggacccggccctcgagggtacctcccgtaggacgtcgtacttcctcgtacggtcctaccgaacgttcggacggggaaaccnccggaccctaccgtcgacctacgtccgaggggtaccgggggtacgaaacggggtccggggataccggggacgtcccgtaattcgtttccgtgtcgacgtcgtggtggtacttcgactagtgtaggttagggtaggggaggggtacttcgggtcggggacggaacggggaccgagggtcctaacggtacccgtacgtaacgccgacggcccgaggtccctccggccctcggtactccttccg

SEQ ID NO: 412827 - DNA, 565 bp, Homo sapiens
  misc_feature: GZ8MTXP02G5QI3.9.25.C03.1.454.CMB.2.raw
tcagtgatacgtctcacgaccggtgctcgatttagtagtgtagatttgggtttggggctgggcctaaggaagcagcactggtggtgcctcagccatggcctggaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggacagcagagccagccaggcccctgtcctggtcgtctttgatgataggtgacccggccctcgagggacttccccgtgagcgtattcctctggcctaccaacgtcgtcgggaaccacggcccaccgtcgaccagtccgacggcgggtacgaacggcggggatggaggccgacttagttctgtcgagcgtggtggtactctcgatgagtgggtaggtggggtactcggtcggcgggtacgggcgaggcgtacggaccgtctaacgtcgacgaaccgaaggccgtacgccccgtcgtacgacttccg

SEQ ID NO: 412828 - DNA, 503 bp, Homo sapiens
  misc_feature: GZ8MTXP02H8EJS.9.25.C03.1.454.CMB.2.raw
  modified_base (312)..(312): a, c, t, g, unknown or other
  modified_base (329)..(329): a, c, t, g, unknown or other
  modified_base (434)..(434): a, c, t, g, unknown or other
  modified_base (445)..(445): a, c, t, g, unknown or other
  modified_base (481)..(481): a, c, t, g, unknown or other
  modified_base (483)..(503): a, c, t, g, unknown or other
tcagtgatacgtctcacgaccggtgctcgatttagtagtgtagatttgggtttgggaacctatgaacattctgtcagtggcccctggaaagacggccagcataacctgtgagggagacaacattaaaaacaaataatgtgcattggtaccagcagaagccaggccaggcccctgtcctggtcgtctttgatgatagtgaccggccctgagggatccctgagcgattctctggctaccaaactcgtaggggaaccacggccacccctgaccatcaggcggggtcgaaggccggggatggacggccgatattcngtcagctggtggattcnctagtgagtgggtaggtaggggaatcgttcgggcggaggacccgaggctgaccgtctaagtcacgccaagcctcgccccctgacactctccgtcccgcccttacncagtacgtacncacgtcgacggccggcgtcggacgaaggccgatagngnnnnnnnnnnnnnnnnnnnnn

SEQ ID NO: 412829 - DNA, 544 bp, Homo sapiens
  misc_feature: GZ8MTXP01BEB8J.13.50.E06.1.454.CMB.2.raw
  modified_base (245)..(245): a, c, t, g, unknown or other
  modified_base (253)..(253): a, c, t, g, unknown or other
  modified_base (286)..(286): a, c, t, g, unknown or other
  modified_base (296)..(296): a, c, t, g, unknown or other
  modified_base (365)..(365): a, c, t, g, unknown or other
  modified_base (431)..(431): a, c, t, g, unknown or other
  modified_base (440)..(440): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctcccctcctcattctctgcacagtctctgtgacctcctatgaactgacacagccatcctcagtgtcagtgtctccgggacagacggccaggatcacctgctcaggaaatatctagaacaaaaaatntgctcggnggttccagcagagccaggccaggccccagtacnggtgatttanaaagcattgagcggccctgagggactccccctgagcgtatcctaccggctctaaattcgacgggaccanacgtcaccttgaccatcgacgggcccagacttgagatgagctagactagttattgtactcgtgcgntgacacctntcgtggtttcgggcgggggtaccttaagggttcgaccggttacggtcgggttacgcgttacccgaaggcctcgtcccccgtcggttcctaacgttccttaaccg

SEQ ID NO: 412830 - DNA, 558 bp, Homo sapiens
  misc_feature: GZ8MTXP01DGCU9.13.50.E06.1.454.CMB.2.raw
tcagtcacgtactacacgaccggtgctcgatttagatctactgacaacacacaagggggctgtaggctcaggaggcagagctctgaatgtctcaccatggcctggatccctctcctgctcccctcctcattctctgcacagtctctgtgacctcctatgaactgacacagccatcctcagtgtcagtgtctcgggacagacggccaggatcacctgctcaggaaatattctagaaacaaaaaaatatgctcggtggttccagcagaagccaggccaggccccagtactggtagtatttaataaaagactatttggagccggccctcgagggactcccccctggagcgtattccgtacccgggtcttctaaattcgaacggggacccacagtacacccttgacccagtccgaccggggcccaagattgagatgaggctgacttattattgttactcgtgcgctgaacacctagtcgttgggtttcgggcgggggtacttaggttcgacgttcgtgggttcgcgcccgaaggcctcgcccctggttcctcgttcgttccg

SEQ ID NO: 412831 - DNA, 633 bp, Homo sapiens
  misc_feature: GZ8MTXP01DHJ95.13.50.E06.1.454.CMB.2.raw
  modified_base (198)..(198): a, c, t, g, unknown or other
  modified_base (226)..(226): a, c, t, g, unknown or other
  modified_base (244)..(244): a, c, t, g, unknown or other
  modified_base (298)..(298): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctccccctctcattctctgcacagtctctgtgacctcctatgaactgacacagccatcctcagtgtcagtgtctcggganagacgccaggatcactgctcaagaaatntctagaaacaaaaaaatntgctcggtggtccagcagaagccaggccaggccccagtactggtagtatttaanaaagactattggagccggccctgagggactcccccgtagagcgtattccgtcccggtctctaaattcgaacgggacccaacacgtccaccttcgaaccacgtcccgaaccggggcccaggtagttgaaggtatgacggctaggtacttaagtttatttcggttacttcgtacgtcggtcttacggaaacctaaccgtagttccgtttcgggggttttccggggaaccggggggtaacccttaagggtttcggaccggttcgggttcggttccgacggacccggaagggtcccttcccggccccccgttgggttaccctccgttccgtttccccgg

SEQ ID NO: 412832 - DNA, 793 bp, Homo sapiens
  misc_feature: GZ8MTXP01D3FK2.13.50.E06.1.454.CMB.2.raw
  modified_base (179)..(179): a, c, t, g, unknown or other
  modified_base (198)..(198): a, c, t, g, unknown or other
  modified_base (219)..(219): a, c, t, g, unknown or other
tcagtcacgtactacacgaccggtgctcgatttagatctactgacaacacacaaggggggctgtaggctcaggaggcagagctctgaatgtctcaccatggcctggatccctctcctgcctccccctctcattctctgcacagtctctgtgacctctatgaactgacacagccatcctnagtgtcagtgtctcggganagacgcaggactcactgctanaaggtaaatattctaagaaactaaaaaaatgtgctcggtgtaccagcaagaacgccgaaggccacggacccctagtacgtagggtataatttaaagaaaacgtactagttaggacggtcccggtaccctacggagggaaccttccccccgaggaacgtcgtaactttccgtaacccggtacttaacggtaaacttaccgggaaacgggaaccccaacgtacgttaccctaacccgttacggaaccctaacgtacccgggaacccggggacccaaagggttaacgttagggaaggagttagggacggtcttaaggtaaccttttaagtttaagtttacggtttaacctcggttacggacccgggtataacggtaaaccctaaacccgtaggtttccgggtttacgggggttttaccggggggaacccggggggttaaaccttaaacggggtttccggaaaccccgggttggggttaccggggttaaccgacccgggttaaccccggaacggggtccccgttccccgggtccccccggttcgggttacccctcccgtttcccggtttccccccggg

SEQ ID NO: 412833 - DNA, 561 bp, Homo sapiens
  misc_feature: GZ8MTXP01BW5L0.13.50.E06.1.454.CMB.2.raw
  modified_base (229)..(229): a, c, t, g, unknown or other
  modified_base (246)..(246): a, c, t, g, unknown or other
  modified_base (298)..(298): a, c, t, g, unknown or other
tcagtcacgtactacacgaccggtgctcgatttagatctactgacaacacacaagggggctgtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatnttcagaacaaaaaaatntgctcggtggtccagcagaagccaggccaggccccagtactggtgatttaanaaagcattgagcggcctgagggactcccccgtggagcgtattccgtaccggctctaaagttcgagggacccacacgtccaccttgaccacgtccgaccggggccagtacgttgaggtatggacgctagtaacttagttatttggttactcgtcgacgctagaactacctagttcgtgggtttcgggaacgggggtacttaggttcgaccgtggtcgggttcgcgcccgaaggcctccgcccctggttctaaccgttcgtcccg

SEQ ID NO: 412834 - DNA, 680 bp, Homo sapiens
  misc_feature: GZ8MTXP01EQ7MW.13.50.E06.1.454.CMB.2.raw
  modified_base (180)..(180): a, c, t, g, unknown or other
  modified_base (200)..(200): a, c, t, g, unknown or other
  modified_base (252)..(252): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctccccctctcattctctgcacagtctctgtcgacctcctatgaactgacacagccatcctnagtgtcagtgtctccggganagacgcaggatcacctgctacaaggtaaatattactaagaaacaaaaaaatntagcgttcgggtgtaccagcaagaacgccaggccacggacccctagtactggtacgtaatttaaagaaagactagtttaggacggccggaccctacgagggtactcccccgtagacgtcgtacttccgtacccggtcttaacgtaaactcgaacgggaccaacgtagtcctaacttcgaaccagtcccggacccggggaccagtacgttaggaggtaactggacggtctacgtactttaagtttatttacggttactcgttcggccgtcttacgaacctaaaccgtcgtttcggttacggggttttccgggggaaccggggtaaacccgttaaggttcggttaaccggtcgggttcgggttaccgacggttacccgaagggtccttaacccggtccccccgtggttccctaacctttcccgttccccg

SEQ ID NO: 412835 - DNA, 550 bp, Homo sapiens
  misc_feature: GZ8MTXP01DLER8.13.50.E06.1.454.CMB.2.raw
  modified_base (406)..(406): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctccccctcctcattctctgcacagtctctgtgacctcctatgaactgacacagccatcctcagtgtcagtgtctccgggacagacggccaggatcacctgctcaggaatatctagaacaaaaaatatgctcggtggttccagcaagagccaggccaggccccagtactggtgtatttataaagcatttgagcggccctcgaggactccccctgagcgtattctcccggctctattcgagggtaccacaggtcaccttgaccagtcaccggggcccaagattggaggntcgagctagtactagtttattgttactctgcgctgaacctactatcgtgggtttcgggcgggggtaccttaaggttgacccggtggtcgggttacgcggttcccgaagggtcctccggccccctgggcctaaccttcgttcccg

SEQ ID NO: 412836 - DNA, 820 bp, Homo sapiens
  misc_feature: GZ8MTXP01D6INF.13.50.E06.1.454.CMB.2.raw
  modified_base (250)..(250): a, c, t, g, unknown or other
  modified_base (304)..(304): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctccccctctcattctctgcacagtctctgtgacctcctatgaactgacacagccatcctcagtgtcagtcgtctccgggacagacggccaggatcacctgctacaaggtaatattacagaaacaaaaaatntgctcggtgtcagcaagacgcaggccacggccccagtactggtagtaatttaanaaagactagtttcgacggccggtaccctacgaggggtacctcccccgtaggacgtcgtacttcccgtacccggtcttaacgtaaacgttaccggaacggggtaacccaacgtacggttaccctaacccgtttacggaacccctaacgttacccgggaaccccgggggtaccctaaagggtaacgtttagggaacgggtagttacgggaacgggtacgttacggtaaaccttttaggttttaacgtttcggtttaaacccttcgtacgggtcccggttaccgttaacggtaaaccctaaacccgttagtttcccggggttttacggggggtttttacccggggggaaccggggggttaaaccccttaaagggggttttcccggggaaacccgggtttccggggttaccgggggttaacccgaccggggttacccccgggtaaacggggtccccgtttaaccccgggtcccccccgttacggggttccccttaacccgtttccccgtttaacccccgg

SEQ ID NO: 412837 - DNA, 769 bp, Homo sapiens
  misc_feature: GZ8MTXP01DHQUH.13.50.E06.1.454.CMB.2.raw
  modified_base (258)..(258): a, c, t, g, unknown or other
  modified_base (579)..(579): a, c, t, g, unknown or other
tcagtcacgtactacacgaccggtgctcgatttagatctactgacaacacacaaggggggctgtaggctcaggaggcagagctctgaatgtctcaccatggcctggatccctctcctgcctccccctctcattctctgcacagtctctgtgacctcctatgaactgacacagccatcctcagtgtcagtcgtccgtcgggacagacggccaggatcacctgctacgaaggtaaatattactaagaaactaaaaaaatntcgacgtcggtagttaccagacgaagaacgccgacggccgacggaccccagtacgtaggttagtaaatttaacgtaaagactagtttaggaacggtcccggtaccctagacgggtacctcccccgaggtaacggctaccgttcccgtacccgggtacttaacgttaaacgttaccggaacgggtaaccccctagtaccggttaccctaacccgtttacgaacccgtacgtacccgggacccgggacctaggtaagtagggagagtacggaggacttagtaactttaaggtttacgtttacggttactacgtggtaccggtntaaccggtaaactccgttaacgttcggggtttaccggggttcgggggtaaccggggtaaaccgttacggggttaccggttacccgggttacggggttcggttaacccggccgggacccccggtaaaggtcccgtaaccccggttcccccggtcgggttaccctaacccgttccccggttttaaccccccg

SEQ ID NO: 412838 - DNA, 729 bp, Homo sapiens
  misc_feature: GZ8MTXP01C646P.13.50.E06.1.454.CMB.2.raw
  modified_base (260)..(260): a, c, t, g, unknown or other
  modified_base (323)..(323): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctccccctcctcattctctgcacagtctctgtgacctcctatgaactgacacagccatcctcagtgtcagtgtcgtccgggacaggacggccaggactccacctgctacgaaggtaaattattctaagaaactaaaaaaatntgcgtcggtggtaccagacaagacgccgacggccacggccccagtacgtggtagtaatttaanaaagactagttggacggtccggccctacggagggtactcccccgtaggacgtccgtacttcccgtacccggtcttaacgtaaacgttccgaaacgggaccctacgtacgtacctacccgttacgaccctacgtacccgggacccggggaccctaagggtaagttacgggaaggtagtacgggacgtacctaggtaacctttaagttttacgtttacgttaacctcgtcggtccggtacttacggaaacctaaccgttacgttccgggttacgggggttttacccgggggaaccgggggtaaccttaaggggttccggaccgggttcgggtcgggttaccgacggttaccccggtaagggtcccgtccggtacccccggtcggttacctaacccgttccgttccccg

SEQ ID NO: 412839 - DNA, 719 bp, Homo sapiens
  misc_feature: GZ8MTXP01DQBO0.13.50.E06.1.454.CMB.2.raw
  modified_base (248)..(248): a, c, t, g, unknown or other
  modified_base (295)..(295): a, c, t, g, unknown or other
  modified_base (304)..(304): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctccccctcctcattctctgcacagtctctgtgacctcctatgaactgacacagccatcctcagtgtcagtgtctccgggacagacgccaggatcacctgctacgaggaaatattctagaacaaaaaatntgctcggtggtccagcagaacgccaggccacggccccagtactggtntaatttaanaaagacagtttgacgccggccctcgagggactcccccgtgagtcgtattccgtacccggtcttcgtaaacgttccgaacggggtacccaacgtacggtacctacctttacggaaccctaacgtacccggaaccccgggggtacccctaaagggtaaacgtttcgggaagggtacgtcggaacggtctaacgttaaccgtttaattttaacgtttcgtttaacctcgtttacggccgtcgttacgaaaacccgtaacccgttagtttccgggtttcgggtttttcccgggggaaccggggggttaaaccttaaaggggtttcggttacccgggtttacgggtcgggttaccgcggttaccccgaacgggtccctcccggtcccccgtcggttccgtaacccgttccgttttccccg

SEQ ID NO: 412840 - DNA, 739 bp, Homo sapiens
  misc_feature: GZ8MTXP01CLQA2.13.50.E06.1.454.CMB.2.raw
  modified_base (234)..(234): a, c, t, g, unknown or other
  modified_base (255)..(255): a, c, t, g, unknown or other
  modified_base (312)..(312): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctccccctcctcattctctgcacagtctctgtgacctcctattaactgacacagccatcctcagtgtcagtgtctccgggacagacggcaggatcacctgctacgaaggtaaattnttactagaaaacaaaaaaatntagctcggtgtccagcaagaagccgaggccacggccccagtacgtggtatatttaanaaagactagttggacgccggtaccctcgagggactcccgtaggacgcgtacttcccgaccggtacttacttaagtccgaaacgggaccctacgacgtaccaccttacgaccctacgtacccggacccgggggcccaaggttacgttagggaacgggtatacgggacgtaccgttaggtaaacctttattttaaggtttacggtttaacctcgttcgggtccggtactacggtaaacctaaacccgtaggtttccggtttaccgggggtttacgggggtcccggggggaaactttaacggggtttaccggtacccgggttcgggttaacgggggtccgaaccgggttaccccggttaacgggtccccgttcccggccccccgttcgggttcccttacccgtttcccggtttaacccgttaaccccccg

SEQ ID NO: 412841 - DNA, 706 bp, Homo sapiens
  misc_feature: GZ8MTXP01AW1R1.13.50.E06.1.454.CMB.2.raw
  modified_base (228)..(228): a, c, t, g, unknown or other
  modified_base (242)..(242): a, c, t, g, unknown or other
  modified_base (249)..(249): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctccccctcctcattctctgcacagtctctgtgacctcctatgaactgacacagccatcctcagtgtcagtgtcgtccgggacagacggcaggatcactgctcagtaatntcagaacaaaaatntgctggngtcagcagacgcaggccacgccccagtactggtagtattaataaagactagttgacggccggtccctacgaggggactccccccgaggacgtcgtacttccgtaccgggacttcgtaaagtttcccggaaacggggtaccccacgtacggtacctaacccgtttacgaacccctacggttaccccggaaccccgggggtacccctaaagggtacgtttacggggaacgggtagttacgggaacggtcgtacgttaaacgttaaggtttagtttacggtttaacctcgttcgacgggtcctaggtaacccaaaccgttgttccggtttcggggttttaccgggggaaccgggggttaaccttaacggggtttcggaccggttcgggtcgggttacgttcggacccgaacgggtcccgtcccggcccccgttcgggttcctaaccgttccgtttccccg

SEQ ID NO: 412842 - DNA, 805 bp, Homo sapiens
  misc_feature: GZ8MTXP01APTUF.13.50.E06.1.454.CMB.2.raw
  modified_base (201)..(201): a, c, t, g, unknown or other
  modified_base (223)..(223): a, c, t, g, unknown or other
  modified_base (251)..(251): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctccccctctcattctctgcacagtctctgtcgacctcctatgaactgacacagccatcctcagtgtcagtcgtctccggganagacggcaggatcacctgctanaaggtaatattctaagaaacaaaaaatntgctcggtgtccagcaagaacgccacggccacggcccagtactggtagtaatttaagaaagactagttcggacggccggccctagacgggtactcccccgtaggacgcgtacttccgtaccggacttaacgtaaatccggaacgggaaccctacgtacggttaccctaacccgttacgaacccgtaacgttaccccgggaaccccggggggtacccctaagggtaaacggtttacgggaacggggtaacgttaggggaaaccggggtaccttaacgggttaaacccgtttttaaacgttttaaggttttacggtttaacccgttaccggttaacggggtcccgggttaccttaaacggtaaaaccccgttaaaccgtaacgggttttccgggttttaccggggggttttaccgggggaaccggggggttaaaccccttaaagggggtttcccggaaccgggttcgggttacggggttaccgaccgggttaccccgaacgggtcccgttccccggtccccccgttagggttccctaacccgttccgtttcccccg

SEQ ID NO: 412843 - DNA, 630 bp, Homo sapiens
  misc_feature: GZ8MTXP01CFB1W.13.50.E06.1.454.CMB.2.raw
  modified_base (200)..(200): a, c, t, g, unknown or other
  modified_base (234)..(234): a, c, t, g, unknown or other
  modified_base (253)..(253): a, c, t, g, unknown or other
  modified_base (305)..(305): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctccccctcctcattctctgcacagtctctgtgacctcctatgaactgacacagccatcctcagtgtcagtgtctccggganagacggccaggactcacctgctacgaggtaaatnttactagaaacaaaaaatntgctggtgtcagcagagccaggccaggccccagtacgtggtagtaatttaanaaagactagttgacgccggcctagaggactcccccgtagacgcgtacttccgtacccggtcttaactaacgttcgaacggggtacccacgacgtcctaccgttacgacctacgtcccggacccggggccaaggtagttacgggaggtatggaggtctagtaactttaagtttagtttcgttactcgtaggccgtctacggaacctaacgtacgttcggttcgggtttcggggaaccgggggtacttagggttcgacggttcggtcggttacgcgttccggaaggtccgtccggaccccgtcggttacctccgttccgttccccgg

SEQ ID NO: 412844 - DNA, 581 bp, Homo sapiens
  misc_feature: GZ8MTXP01BGU1W.13.50.E06.1.454.CMB.2.raw
  modified_base (245)..(245): a, c, t, g, unknown or other
  modified_base (253)..(253): a, c, t, g, unknown or other
  modified_base (300)..(300): a, c, t, g, unknown or other
  modified_base (332)..(332): a, c, t, g, unknown or other
  modified_base (339)..(339): a, c, t, g, unknown or other
tcagtcacgtactacacgaccggtgctcgatttagatctactgacaacacacaagggggctgtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaaggaatatctagaacaaaaaatntgctcggnggttccagcagaagccaggccaggccccagtactgggtactattaanaaagacattgagcgcctgagggactcccccgngagcgtntcgtacgtctctatcgacgacactactctactcgacacgtaccgaccgggccagtagtgaggagagagctagtacttagttattacgttactcgtcgcgtcgtacgaacctacgtgttcggttacggggtttccggggaacggggtaacgttacgggtcggttacgggtcgggtcggttccgaccgacccggaacggtcccgtcccggtccccgttacgttccgtcccgttcccgttccccg

SEQ ID NO: 412845 - DNA, 612 bp, Homo sapiens
  misc_feature: GZ8MTXP01AC5C6.13.50.E06.1.454.CMB.2.raw
  modified_base (228)..(228): a, c, t, g, unknown or other
  modified_base (246)..(246): a, c, t, g, unknown or other
  modified_base (303)..(303): a, c, t, g, unknown or other
tcagtcacgtactacacgaccggtgctcgatttagatctactgacaacacacaagggggctgtaggctcaggaggcagagctctgaatgtctcaccatggcctggatccctctcctgctccccctcctcattctctgcacagtctctgtgacctcctatgaactgacacagccatcctcagtgtcagtgtctccgggacagacgccaggatcacctgctcaggaaatnttcagaaacaaaaaaatntgctcggtgttccagcagaacgccaggccacggccccagtacgtggtagtatttaanaaagctattggacgcggccctgagggactcccccgtagagtcgtactcgtccggactcttaagtcgagggtaccacgacgtcaccttcgacccagtaccgaccggggtacccaagtacgttggaaggagtaggacggtactagtacttagtttattcggttactcgtcggccggtctacggaacctaacgtgttacggttcgggtttacggggcgggggtaacttaaggttcggaaccgttcggtcgggttaccgcggacccgtaaggccgtccgtcccccggtcggttcctaacccgttcgttccccg

SEQ ID NO: 412846 - DNA, 511 bp, Homo sapiens
  misc_feature: GZ8MTXP02GHD0S.13.50.E06.1.454.CMB.2.raw
  modified_base (245)..(245): a, c, t, g, unknown or other
  modified_base (420)..(420): a, c, t, g, unknown or other
tcagtcacgtactacacgaccggtgctcgatttagatctactgacaacacacaagggggctgtaggctcaggaggcagagctctgaatgtctcaccatggcctggatccctctcctgctcccctcctcattctctgcacagtctctgtgacctcctatgaactgacacagccatcctcagtgtcagtgtctccgggacagacggccaggatcacctgctcaggaaatattctgaacaaaaaaatntagctcggtggttccagcagaagccaggccaggccccagtactgtgattataagacattgagcgcctcagggatccccctgagcgattctccggcttctaattcagggaccacagtcaccttgaccatcgaccgggccagactgagatgagctgactattattgtactctgcggntcgacaactagtcgtggtttcggcgggggacctaagttcggaccggtcgtcggggtcacggcccaaggctcgccccctggccacgtctccg

SEQ ID NO: 412847 - DNA, 509 bp, Homo sapiens
  misc_feature: GZ8MTXP02HBC5K.13.50.E06.1.454.CMB.2.raw
  modified_base (244)..(244): a, c, t, g, unknown or other
  modified_base (316)..(316): a, c, t, g, unknown or other
tcagtcacgtactacacgaccggtgctcgatttagatctactgacaacacacaaggggctgtaggctcaggaggcagagctctgaatgtctcaccatggcctggatccctctcctgctcccctcctcattctctgcacagtctctgtgacctcctatgaactgacacagccatcctcagtgtcagtgtctccgggacagacggccaggatcacctgctcaggaaatattctagaacaaaaaatntagctcggtggttccagcagaagccaggccaggccccagtactggtgatttataaagacattgagcggcctnagggatccccctgagcgattctccggctctaattcagggaccacagtcaccttgaccatccgaccggggcccagattgagatgagctgacttagttattgttactcgtgcgctgacaaccatcgttgggtttcggcgggggaccaggttcgaccgtcggtggtcagccgaaggctcgcccctcggcactctcg

SEQ ID NO: 412848 - DNA, 526 bp, Homo sapiens
  misc_feature: GZ8MTXP02G1ZZ0.13.50.E06.1.454.CMB.2.raw
  modified_base (228)..(228): a, c, t, g, unknown or other
  modified_base (246)..(246): a, c, t, g, unknown or other
  modified_base (317)..(317): a, c, t, g, unknown or other
  modified_base (337)..(337): a, c, t, g, unknown or other
  modified_base (342)..(342): a, c, t, g, unknown or other
  modified_base (421)..(421): a, c, t, g, unknown or other
tcagtcacgtactacacgaccggtgctcgatttagatctactgacaacacacaagggggctgtaggctcaggaggcagagctctgaatgtctcaccatggcctggatccctctcctgctcccctcctcattctctgcacagtctctgtgacctcctatgaactgacacagccatcctcagtgtcagtgtctccgggacagacggccaggatcacctgctcaggaaatnttctagaacaaaaaaatntgctcggtggttccagcagaagccaggccaggccccagtactggtgattaataaagacattgagcggcctnaggatcccctgagcgattcnccggntctattcacgggaccacagtcaccttgaccatcaccggggcccagatgagatgagctgactatattgtactcgtagcgntgacaaccatcgtggtttcggcgggggtacctaaggttcgaccgttcggtcgggtacaggaccccgaaaggcctccggacccccgtcggtccaccgtcttccccg

SEQ ID NO: 412849 - DNA, 531 bp, Homo sapiens
  misc_feature: GZ8MTXP02FVPDZ.13.50.E06.1.454.CMB.2.raw
  modified_base (246)..(246): a, c, t, g, unknown or other
  modified_base (458)..(458): a, c, t, g, unknown or other
  modified_base (501)..(501): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctcccctcctcattctctgcacagtctctgtgacctcctatgaactgacacagccatcctcagtgtcagtgtctccgggacagacggccaggatcacctgctcaggaatattctagaaacaaaaaatntgctcggtgttccagcagaagccaggccaggccccagtacgtggtagtatttaataaagacattgagccggccctgagggactcccccgtgacgcgtacttcgcccggcttctaattcgaagggacccactagtaccaccgttgaccactcccgacccggggcccagtactggaagagtggagctagtacttattattgttactcgtgccgntgactacatcgtggttcggcgggactagtcgacgtcgtgtacncgaccaagcctcgccccgtgctactctccg

SEQ ID NO: 412850 - DNA, 526 bp, Homo sapiens
  misc_feature: GZ8MTXP02F6U86.13.50.E06.1.454.CMB.2.raw
  modified_base (198)..(198): a, c, t, g, unknown or other
  modified_base (226)..(226): a, c, t, g, unknown or other
  modified_base (243)..(243): a, c, t, g, unknown or other
  modified_base (442)..(442): a, c, t, g, unknown or other
  modified_base (450)..(450): a, c, t, g, unknown or other
tcagtcacgtactacacgaccggtgctcgatttagatctactgacaacacacaagggggctgtaggctcaggaggcagagctctgaatgtctcaccatggcctggatccctctcctgctcccctcctcattctctgcacagtctctgtgacctcctatgaactgacacagccatcctcagtgtcagtgtctccggganagacggccaggatcactgctcaggaatnttctagaacaaaaaatntgctcggtgtccagcagaagcagccaggccccagtactggtgattataaagacattgagccggcctcgagggactcccccgtgacgcgtacttccgtcccggcttctaaacttcgaaggggacccacagtccaccttgacccatccgacccggggcccagatgaggatgagctagactattattgttactcgtgccggntgacaacntcgttggtttcggcgggggaccaaggttcgaccggtgtgggtcacgcccgaaggctcgcccctggtcactcgtccg

SEQ ID NO: 412851 - DNA, 775 bp, Homo sapiens
  misc_feature: GZ8MTXP02IZ632.13.50.E06.1.454.CMB.2.raw
  modified_base (199)..(199): a, c, t, g, unknown or other
  modified_base (247)..(247): a, c, t, g, unknown or other
  modified_base (302)..(302): a, c, t, g, unknown or other
tcagtcacgtactacacgaccggtgctcgatttagatctactgacaacacacaagggggctgtaggctcaggaggcagagctctgaatgtctcaccatggcctggatccctctcctgctccccctcctcattctctgcacagtctctgtgacctcctatgaactgacacagccatcctcagtgtcagtgtctccggganagacggccaggatcacctgctcaggaaatattctagaacaaaaaaatntgctcggtgttccagcagaagccaggccaggccccagtacgtggtgtaatttaanaaagactattgacgccggccctcgagggactccccctggacgacgtacttccgtcccggtcttacgttaacttacggaaccggggtaacccacgtaacggttccctaacccgtttacgaaccctacgttacccggaaccccgggggccccaaagttacgttacgggaaagggtagttagggaacgggtccttaaggtaacctttaaagttttaacgtttaggttttaacccttcggttaaccgggcccgggtaccttaacgggaaaaccctaaaaccgtacgtttaccgggtttacgggggtttttcccgggggaaccgggggggttaaaacccttaaagggggtttccgggttaaaccccgggttcgggggtttacggggtaccaaaccgggtacccccggtaaacgggtcccgttaccccggtaccccccggttccgggtaacccttacccgtttaccgttttccccccgg

SEQ ID NO: 412852 - DNA, 511 bp, Homo sapiens
  misc_feature: GZ8MTXP02IP3WI.13.50.E06.1.454.CMB.2.raw
  modified_base (311)..(311): a, c, t, g, unknown or other
  modified_base (406)..(406): a, c, t, g, unknown or other
  modified_base (419)..(419): a, c, t, g, unknown or other
tcagtcacgtactacacgaccggtgctcgatttagatctactgacaacacacaaggggctgtaggctcaggaggcagagctctgaatgtctcaccatggcctggatccctctcctgctcccctcctcattctctgcacagtctctgtgacctcctatgaactgacacagccatcctcagtgtcagtgtctccgggacagacggccaggatcacctgctcaggaaatattctgaacaaaaaaatatagctcggtggttccagcagaagccaggcccaggccccagtactggtgatttataaaagacattgancggccctcagggatccccctgagcgattctcggctctaattcagggaccacagtcaccttgaccatcaccgggcccgacgattgagagtagaggngtagatattattnttactctgcgcgtgacaacatcgtgttcggtcggggtacgagtcgtacgtcgtcggtcgacgacgaacgcgtcgcccgtccgtcgtctctcg

SEQ ID NO: 412853 - DNA, 589 bp, Homo sapiens
  misc_feature: GZ8MTXP02HV2WX.13.50.E06.1.454.CMB.2.raw
  modified_base (231)..(231): a, c, t, g, unknown or other
  modified_base (249)..(249): a, c, t, g, unknown or other
  modified_base (375)..(375): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctccccctcctcattctctgcacagtctctgtgacctcctatgaactgacacagccatcctcagtgtcagtgtctccgggacaggacggccaggatcacctgctcaggaaatnttctagaacaaaaaaatntgctcggtggttccagcagaagccaggccaggccccagtctggtgatttataaagactattgagccggccctacgagggactcccccgtgagcgtacttcgtccggctctaattcgagggacccanacgtcctaccttcgaacccagtcccgacccgggggcccaagtacttggaggatggaggctagacttatttagtttgttactcgtgacggctagaaccaacctgtcgttgggtttcggggacgggggtactaaggttcgaccggttcggtcgggtaccgacggacccgaaggtcccgtaccggtccccccgtggtaccctaccgttccgttcccg

SEQ ID NO: 412854 - DNA, 576 bp, Homo sapiens
  misc_feature: GZ8MTXP02ISDPK.13.50.E06.1.454.CMB.2.raw
  modified_base (249)..(249): a, c, t, g, unknown or other
  modified_base (305)..(305): a, c, t, g, unknown or other
  modified_base (468)..(468): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctcccctcctcattctctgcacagtctctgtgacctcctatgaactgacacagccatcctcagtgtcagtgtctccgggacagacggccaggatcacctgctcaaggaaatattctagaaacaaaaaaatntgctcggtggttccagcagaagccaggccacggccccagtacgtggtgtaatttanaaagactagttgagccggcctgaggactcccccgtgagcgtattctccggtctcttaattcgacggggacccacgacgtcacccttgaccatcgacccggggcccagtacttggaggatggagctgacttattatttgttactcgtgcggtctagacaaacgnttacgttgggtttcggggacgggggtacctaggttcggtaccggttcggttcggggtaccacggtacccgaaggtccctcggccccctggtcctaccgtcgtttcccg

SEQ ID NO: 412855 - DNA, 834 bp, Homo sapiens
  misc_feature: GZ8MTXP02GFXO0.13.50.E06.1.454.CMB.2.raw
  modified_base (227)..(227): a, c, t, g, unknown or other
  modified_base (241)..(241): a, c, t, g, unknown or other
  modified_base (279)..(279): a, c, t, g, unknown or other
  modified_base (285)..(285): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctcccctcctcattctctgcacagtctctgtgacctcctatgaactgacacagccatcctcagtgtcagtgtctccgggacagacggccaggatcacctgctcagaatntcagaacaaaaatntgctcggtgtcagcagagcagcaggcccagtactggtntattanaaagacattgagcggcctagagggtactcccccgtagacgcgtacttccgtcccggcttccgtaaacgttccgaacggggtacccaacgacgttcctaacccgtttacgaaaccctaacgttacccggaaaccccggggggaccccctaaagggtaacgtttacggggaaacggggtaacgttaggggaaacggggtccttaagggtaaacccgtttaaagttttaaacggttttacggtttaaacccttcgggtttaccgggacccggggttaacctttaacggggaaaacccctaaaaccgttaacggtttacccgggttttacggggggttttttaaccccggggggaaccgggggggggtttaaaacccccttaaaagggggtttttacccggggaacccccggggtttaacggggttacccggggggttaaccctaacccgggggtaaccccccgaaaagggggttcccccgttacccggggttacccccccccggttcgggggtttaaccctaccccgggttttacccgttttccccccgggg

SEQ ID NO: 412856 - DNA, 752 bp, Homo sapiens
  misc_feature: GZ8MTXP02IXMGJ.13.50.E06.1.454.CMB.2.raw
  modified_base (227)..(227): a, c, t, g, unknown or other
  modified_base (244)..(244): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctcccctctcattctctgcacagtctctgtgacctcctatgaactgacacagccatcctcagtgtcagtgtctccgggacagacggccaggatcactgctcaggaaatnttctagaacaaaaaatntgctcggtgtccagcagacgcacggccaggccccagtactggtagtaatttaataaaagactattgagccggccctagagggactcccccgtagagcgtattcctcccggtactcgttaacttcgaacggggacccaacgtacgtcctaacccttgaaccctacgtcccggaacccggggaccctaaagtacgtttacggaagggtagttacgggaggtaccttaggtaaacctttaaagtttacgtttttacggttaaccttaccggttacgggtcccgggtaccttaacggaaaccctaaacccgttaacgtttacccgggtttacgggggtttttaccccgggggaccgggggggttaaaacccttaaaagggggtttcccgggtaaacccgggttcggggtttaccgggggtacccgtaaccggtacccccggaaacggggtccccgttacccgggtcccccccggtttacgggtcccgtaacccctttcccggtttcccccgg

SEQ ID NO: 412857 - DNA, 609 bp, Homo sapiens
  misc_feature: GZ8MTXP02JHDDQ.13.50.E06.1.454.CMB.2.raw
  modified_base (229)..(229): a, c, t, g, unknown or other
  modified_base (244)..(244): a, c, t, g, unknown or other
  modified_base (295)..(295): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctccccctcctcattctctgcacagtctctgtgacctcctatgaactgacacagccatcctcagtgtcagtgtctccgggacagacggccaggatcacctgctcaggaatntcagaacaaaaaatngctcggtgtccagcagaagccaggccaggccccagtactggtgtaatttanaaagactattgagccgcctgacggctcccccgtgacgcgtattccgtccgtcttctaagttcgacgggacccacgtacgtaccctaccttacgaccctaacgtacccggacccggggacccaggtattacggaggagtgacggtctagtacgttatttacgttcgttacttcgtgccggtctacggaccaacgtagttcggttaggggtttaccgggcgggggtaacctaaggttccggaccggttcggtacgggtaccacggacccgaaggtccctcccggacccccgtcggtacctaccgttcgttcccccg

SEQ ID NO: 412858 - DNA, 661 bp, Homo sapiens
  misc_feature: GZ8MTXP02IQR2N.13.50.E06.1.454.CMB.2.raw
  modified_base (228)..(228): a, c, t, g, unknown or other
  modified_base (245)..(245): a, c, t, g, unknown or other
  modified_base (291)..(291): a, c, t, g, unknown or other
  modified_base (331)..(331): a, c, t, g, unknown or other
tcagtcacgtactacacgaccggtgctcgatttagatctactgacaacacacaagggggctgtaggctcaggaggcagagctctgaatgtctcaccatggcctggatccctctcctgctcccctcctcattctctgcacagtctctgtgacctcctatgaactgacacagccatcctcagtgtcagtgtctccgggacagacggccaggatcacctgctcaggaaatnttctagaacaaaaaatntgctcggtggtccagcagagcaggccagcccagtactggtgattanaaagcattgagcggcctgaggactccccgtgagcgattcnccggctctaattcgacggaccactacgtcctaccttacgacctaacgtcccgaacccgggggcccaagtacgttcggaagggtagtggacggtcgtaggtaaccttaagtttacgtttgttacgtcgttacggcggtccgtacgaacctaaacctagttccggtttacggggttttacccggggacgggggttaaaccccttaaagggtttcccggtaaacccgggttccgggtttcggggtaacccgtaccggggaccccgtaaacggggtccctaccgggtaccccccccggttagggttcccctaaccggtttcccgtttccccggg

SEQ ID NO: 412859 - DNA, 739 bp, Homo sapiens
  misc_feature: GZ8MTXP02IGOLM.13.50.E06.1.454.CMB.2.raw
  modified_base (227)..(227): a, c, t, g, unknown or other
  modified_base (240)..(240): a, c, t, g, unknown or other
  modified_base (246)..(246): a, c, t, g, unknown or other
  modified_base (290)..(290): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctccccctcctcattctctgcacagtctctgtgacctcctattaactgacacagccatcctcagtgtcagtgtctccgggacagacggccaggatcactgctcagaatntcagaacaaaatngctcgngtcagcagagcaggccacggccccagtactggtagtaatttaanaaagactagttggacggccggccctacgaggggtactcccgtagacgtccgtacttccgtaccggtcttacttaacgtcgaacggggtaccccaacgtaccgttcctaaccgtttacggaaccctaacgtccccggaaacccgggggccccaaggtaacgtttacgggaaagggtacgtagggaacgggtacctaggtaaaccgtttaattttacgtttacgttttaaccgtccgtttcgggaaccggttccgtaacgtaaccctaaaccgtaacgtttccgggtttacgggggttttaccgggggaccggggggttaacctaaaaggggtttccggaacccggttcgggtacggggttacccgacgggtacccccgtaaaggggtccccgttccccgggtcccccgttacggggtaccttacccttccgtttacccggttaacccccc

SEQ ID NO: 412860 - DNA, 515 bp, Homo sapiens
  misc_feature: GZ8MTXP02G4JP2.13.50.E06.1.454.CMB.2.raw
  modified_base (198)..(198): a, c, t, g, unknown or other
  modified_base (225)..(225): a, c, t, g, unknown or other
  modified_base (240)..(240): a, c, t, g, unknown or other
  modified_base (277)..(277): a, c, t, g, unknown or other
  modified_base (285)..(285): a, c, t, g, unknown or other
  modified_base (347)..(347): a, c, t, g, unknown or other
  modified_base (415)..(415): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctcccctctcattctctgcacagtctctgtgacctcctatgaactgacacagccatcctcagtgtcagtgtctccggganagacggccaggatcactgctcagaatntcagaacaaaaaatntgctcggtgtccagcagaagcagccagccccagtacngtgattanaagacatgagcgcctgaggctccccgtgagcgacttcgccggctctaattcgacgggaccanacgtcaccttgaccatccgacccgggccagtactgagatgagctagacttattattgtactcgagcgntacgaacacgtatcggtggtttcgggacggggtacctaaggtcgacggtcggtcggtacacgaccgaagcctccgtccccgtgtcctaccgtcttacccg

SEQ ID NO: 412861 - DNA, 781 bp, Homo sapiens
  misc_feature: GZ8MTXP02IPT3R.13.50.E06.1.454.CMB.2.raw
  modified_base (234)..(234): a, c, t, g, unknown or other
  modified_base (252)..(252): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctccccctcctcattctctgcacagtctctgtgacctcctatgaactgacacagccatcctcagtgtcagtgtctccgggacaggacggccaggatcacctgctacgaggtaaatnttctagaaacaaaaaatntgctcggtgttccagcaagacgcaggccacggccccagtacgtggtagtatttaagaaagactagttggaggcccggaccctgaagggtactcccccgtagacgtcgtaactttcccgtacccggtacttccgtttaaattcccggaaacgggggtaaccccctaacgtaacggttaccctaacccgtttacggaaaccctaacgttacccgggaaacccccgggggtccctaaagggtaacgtttaccggggaaaggtacgttagggaacggtcttaaaggttaacctttaagtttaaacgtttcgtttaaccgttcgtacgggtccggtcctacggtaaacctaaaacgttcgtttaccgggtttacgggggttttcccgggggaaccggggggtaacctttaaaggggttaccggggtacccgggttcgggtttcggggtaacccgaccggtaccccgtaaagggtccccgttaacccggtcccccccggttagggtacccctaccggtttcccggtttcccccgg

SEQ ID NO: 412862 - DNA, 777 bp, Homo sapiens
  misc_feature: GZ8MTXP02J0YLP.13.50.E06.1.454.CMB.2.raw
  modified_base (229)..(229): a, c, t, g, unknown or other
  modified_base (246)..(246): a, c, t, g, unknown or other
tcagtcacgtactacacgaccggtgctcgatttagatctactgacaacacacaagggggctgtaggctcaggaggcagagctctgaatgtctcaccatggcctggatccctctcctgctcccctcctcattctctgcacagtctctgtgacctcctatgaactgacacagccatcctcagtgtcagtgtctccgggacagacggccaggatcacctgctcaaggaaatnttctagaacaaaaaatntgctcggtgtccagcagagccaggccaggccccagtacgtggtgtatttaataaagacagttgacgccggcctcgagggactcccccgtgacgtcgtacttccgtcccggtcttccgtaaagtttccgaacggggtaacccaaccgtaacggtaccctaaacccgtttcggaaacccctacgttaccccgggaacccccgggggtaccccaagggtacgtttacgggaaggggtacgttaggggacggtccgttaacgggttaacctttaaggttttaactttagggttttaaccttccggttagggtcccggtacgtttaacgggaaaccctaaaccgttacgtttccgggtttcgggggttttaccgggggacccgggggggtaaacccttaaaggggttcccgggtaacccgggttcggggttaccggggttacccgtaaccggggacccccggtaaacggggccccgtttcccggggtcccccccggttccgggtttacccgtacccgttacccggttttcccccgg

SEQ ID NO: 412863 - DNA, 577 bp, Homo sapiens
  misc_feature: GZ8MTXP02I7CMM.13.50.E06.1.454.CMB.2.raw
  modified_base (229)..(229): a, c, t, g, unknown or other
  modified_base (245)..(245): a, c, t, g, unknown or other
  modified_base (288)..(288): a, c, t, g, unknown or other
  modified_base (294)..(294): a, c, t, g, unknown or other
  modified_base (373)..(373): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctcccctcctcattctctgcacagtctctgtgacctcctatgaactgacacagccatcctcagtgtcagtgtcctccgggacagacggccaggatcacctgctcaggaatnttctagaacaaaaatntgctcggtgtccagcagaagcagccaggccccagtactggtanatttanaaagactattggacgccggtccctgacgggtctcccccgtgacgcgtattcgtccggtctctaattcgaacgggaccanacgtccaccttcgacctacgtccgacccgggccagtattcggaaggatggacgctagacttagtttacttgttactgtcgcggtctggaaccacgtattcgttagggtttcgggacgggggtacctagggttcggaccggttacggtcggtacgacgacccgtaaggccgtccggcccccgtaggtcctaccgttcgttacccg

SEQ ID NO: 412864 - DNA, 709 bp, Homo sapiens
  misc_feature: GZ8MTXP02FQOP3.13.50.E06.1.454.CMB.2.raw
  modified_base (247)..(247): a, c, t, g, unknown or other
tcagtcacgtactacacgaccggtgctcgatttagatctactgacaacacacaagggggctgtaggctcaggaggcagagctctgaatgtctcaccatggcctggatccctctcctgctccccctcctcattctctgcacagtctctgtgacctcctatgaactgacacagccatcctcagtgtcagtgtctcgggacagacggcaggatcacctgctacaggaaatattctagaaacaaaaaaatntagctcggtgttccagcagaagccaggccaggccccagtactggtagtatttaataaagactattcggagtccggcctgaaggggtactccccccgtaggaacgtcggtactttcccgtccgggacttcgtaaattccgaaacgggggaacccactaggtcccacttacggaaccctaacgttcccggaacccgggggccctaaggtacgttacggaagggaattgggaaacgtccgttaaggtaacctttaaagttttaagtttcggtttaaccttccgttggggacccggttactaggtaacctaaacccgtgtttacggtttacgggggttttcccgggggacggggggttaccctaaaagggttccggtaaacccggtccgttaggggtaccacggttaccccggaaacggttccgtacccgtcccccgttcggttaccctaccgttcccgttcccgg

SEQ ID NO: 412865 - DNA, 713 bp, Homo sapiens
  misc_feature: GZ8MTXP02IFOY0.13.50.E06.1.454.CMB.2.raw
  modified_base (198)..(198): a, c, t, g, unknown or other
  modified_base (219)..(219): a, c, t, g, unknown or other
  modified_base (229)..(229): a, c, t, g, unknown or other
  modified_base (245)..(245): a, c, t, g, unknown or other
  modified_base (290)..(290): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctcccctctcattctctgcacagtctctgtgacctcctatgaactgacacagccatcctcagtgtcagtgtctccggganagacggcaggatcactgctanaaggaaattntcagaaacaaaaaatntgctcggtgttccagacagaagccaggccaggccccagtactggngtaatttataaagacattgagcggcctgagggatcccccgtgacgcgtattcgaccggtcttctaacttcgaacggtacccaacgtacgtaccctaccttacgacccaagtacccgacccgggggacccagtacgttaggaacggactgggacggtctaggtaacctttaagtttagtttacggttaccttcggtcggtccggtacccgtttacggaaccctaaacccgttaacgtttccggtttacgggggtttttaacccgggggacccggggggtaaacccttaaaacggggtttccggtaaaccccgggtttccgggttacgggggttaccctaaaccggggacccccgtaaacgggtcccgttaccccggtaccccccggttacggttcccgtaacccgtttcccggtttacccccgg

SEQ ID NO: 412866 - DNA, 776 bp, Homo sapiens
  misc_feature: GZ8MTXP02JI43B.13.50.E06.1.454.CMB.2.raw
  modified_base (236)..(236): a, c, t, g, unknown or other
  modified_base (253)..(253): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctccccctcctcattctctgcacagtctctgtgacctcctatgaactgacacagccatcctcagtgtcagtgtcctccgggacaggaccggccaggactcacctgctacaaggtaatnttcagaaacaaaaaatntgcgtcggtggttccagacaagaacgccacggccacggccccagtacgtggtagtaatttaataaagactagttcggacgtccggaccctcgagggtactccccccgtgacgtaccgtacttccgtaccggtccttacgttaaacgttcggaaaccggggtaccctaacgtacgtaccctacccgtttacgaaccctaccggttacccgggaccccggggtaccccaaagtaagtttaccggaaggtacgtacgggtacgggtccttaacggttaacctttaagtttaacgttttacggtttaaccgttcgttacgggtacccgtacgttacggaaacccctaaacgtcgtttaccggttttagggggtttcccgggggaaccgggggtaaaccgttacggggttaccgggtaaacccggttcgggggttacgggttacccgacccggtacccggtaaacgggtccccgtccccggtaccccccggttaggtccccggtaaccctttacccggtttcccccgg

SEQ ID NO: 412867 - DNA, 674 bp, Homo sapiens
  misc_feature: GZ8MTXP02FP2P2.13.50.E06.1.454.CMB.2.raw
  modified_base (252)..(252): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctccccctctcattctctgcacagtctctgtgacctcctatgaactgacacagccatcctcagtgtcagtgtctccgggacagacggccaggatcacctgctacgaaggaaatattctaagaaacaaaaaaatntagcgtcggtgttccagcaagaacgccaggccacggccccagtactggtagtatttaagaaagactagttgacggccgaccctgaacgggtactcccccgtagacgacgtacttccgtaccggtctacgtaacgttcgaacggggtaacccacgtacgtacctacccgttacgaaccctacgtacccggaaccccggggacccaagtagtcggaaggtagtacggaaggtctagtacttatttacgttagttacctcgtagccggtactacgaaacctaacgtcgttacggtttcgggggtttaccggggacgggggtaaccctaagggttcggtaacccgggttcgggtcggggtaccgacggacccgtaaggtcccgtcccggtaccccccgttggtaccctaccgttccgtttccccgg

SEQ ID NO: 412868 - DNA, 518 bp, Homo sapiens
  misc_feature: GZ8MTXP02GR6MY.13.50.E06.1.454.CMB.2.raw
  modified_base (245)..(245): a, c, t, g, unknown or other
  modified_base (286)..(286): a, c, t, g, unknown or other
  modified_base (295)..(295): a, c, t, g, unknown or other
  modified_base (313)..(313): a, c, t, g, unknown or other
  modified_base (377)..(377): a, c, t, g, unknown or other
  modified_base (419)..(419): a, c, t, g, unknown or other
tcagtcacgtactacacgaccggtgctcgatttagatctactgacaacacacaagggggctgtaggctcaggaggcagagctctgaatgtctcaccatggcctggatccctctcctgctcccctcctcattctctgcacagtctctgtgacctcctatgaactgacacagccatcctcagtgtcagtgtctccgggacagacggccaggatcacctgctcaggaaatattctgaacaaaaaaatntgactcggtgttccagcagaagccagccaggccccagtacnggtgattanaaagcattgagcggcctnagggactccccctgacgcgtattctccgggcttctaattcacgggaccacagtcaccttgaccntcaccggggccagatgaggatgagctgactattattgtactntgcgtctgacaaccatcgttgggtttacggcgggggtaaccagttcggaccgtcggtggtccagtcccgaagctcgacccccgtggccactcttacccg

SEQ ID NO: 412869 - DNA, 782 bp, Homo sapiens
  misc_feature: GZ8MTXP02ITT3U.13.50.E06.1.454.CMB.2.raw
  modified_base (231)..(231): a, c, t, g, unknown or other
  modified_base (248)..(248): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctcccctcctcattctctgcacagtctctgtgacctcctatgaactgacacagccatcctcagtgtcagtgtctccgggacagacggccaggactcactgctacaggtaaatnttcagaaacaaaaaatntgctcggtgtccagcagagccaggccaggccccagtacgtggtagtaatttaagtaaaagactagtttacggacgcccggaccccgtacgaacggggtacctcccccccgtaggacgtaccgtaactttcccgtacccggtcttacgttaaacttccgaacggggtaacccacgtacgtaccctaaccgttcgaaccctacgtacccgaacccgggggtccccaaggtacgttacgggaacggtagtacgggaacgtccgtaggttaaccttaaagttttacgttttcggtttaaacccgttcggttacgggtcccgggtcgtaacggtaaaccctaaaccggttcgttaccgggtttacgggggttttacccgggggaccggggggttaaaccctaaaggggtttaccgggtaaaccccggggtttcggggttaccggggtacccggtaacccggtaaccccggtaacggggtccccgttaccccggtccccccggttacgggttcccctaaccgtttcccgtttacccccgg

SEQ ID NO: 412870 - DNA, 680 bp, Homo sapiens
  misc_feature: GZ8MTXP02HBNXB.13.50.E06.1.454.CMB.2.raw
  modified_base (236)..(236): a, c, t, g, unknown or other
  modified_base (254)..(254): a, c, t, g, unknown or other
  modified_base (293)..(293): a, c, t, g, unknown or other
  modified_base (303)..(303): a, c, t, g, unknown or other
  modified_base (336)..(336): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctccccctctcattctctgcacagtctctgtgacctctatgaactgacacagccatcctcagtgtcagtgtccgtccgggacaggaccggccaggactcacctgctcgaaggtaaatnttctagaaacaaaaaatntgctggtgtcagacagaacgcaggcccagccccagtacngtgtaattanaaagctagtgagccgccgtgacggtctccccgngacgcgtacgttccgtcggcttacgtacttacgacggacccagtactacctaccctagacctacgccgaccgggaccaagtacgtggaagtagtagaccgtgtaacggtacttttaaacgttacgttttactaccggtttcgaggttcccgggtataccggtaaaccctaacgttacgttccggtttcgggggtttacccggggaccgggggtaaaccttaggggttacccgaccggtttccggggtagggttaccccgaaacggttaccccggaaacgggttccccgtaacccggttcccccccggtaaggtttccccgaccctttccccgtttaacccccgg

SEQ ID NO: 412871 - DNA, 725 bp, Homo sapiens
  misc_feature: GZ8MTXP02JT7JX.13.50.E06.1.454.CMB.2.raw
  modified_base (201)..(201): a, c, t, g, unknown or other
  modified_base (236)..(236): a, c, t, g, unknown or other
  modified_base (254)..(254): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctccccctctcattctctgcacagtctctgtgacctcctatgaactgacacagccatcctcagtgtcaggtgtcctccggganaggaccggccaggatcacctgctcgaaggtaaatnttacagaaacaaaaaatntgctcggtgttccagcagacgccgaggccacggccccagtacgtggtagtaatttaagaaaagactattggacgtccggacctcgaggtactcccccgtgacgcgtacttccgtaccggcttctaacgttcgaacgggaccagtacgacctacttacgacctacgaccgaacccggggcccaaggtacttcggaaggtaagtgggtacgtcgttaacggtactttaagtttaacgtttcggtttaactaccgttggtaccggtacgttaccggaaaccgtaaacccttaggtttaccgggtttcgggggtttacccgggggaaacggggggtaacccttaaaggggtttccgggtaaaccgggttccggggtttacggggtaacccgccgggttaacccccgaacgggtcccggttcccccgtaccccccggttcggggtaccccttacccgtttcccggtttacccccgg

SEQ ID NO: 412872 - DNA, 652 bp, Homo sapiens
  misc_feature: GZ8MTXP02IL9J1.13.50.E06.1.454.CMB.2.raw
  modified_base (267)..(267): a, c, t, g, unknown or other
  modified_base (332)..(332): a, c, t, g, unknown or other
  modified_base (505)..(505): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctccccctcctcattctctgcacagtctctgtgacctcctaatgaactgaccacacgccatcctcagttgtcaggtcgtccgtccgggacaggaccggccaaggactcacctgctacgaaggaaattattactagaaaacaaaaaaatntagcgtcggtcggttccagcaagaacgccgacggccgacggaccccagtactggtataatttaanaaacgactaagttggacgcccgggtccctaggaacgggactcccccgtaggacgccgtacgttccgtcccggcttacgttaactcggaaacgggcctaaccgtaggtaccctaaccgttcgaccctacgtacccggacccgggggaccctagtaacgtggaggacgtggacgnttacgtacttatttacgttgttactgtacggccgtctagaaacctacgttagtcggtttcgggttaccggggacgggggtacctaggttcggacgttcggtcgtacgacgtcccgaagcctcggcccccgtgtcaccttcgtacccg

SEQ ID NO: 412873 - DNA, 689 bp, Homo sapiens
  misc_feature: GZ8MTXP02FGV1M.13.50.E06.1.454.CMB.2.raw
  modified_base (257)..(257): a, c, t, g, unknown or other
tcagtcacgtactacacgaccggtgctcgatttagatctactgacaacacacaagggggctgtaggctcaggaggcagagctctgaatgtctcaccatggcctggatccctctcctgcctccccctcctcattctctgcacagtctctgtgacctcctatgaactgacacagccatcctcagtgtcagtgtctccgggacaggaccggccaggatccacctgcctcgaaggaaattattactagaaacaaaaaaatntgctcggtgtccagcagagccaggccacggccccagtactggtgtattaataaagactatgagccggccctcgagggactccccccgtgacgcgtacttccgtcccggcttctaaacgttccgaacgggtacccaacgtacgtacctaacccgttcgaaccctagtacccggaacccgggggcccccaagggtacttagggaacggtagtgggacgggtcctaggaacctttaagtttatttagttacttcgtggccgtcgtacggaaaccaaccgtagttcggtttacgggggtttacccgggggaccggggggtaacccttaagggtttacggtacccggggttccgggtcggggttaccaccggtaccccgaaacggggtccttacccggtcccccccgtcgggttacctacccgttccgtttcccccg

SEQ ID NO: 412874 - DNA, 553 bp, Homo sapiens
  misc_feature: GZ8MTXP01CZ1U2.52.87.H10.1.454.CMB.2.raw
  modified_base (273)..(273): a, c, t, g, unknown or other
  modified_base (280)..(280): a, c, t, g, unknown or other
  modified_base (283)..(283): a, c, t, g, unknown or other
  modified_base (302)..(302): a, c, t, g, unknown or other
  modified_base (416)..(416): a, c, t, g, unknown or other
  modified_base (426)..(426): a, c, t, g, unknown or other
tcagcgcagtacgacacgaccggtgctcgatttagcagtactgcgttgggtttggggctgggcctcaggaagcagcatcgggggtgccgcagccatggcctggaccgctctccttctgagcctccttgctcactttacagggtctgcggcctcccatgacctgactcagtcactctcagtgtcggtggccctggacagacggccactattacctgtggggatacaacattggaaactaaaatgtgcagtgtaccagcagagcagcagccctgntgtcatntanaggatcgaagacgggctgngggattccgtgagcgattctcgtcggcctccgaaacgtcggaacgaaccaaccggcccaacccgtgacccatcagaagtcgacccaagtcggtgagtgagcagtactattacgngccgaggtgngggacgtaggtggttagttgtgtatagttcggacggtagggaccaagctgaacccgtcttaagtcacgacccgaggccgttcgcccccgtggtctaaccgtttcgtccccaccttccgttcttaacg

SEQ ID NO: 412875 - DNA, 546 bp, Homo sapiens
  misc_feature: GZ8MTXP01BHM3Y.52.87.H10.1.454.CMB.2.raw
  modified_base (338)..(338): a, c, t, g, unknown or other
  modified_base (414)..(414): a, c, t, g, unknown or other
  modified_base (434)..(434): a, c, t, g, unknown or other
  modified_base (441)..(441): a, c, t, g, unknown or other
  modified_base (521)..(521): a, c, t, g, unknown or other
  modified_base (535)..(535): a, c, t, g, unknown or other
tcagcgcagtacgacacgaccggtgctcgatttagcagtactgcgttgggtttggggctgggcctcaggaagcagcatcgggggtgccgcagccatggcctggaccgctctccttctgagcctccttgctcactttacagggtctgcggcctcccatgacctgactcagtcactctcagtgtcggtggccctgggacagacggccactatacctgtggggatacaacattaggaaactaaaaatgtgcagtggtaccagcagaagccaggccaggcccctgtgttggtcatctatagggatcggaagacgggcctgtgggattccgtgagtcgattcnctggccctccaaacgtcggagaaccaccgggcccaacctcgacccatcagaacgtcgacccaagtcggtgatgagnagtactatactgcgaggtgngggacgnggtggtgtgtgagtgttcgggacggtaggtaccaagcgtggaacccgtcttagtcacgcccaaggccgttcgcccctgcncgtcctcgttcccnccttccgtaac

SEQ ID NO: 412876 - DNA, 590 bp, Homo sapiens
  misc_feature: GZ8MTXP01C2QZJ.52.87.H10.1.454.CMB.2.raw
  modified_base (266)..(266): a, c, t, g, unknown or other
  modified_base (335)..(335): a, c, t, g, unknown or other
  modified_base (555)..(555): a, c, t, g, unknown or other
  modified_base (565)..(565): a, c, t, g, unknown or other
tcagcgcagtacgacacgaccggtgctcgatttagcagtactgcgttgggtttggggctgggcctcaggaagcagcatcgggggtgccgcagccatggcctggaccgctctccttctgagcctccttgctcactttacagggtctgcggcctcccatgacctgactcagtcactctcagtgtcggtggccctgggacagacggccactattaccgtgtggggatacaacattaggaaactaaaatgtgcagtggtaccagcagaancaggccaggccctgtgtggcatctagtaggatcgaagacggcctgtgggactttcctgacgcgtattcntcggcccctaccgaaacgtcggaagaacccaaccgggacccaaccccgtagaaccccaattccgaacggtaaacgtcgaccccgaaaggttccggtaggaagtggaggaccgaagtacttagttaaccgtgaccgtagggtgacggggtatagggttggtagttgtagtacgtagttcgggacggaggaccaagcgtgaaccgtcttagcacgccagccncgcccctgcncgtctcgttccctaacccttctaac

SEQ ID NO: 412877 - DNA, 715 bp, Homo sapiens
  misc_feature: GZ8MTXP01CZUXP.52.87.H10.1.454.CMB.2.raw
  modified_base (297)..(297): a, c, t, g, unknown or other
tcagcgcagtacgacacgaccggtgctcgatttagcagtactgcgttgggtttggggctgggtctcaggaagcagcatcgggggtgccgcagccatggcctggaccgctctccttctgagcctccttgctcactttacagggtctgcgcctccatgacctgactcagtcactctcagtgtcggtcggccccgggacagaccggccactattaccgtggtgggggataacaacagttaggaaactaaaaatgtagcagtggtaccagcagaagcaggcaggccctgtgtggcatctanaggatcggaagacgggccctgtagggactttcccgtaggagcgtatttccgtacgtggcctaccccaacgtacggaacgaaaccgaccggaacccaccccgtcgaaaccactacgaaagaacgtcgacccctaaagggtccggtagagtacggaagggtaccaaggtaactttaacttacgtcggaccggtaagggttcggtacggggtacgtagggggttgggttgggtttggacgtagttacggttacggggacggggtaaacgggacctaagggccgttacggaccccggttaactaacggttccgaaacggccccggaaacgggtcccttaaccccgggccccttacccgggtccctaacccgtttcccggtaccccgtttccccttacccctttaaccgttccgtttaaaccg

SEQ ID NO: 412878 - DNA, 715 bp, Homo sapiens
  misc_feature: GZ8MTXP01EJSI9.52.87.H10.1.454.CMB.2.raw
tcagcgcagtacgacacgaccggtgctcgatttagcagtactgcgttgggtttggggctgggcctcaggaagcagcatcgggggtgccgcagccatggcctggaccgctctccttctgagcctccttgctcactttacagggtctgcggcctccatgacctgactcagtcactctcagtgtcgtggccctggacagacggccactataccgtgtaggggatacaactattaggaaactaaaaagtgtagacagtcggtaaccagcaagaagccaggccacggcccctgtgtggtcatcgtagaggatacggaagacggtcctgtagggtattcccgtaggacgcgtattcgtcgtggcccctaccgaacgtacgggaacgaaacccgaacccgggacccaaccccgtagaaacccctagtaccgaaacggtaaacggtcgaaccccgtaaaggttccggaagtagtacgggaaggacaaacggtaaccttaattaacgtcgaccgtagggtaggtacgggacgtaagggtggttagttgaggtaagtacggttacgggacgggaacgggtacccaaaggtccgttaacgggaaccccgttaacgttaaacggacccgaacggaaccccgtaacggttcccgttcccgttaccccccgtcggttccctaacccgttcccgtaccccgttccccctaaccccgttcccgttaacccg

SEQ ID NO: 412879 - DNA, 604 bp, Homo sapiens
  misc_feature: GZ8MTXP01EYZSC.52.87.H10.1.454.CMB.2.raw
  modified_base (331)..(331): a, c, t, g, unknown or other
tcagcgcagtacgacacgaccggtgctcgatttagcagtactgcgttgggtttggggctgggcctcaggaagcagcatcgggggtgccgcagccatggcctggaccgctctccttatgagcctccttgctcactttacagggtctgcggcctcccatgacctgactcagtcactctcagtgtcggtggccctggacagacggccactattacctgtgggggatacaacattaggaaactaaaatgtgcagtggtaccagcagaagccaggccaggcccctgtgttggtcatctatagggatcggaagacggggcctcgtggggatttcccnggagcgtattctctggcccttaccaacgtcggaagaacccaaccgggcccaacccctgaacccatcaggaaacgtgaccccaaggtcggtagagtggaggacaaggacttaagtaacctgccgaagggtcgtaggggacgtagggttgggtgttgtcgtagttagttcgggacgggtagggaccaaggcgtgaaccgtcttaaagtcgacgccccgaaggccgttcgcccccgtggtcctaaccgtctcgttcccctaacccgttcctaaccg

SEQ ID NO: 412880 - DNA, 680 bp, Homo sapiens
  misc_feature: GZ8MTXP01DK2OA.52.87.H10.1.454.CMB.2.raw
  modified_base (317)..(317): a, c, t, g, unknown or other
  modified_base (328)..(328): a, c, t, g, unknown or other
tcagcgcagtacgacacgaccggtgctcgatttagcagtactgcgttgggtttggggctgggcctcaggaagcagcatcgggggtgccgcagccatggcctggaccgctctccttatgagcctccttgctcactttacagggtctgcggcctcccatgacctgactcagtcactctcagtgtcggtggccctgggacagacggccactattaccgtggtggggatacaacataggaaactaaaatgtgcagtgaccagcagagcagcagccctgtgtgtcatctagaggatcggaagacgggcctgtgggattccgngagcgtattcngtcggcccctacctaaagtcggaacgaaacccgtaacccgggacccctaaccccgtacgaaaccctaagttaccgaaaggtaaacgtccgaacccgtaaacggttccgggttaggaagtacggaacgggtacctaaacggtaacttaacgttaaccgtacggacccggtaagggttcgggtacggggaggtaagggttggggttgttggtacggtagttacggttcgggacgggtaacgggaacccgaaggtccgtacgaacccggttacgaagtaccacggacccgaacggccgttccgccccctggtccctaaccgttcccgtccgttccccgtccccttccgttaaccg

SEQ ID NO: 412881 - DNA, 714 bp, Homo sapiens
  misc_feature: GZ8MTXP01EWYIF.52.87.H10.1.454.CMB.2.raw
tcagcgcagtacgacacgaccggtgctcgatttagcagtactgcgttgggtttggggctgggcctcaggaagcagcatcgggggtgccgcagccatggcctggaccgctctccttctgacgcctccttgctcactttacagggtctgcggcctcccatgacctgactcagtcactctcagtgtcggtcggcccgtgggacaggaccggccacttacttaccgtggtagggggaataacaactattaaggaaactaaaatgtagacaggtcggtaaccagacagaacgccacggccacggccctgtgttcggtcatctagaggatacggaagcggtctcgtgggtacttccgtgagacgtattcctcgtcggccccttaccgaaacgtacggaacgaaacccgaacccgggaccctaacccgtacgaaaccctagtaccgaaacgggtaacgtcggaccccgtaaagggttcggtagaacggtaggaacggacgtaacgaacgtttataaccgtcggacgtagggttaggttcggggaacgttggggtttcggggttagttgggtagttacggttacgggttcgggagggtaaacggaccctaagggtcctacggtaaccgtaacgttacgggtacacccggacccgaacggttccgttccgttacccccgtggaccctcgttcccgtcccggttcccctccccttcgttaaccg

SEQ ID NO: 412882 - DNA, 651 bp, Homo sapiens
  misc_feature: GZ8MTXP01D6LJF.52.87.H10.1.454.CMB.2.raw
  modified_base (317)..(317): a, c, t, g, unknown or other
  modified_base (322)..(322): a, c, t, g, unknown or other
  modified_base (329)..(329): a, c, t, g, unknown or other
  modified_base (402)..(402): a, c, t, g, unknown or other
  modified_base (425)..(425): a, c, t, g, unknown or other
tcagcgcagtacgacacgaccggtgctcgatttagcagtactgcgttgggtttggggctgggcctcaggaagcagcatcgggggtgccgcagccatggcctggaccgctctccttctgagcctccttgctcactttacagggtctgcgcctccatgacctgactcagtcactctcagtgtcggtggccctggacagacgccactattaccgtgtgggatacaatattaggaaactaaaatgtagacagtcgtaccagcagagcaggccaggccctgtgttggcatctagaggatacgaagcggctagtggattccgngacgngtattcncgtgccctaccaagtcggacaaccgaccggacccaacccgtgaaccatacgagaacgtcgacccaagtcgganagtgagactaagacttactacgngtaccgtaggtggtaggacggtaggttgggtgttaggtagtacgttacggttcgggaacggggtaacgggtaacccgaaacggtccgtacgggtaaccccgtaaccgttaaagggccccttaaacggacccggtaaacggttcccgttaccccggcccccggttaacggtcccctaaccgttcccgttccccggttaccccctaacccccgttaaccgttaacccg

SEQ ID NO: 412883 - DNA, 714 bp, Homo sapiens
  misc_feature: GZ8MTXP01AGFYE.52.87.H10.1.454.CMB.2.raw
  modified_base (502)..(502): a, c, t, g, unknown or other
tcagcgcagtacgacacgaccggtgctcgatttagcagtactgcgttgggtttggggctgggcctcaggaagcagcatcgggggtgccgcagccatggcctggaccgctctccttctgagcctccttgctcactttacagggtctgcggcctcccatgacctgactcagtcactctcagtgtcggtcggcccgtgggacagaccggccactacttaccgtggtaggggatacaactagttaaggaaactaaaatgtagacagtacggtacagcaagaacgccgacggccgacggtcccctggtcgttggtcattacgtagtagggactacggaaggaccgggtctcgtggggtacttccgtggagcgtacttctcgtcggtcccctaccgacgtacgggaacgaaccgaacccgggaccccaacccgtacgaaccctataccgaaggaacgtcgacccgtaagggtccggtagacgtgggacggacaaggtactattaccgnggaccggtagggtcgtaggggtacggtaggggttggttggttagtaggttacgtagggttccggggaacgggacgggtaacctacgggtccgttacggaacccggtacttaacgggccgaccggacccgtaacgggttccccgttcccgttcccccggttcgtaccctccgttccccttcccggttaccccctaacccgttccctttaaccg

SEQ ID NO: 412884 - DNA, 630 bp, Homo sapiens
  misc_feature: GZ8MTXP02GFF8Q.52.87.H10.1.454.CMB.2.raw
  modified_base (246)..(246): a, c, t, g, unknown or other
  modified_base (452)..(452): a, c, t, g, unknown or other
  modified_base (476)..(476): a, c, t, g, unknown or other
tcagcgcagtacgacacgaccggtgctcgatttagcagtactgcgttgggtttggggctgggcctcaggaagcagcatcgggggtgccgcagccatggcctggaccgctctccttctgagcctccttgctcactttacagggtctgcggcctcccatgacctgactcagtcactctcagtgtcggtgccctgggacagacggccactattacctgtggggatacaacattaggaaactaaaatgtncagtggtaccagcagagccaggccaggcccctgtgttggcatctagtagggatacggaagacgggcctcgtgggatttccgtgagcgtattctcgtggcccctaccaacgtcggaagaaccaccggacccacccgtgaaccctatacgaagaaacgtcgacccgtaaaggtccggtagagtggaacggctaagaacttagttaacncgaccgtagggttggaggggaacnggttggtgttggtagaagtagttcgggacgggtacgggacaaggtctacggtaacccgtctaaaggtccaaacggaccccgaaacggcccttacccggaccccccgtcggtacctaccgttccgttaccgttcccccgaccccttccttacccg

SEQ ID NO: 412885 - DNA, 652 bp, Homo sapiens
  misc_feature: GZ8MTXP02JOM4Z.52.87.H10.1.454.CMB.2.raw
  modified_base (283)..(283): a, c, t, g, unknown or other
  modified_base (298)..(298): a, c, t, g, unknown or other
  modified_base (322)..(322): a, c, t, g, unknown or other
  modified_base (638)..(638): a, c, t, g, unknown or other
tcagcgcagtacgacacgaccggtgctcgatttagcagtactgcgttgggtttggggctgggcctcaggaagcagcatcgggggtgccgcagccatggcctggaccgctctccttctgagcctccttgctcactttacagggtctgcggcctcccatgacctgactcagtcactctcagtgtcggtggccctgggacaggaccggccactattacctggtggggatacaacattaggaaactaaaatgtgcagtggtaccagcagaagcaggccagccctgtntggcatctagtaggntcgaagcggactgtgggattccgngacgcgtattcgtcgtcggcccctacccgaaacgtcgggaacgaaaccgaccgggaccctacccgtgaacccattaccgaagaaacgtcgaccccgtaaagtccggtagaactggaagtcaagtaccttaagtaccgtgacccgtaagggttggacgggtaactagggttgggttgttagggtagtaagttaggttccggggacgggtaacggggaacctaaagggtccgtacggtaacccccgtacttaaaggcccaaacggccccgaaaggtccctcccggcccccgtggtacccacgttcctcccggtccccnccccgttctacccg

SEQ ID NO: 412886 - DNA, 546 bp, Homo sapiens
  misc_feature: GZ8MTXP02GDKV4.52.87.H10.1.454.CMB.2.raw
  modified_base (353)..(353): a, c, t, g, unknown or other
  modified_base (415)..(415): a, c, t, g, unknown or other
  modified_base (539)..(539): a, c, t, g, unknown or other
tcagcgcagtacgacacgaccggtgctcgatttagcagtactgcgttgggtttggggctgggcctcaggaagcagcatcgggggtgccgcagccatggcctggaccgctctccttctgagcctccttgctcactttacagggtctgcggcctcccatgacctgactcagtcactctcagtctcggtggccctgggacagacggccactattacctgtgggggatacaacattggaactaaaaatgtgcagtggtaccagcagaagccaggccaggcccctgtgttggtcatctatagggatcgaagacgggcctctgggattcctgagcgattctctggcctccaactcgganacacggccaccctgacccatccagaacgtgcccaaagtcggtagatgaggcagactattacngaccaggtgtgggacaggtggtgttgtgtagtagttcgggcggtaagggaccaaaggcgttcgaccgtccgtaaagtccaagcccgaagctccgccccctaacggtcactccgtcgttcccccnccctctc

SEQ ID NO: 412887 - DNA, 711 bp, Homo sapiens
  misc_feature: GZ8MTXP02G3AK5.52.87.H10.1.454.CMB.2.raw
  modified_base (403)..(403): a, c, t, g, unknown or other
tcagcgcagtacgacacgaccggtgctcgatttagcagtactgcgttgggtttggggctgggcctcaggaagcagcatcgggggtgccgcagccatggcctggaccgctctccttctgagcctccttgctcactttacagggtctgcggcctcccatgacctgactcagtcactctcagtgtcggtggccctgggacagacggccactattacctgtggggatacaacattaggaaactaaaatgtgcagtgtaccagcagaagccaggccaggcccctgtgttggtcatctataggatacgaagacggcctcgtggattcctgagcgtattctcgtggtccctccgaaacgttcggaagtaaccacggcccacccgtcgaacccagtaccaagaacggtacnccccgaaagtccggtagacgtggaacggctaaggaacccttagttaacgtcgtacccgtagggttagggtcggggaaacctagggtttagggtggtttaggttaggaagtttaaggtttccggggaccgggggtaacggggaaccccgaagggtaccgtaccgggtaaaacccccggttccgttaaaaccggtccgaaaccggaacccccgtaaacgggtcccgtaacccggtcccccccgtcgggttaccctaaccccgtttcccgttacccggtttaccccccacccccgtttccccgttaacccg

SEQ ID NO: 412888 - DNA, 677 bp, Homo sapiens
  misc_feature: GZ8MTXP02GE1Q7.52.87.H10.1.454.CMB.2.raw
tcagcgcagtacgacacgaccggtgctcgatttagcagtactgcgttgggtttggggctgggcctcaggaagcagcatcgggggtgccgcagccatggcctggaccgctctccttctgagcctccttgctcactttacagggtctgcggcctcccatgacctgactcagtcactctcagtgtcggtggccctgggacagacggccactattacctggtggggatacaacattggaaactaaaatgtgcagtggtaccagcagaagccaggccaggcccctgtgttggtcatctagtagggatcggaaagacgggcctcgtggggacttccgtgacggtcgtattctcgtggcccctaccgaaacgtcgggaacgaaaccgacccgggccctaccccgtggaaccctattaccgaaaggtaaacgtcgaccccctaaagggtccgggtagagtaggacgggacaaggtacttaattaacgtcggaccgtagggttggtagggacgtaggttgggtgttggtagtagttaggttcggggacgggaaggggacccaaaggtccgtacggtaacccggttacccgtaaggtcccgaacggccccgaaacggtcccgtaccggcccccgttcggtaccctaccgttccctccggttaccccctaacccgttcccgttaaccg

SEQ ID NO: 412889 - DNA, 576 bp, Homo sapiens
  misc_feature: GZ8MTXP02HHTUS.52.87.H10.1.454.CMB.2.raw
  modified_base (316)..(316): a, c, t, g, unknown or other
  modified_base (354)..(354): a, c, t, g, unknown or other
  modified_base (414)..(414): a, c, t, g, unknown or other
  modified_base (429)..(429): a, c, t, g, unknown or other
tcagcgcagtacgacacgaccggtgctcgatttagcagtactgcgttgggtttggggctgggcctcaggaagcagcatcgggggtgccgcagccatggcctggaccgctctccttctgagcctccttgctcactttacagggtctgcggcctcccatgacctgactcagtcactctcagtgtcggtggccctgggacagacggccactattacctgtgggggatacaacattaggaaactaaaatgtgcagtggtaccagcagaagccaggccaggcccctgtgttggtcatctatagggatcgaagacgggcctntggggattcctgagcgattctctggccctcactcgganacacggccaccctgaccatcagaagtcgacccaaagtcggtgatgaggcagactattacngccaggtgtgggacnggtggtgttggtgtagtagttcgggcgggaacggaccgaaagcgttcggaacccgttccgtaaagtccgaacggaccccgaaggtcccgtccgtccccccgtgggtcccaccgttccgtccgttcccccgccccttccctttaaccg

SEQ ID NO: 412890 - DNA, 718 bp, Homo sapiens
  misc_feature: GZ8MTXP02I5SMC.52.87.H10.1.454.CMB.2.raw
tcagcgcagtacgacacgaccggtgctcgatttagcagtactgcgttgggtttggggctgggcctcaggaagcagcatcgggggtgccgcagccatggcctggaccgctctccttctgagcctccttgctcactttacagggtctgcggcctcccatgacctgactcagtcactctcagtgtcggtggccctgggacagacggccactattacctgtggggatacaacattaggaaactaaaatgtgcagtggtaccagcagaagccaggccaggcccctgtgttggtcatctagtaggatcgaagacgggcctgtggggacttccgtgagtcgtatttcctgtggccctccgaaacgtcggaacaaccaccggccacccgtgaacccatacgaagtaacgtcgacccctaaaggtcggtacgagtaggacgggactaaggtaccttaagttaccgtacggtacccggtaaggggttagggtacgggggaaaccgttagggggtttaggggttaggtttggggttaaggtaaggtttaacggttccgggggacgggggtaacggggtaacccgaaacgggtccggtaacggtaaacccggttacccggtaaaaggtcccgaaacggaccccgaaaacgggtccctaacccggcccccccgttcgggtccctaacccggttccctcccggttaccccctaaccctttcccgttaacccg

SEQ ID NO: 412891 - DNA, 692 bp, Homo sapiens
  misc_feature: GZ8MTXP02IVCPE.52.87.H10.1.454.CMB.2.raw
  modified_base (249)..(249): a, c, t, g, unknown or other
  modified_base (319)..(319): a, c, t, g, unknown or other
  modified_base (330)..(330): a, c, t, g, unknown or other
  modified_base (348)..(348): a, c, t, g, unknown or other
tcagcgcagtacgacacgaccggtgctcgatttagcagtactgcgttgggtttggggctgggcctcaggaagcagcatcgggggtgccgcagccatggcctggaccgctctccttctgagcctccttgctcactttacagggtctgcggcctcccatgacctgactcagtcactctcagtgtcggtggccctgggacagacggccactattacctggtggggatacaactattaggaaactaaaatgtncagtgtacagcagaagcagcaggccctgtgtgcatctagtaggatcgaagacggcctgtgggatttccgngagcgtattcncgtgcctaccaagtcganaacgaccgccacctgaaccatcgaagaacgtcgacccaaagtcgtagacgtaggacggacaaggtacttaacgttaacgacgaccgtaagggttacggtaacggggtactaaggggtttgggttggtttagggttaagtaaaggtttacggtttaccgggggacgggtaaaacgggggtaccaacgggtaccgtaaccgggtacccggttaaccggtaaacggtaccgaaccggtaaccccggaaacgggtccccgttaccccgggacccccgtttcggggtacccttaaaccgttccccggttacccgtttaccccccgtaacccgtttccctttaaacccgg

SEQ ID NO: 412892 - DNA, 432 bp, Homo sapiens
  misc_feature: GZ8MTXP02JG3Q0.13.4.A04.1.454.CMB.2.raw
  modified_base (338)..(338): a, c, t, g, unknown or other
  modified_base (424)..(432): a, c, t, g, unknown or other
tcagtcacgtactacacgaccggtgctcgatttagagtagtgatcagggtccgccaggctccagggaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatactttgactactggggccagggaaccctggtcaccgtctcctcagcctccaccaagggcccatcggtctcccctgcaccctcctccagngcacctctggggcacacgcgccctgggctgcctggtcaagggactacttcctagtacgtgactgagcggctggcaaggcgcatagnnnnnnnnn

SEQ ID NO: 412893 - DNA, 441 bp, Homo sapiens
  misc_feature: GZ8MTXP02HV8Q5.13.4.A04.1.454.CMB.2.raw
  modified_base (417)..(417): a, c, t, g, unknown or other
  modified_base (433)..(441): a, c, t, g, unknown or other
tcagtcacgtactacacgaccggtgctcgatttagagtagtgatcagggtccgccaggctccagggaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatacttttgactactggggccagggaaccctggtcaccgtctcctcagcctccaccaaggcccatcggtctccccctgccaccctcctccaagcgcacctcgtggggcacacgcggcccctgggctgcctggtcaagggacctacttcctagtacgtgactgagcggggntggcaaggcgcatagnnnnnnnnn

SEQ ID NO: 412894 - DNA, 428 bp, Homo sapiens
  misc_feature: GZ8MTXP02FR75Z.13.4.A04.1.454.CMB.2.raw
  modified_base (340)..(340): a, c, t, g, unknown or other
  modified_base (424)..(428): a, c, t, g, unknown or other
tcagtcacgtactacacgaccggtgctcgatttagagtagtgatcagggtccgccaggctccagggaaggggctggagtgggtctcaactattagtgctagtggtgccaccacatactacgcagactccgtgaagggccgattcaccatctccagagacaattccaagaacacgctgtatctgcaaatgaacagcctgagagccgaggacacggccgtatattactgtgcgaaggaaatttacccctatacttttgactactggggccagggaaccctggtcaccgtctcctcagcctccaccaaggcccatcggtcttcccctggcaccctcctcaagngcacctctggggcacagcgccctgggctgcctggtcaacggctacttcctagtacgtgactgagcgggctggcaagcgcatagnnnnn

SEQ ID NO: 412895 - DNA, 556 bp, Homo sapiens
  misc_feature: GZ8MTXP01CMPG0.45.69.G03.1.454.CMB.2.raw
  modified_base (219)..(219): a, c, t, g, unknown or other
  modified_base (342)..(342): a, c, t, g, unknown or other
  modified_base (375)..(375): a, c, t, g, unknown or other
  modified_base (445)..(445): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctnagtgagggtctcctgcgcgacttcaggtctcgcctttacgagtcattggtttctgctgggtgcgacgaggcccccgggaaaggacttgagtggataggatggatcgagcgacaaacatggtanacacaccactatgcacaagaacgttccgggganaggagtcctcttacgaccactgacacactcacgaggacacgcctacgtggagtgatgaggctagacatcngacgacgaccggccgtctacttctggtgacgaagggaacgacgtaaacgtggaaacgttcccgttaggtcggacggaacggtcgggggaccgagggaaccgaacgttccgg

SEQ ID NO: 412896 - DNA, 599 bp, Homo sapiens
  misc_feature: GZ8MTXP01D3VEW.45.69.G03.1.454.CMB.2.raw
  modified_base (217)..(217): a, c, t, g, unknown or other
  modified_base (296)..(296): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagagcctgggcctnagtgaggtctcctgcgcgacttcaggtctcgcctttacgagtcattggttctgcgtgggtgcgacgacgggccccgganaaggcttggagtggataggatggatcgagcgacaaacagtggtagacacaaccactatgacaacgaaaggaacggttccgggggacaggtacgttcccttcgtacgaccctacgtacgaccaacacgtaccgaacgaacgggaacacgtaccgtaacgttgggaggtgaagtggacgggtcctagacctatcgtacgacgaccgaccggtccgttcttacttcgtgtaacgacgaaaggacgacgaaacgtaggaaacttccgttagtgacgtcggtggggaccgaagggtaaccgcggtcgg

SEQ ID NO: 412897 - DNA, 659 bp, Homo sapiens
  misc_feature: GZ8MTXP01ES92Y.45.69.G03.1.454.CMB.2.raw
  modified_base (274)..(274): a, c, t, g, unknown or other
  modified_base (283)..(283): a, c, t, g, unknown or other
  modified_base (301)..(301): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagagcctggggcctcagtgagggtctcctgcgcgacttcgaggtctcgcctttacgagtcagttggtttcngcgtgggtncgacgacgggccccgganaaggtcttgagtggataggatggatcgagcgacaaacagtggtagaacacaccactatcgacaacgaaagggtaacggttccgggggactaagggacgttcccttcttacggaccctacgtacgaactaacaactcccgaacggacggaaccgacggtacccttaagttgggaggtgaagttcggacgggtccctaggactacgtcgtacgaaccgaccgtaaccgggtcccgttaccttacgttccgtggtaacggaacgaaacggggaacggacgaaacggtacggaaaccgttcccggttaggtaaccggacggtaacgggtcggggaccgaagggtaaccttaacgggttccgg

SEQ ID NO: 412898 - DNA, 537 bp, Homo sapiens
  misc_feature: GZ8MTXP01DONQL.45.69.G03.1.454.CMB.2.raw
  modified_base (218)..(218): a, c, t, g, unknown or other
  modified_base (294)..(294): a, c, t, g, unknown or other
  modified_base (325)..(325): a, c, t, g, unknown or other
  modified_base (366)..(366): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctgggcctnagtgagggtctcctgcgcgacttcaggtctcgcctttacgagtcatggttctgctgggtgcgacaggccccggganaaggcttgagtggataggatggatcagcganaaacatggtagacacacactatgcacaagaagttccggganagacgtcctcttgaccatgacacatccacgaggacagcctacgtggagtgatgaggcctgacatcgtagacgacacggtccgtctacttcctgtgcgaaaggaacgcgaaacgtgggaaacttcccgttaggtaagaccggcgtcggggaccaaggggtaacaacgttcgg

SEQ ID NO: 412899 - DNA, 537 bp, Homo sapiens
  misc_feature: GZ8MTXP01CCCXY.45.69.G03.1.454.CMB.2.raw
  modified_base (270)..(270): a, c, t, g, unknown or other
  modified_base (293)..(293): a, c, t, g, unknown or other
  modified_base (368)..(368): a, c, t, g, unknown or other
  modified_base (378)..(378): a, c, t, g, unknown or other
  modified_base (531)..(531): a, c, t, g, unknown or other
tcagacgcgatcgacacgaccggtgctcgatttagtcgctgcgtaaaggagaaaggggacccaaaaaccacaccctcctcgggagaatcccctagatcacagctcctcaccatggactggacctggagcatccttttcttggtggcagcagcaacaggtgcccactcccaggtccagctggtgcagtctggagctgaggtgaagaagcctggggcctcagtgagggtctcctgcgcgacttcaggtctcgcctttacgagtcatggttcngctgggtgcgacaggccccgganaaggcttgagtggataggatggatcgagcgacaaacatggtgacacgaccactatgacacaagaagtcccggggnagacgtcctnttgaccatcgacacgataccacgagaacacggaccttacgtggaggttgatgaggcctgacagtctacgacgacgaccggtccgtctacgtctgtcgacgaaggagcaaacgtggaaacttccgttagtgacgcgtggggaccaggggtaacncgtcgg

SEQ ID NO: 412900 - DNA, 573 bp, Homo sapiens
  misc_feature: GZ8MTXP01CJINC.45.69.G03.1.454.CMB.2.raw
  modified_base (306)..(306): a, c, t, g, unknown or other
  modified_base (365)..(365): a, c, t, g, unknown or other
  modified_base (384)..(384): a, c, t, g, unknown or other
  modified_base (393)..(393): a, c, t, g, unknown or other
  modified_base (564)..(564): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtagaagaagccgtggggcctgagtgagggtctctgcgcgacttcgaggtctcgtcctttacgagtcagttggtttctggcgtgggtgcgacgacgggccccggaanaaggtcttggagtggataggagtggatcgagcgaacaaacgagtggagacacaccatangacagaagtaacgtcgggnagagtcctntacgaccactgacacactaccgacggacgacacgtcctacgtggagtgatgacgctgacagtcgtagaccgaccgaccggtccgtcttacgttcgtgtgacgaaagggacggactaaacgtcggttaaacttccgttggtaacgacggaacggtcgggaccgagggaaccncgttaacgg

SEQ ID NO: 412901 - DNA, 786 bp, Homo sapiens
  misc_feature: GZ8MTXP01BVC8C.45.69.G03.1.454.CMB.2.raw
  modified_base (276)..(276): a, c, t, g, unknown or other
  modified_base (284)..(284): a, c, t, g, unknown or other
  modified_base (299)..(299): a, c, t, g, unknown or other
  modified_base (318)..(318): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctggaggtgaagaagccgtggggcctcgagtgagggtctcctgcgcgacttcgaggtctcgcctttacgagtcatggtttcngctgggtncgacacggcccgganaaggcttgagtggataggntggatcgagcgacaaacagtggagacacaccactatgaccaacgaaagggtaaacggttcccgggggataaacgggtacgttaccccttacgtttacggaaacccctacgttacgaaacctaaccgaactaccccgaaacgggaaacggaaccgtaaccggtacccgttaacggtttagggaacggggttagaagttacgggaacgggccccgtttaagggaacctaacgtttaccggtaacggaaacccggaacccggtaaaccccgggggtccccgttaaccggtttaacccttttccggttgggttaacgggaacccggaaaagggggtaaacggaccgtaaaaacggttacggggttaaaaacccgttccccgttaaggggttaacgggaaaccccgggttaaccggtacgggggggaaccccgttaaaacggggggaaacccttaacggtttaaccccggggg

SEQ ID NO: 412902 - DNA, 673 bp, Homo sapiens
  misc_feature: GZ8MTXP01D7X77.45.69.G03.1.454.CMB.2.raw
  modified_base (273)..(273): a, c, t, g, unknown or other
  modified_base (300)..(300): a, c, t, g, unknown or other
tcagacgcgatcgacacgaccggtgctcgatttagtcgctgcgtaaaggagaaaggggacccaaaaaccacaccctcctcgggagaatccctagatcacagctcctcaccatggactggacctggagcatccttttcttggtggcagcagcaacaggtgcccactcccaggtccagctggtgcagtctggagctgaggtgaagaagcctggggcctcgagtgagggtctctgcgcgacttcgaggtctcgtcctttacgagtcattggtttcngcgtgggtgcgacgacgggccccgganaaggacttggagtggataggatggatcgagcgacaaacagtggtagacacgacactatcgacacgaaaggtaacggttccgggggactaacggtacgttccctcgttacgacctacgtagacacactaccgacgaaggacacgtcctacgttgggagtgaagttcgaacgggtcccgttaggaacctacgttacgtacggaaccgaccgtaacccgggtcccgttaccgttaactttccgtggtaacggaaccggaaagggaaacggttacgtaaaccggtaacggaaaaccgtttccccggttaggttaaccggaacggtaacggttacggggggacccttaacgggggaaccttaaccggtttaacccggg

SEQ ID NO: 412903 - DNA, 560 bp, Homo sapiens
  misc_feature: GZ8MTXP01DCBRA.45.69.G03.1.454.CMB.2.raw
  modified_base (298)..(298): a, c, t, g, unknown or other
  modified_base (330)..(330): a, c, t, g, unknown or other
  modified_base (380)..(380): a, c, t, g, unknown or other
  modified_base (486)..(486): a, c, t, g, unknown or other
  modified_base (504)..(504): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctcagtgagggtctcctgcgcgacttcaggtctcgcctttacgagtcattggtttctgctgggtgcgacacggccccggganaaggacttgagtggataggatggatcagcganaaacaatggtagacacaccactatgacacgaagaacggttcccggggganaaggagtccctcttcggaaccactacgacacactccaacgaggaacacgcctacgttggagtgagtgaggcctagaccaatctgacgacaccggccttctacttcngtgacgaaagggacgganaaacgtacgaaacttcccgttagtgaacgcgtcggggccaagggaacaacgttcgg

SEQ ID NO: 412904 - DNA, 653 bp, Homo sapiens
  misc_feature: GZ8MTXP01ESHJ8.45.69.G03.1.454.CMB.2.raw
  modified_base (219)..(219): a, c, t, g, unknown or other
  modified_base (273)..(273): a, c, t, g, unknown or other
  modified_base (301)..(301): a, c, t, g, unknown or other
  modified_base (346)..(346): a, c, t, g, unknown or other
  modified_base (394)..(394): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagccgtgggcctnagtgagggtctcctgcgcgacttcaggtctcgcctttacgagtcattggtttcngcgtgggtgcgacgacgggccccggganaaggtctggagtggataggatggatcgagcgacaaacgagtgganaacacaaccgactagtcgacaacgaaaggtaaacgggttcccgggganaacgggtacgtttcccctacgtttacggaacccctaacgtcgaacaaccgtactacccgaacggaacgggtaaaccacgggtacccttaacggttgggaaggtagaagttcggaacggtccgttagaactactccgtacggaccgtaaccgaccgggtcccttcgtaccttcgcggtaagaacgaaagggacgacgaaacgtaggaacttcccgagtcggaaccggtcgtcgggggaccaagggtaaccttcggtccgg

SEQ ID NO: 412905 - DNA, 660 bp, Homo sapiens
  misc_feature: GZ8MTXP01A6NUW.45.69.G03.1.454.CMB.2.raw
  modified_base (217)..(217): a, c, t, g, unknown or other
  modified_base (270)..(270): a, c, t, g, unknown or other
  modified_base (297)..(297): a, c, t, g, unknown or other
  modified_base (319)..(319): a, c, t, g, unknown or other
  modified_base (343)..(343): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagagcctgggcctnagtgaggtctcctgcgcgacttcaggtctcgcctttacgagtcattggtttcngcgtgggtgcgacgacggccccggganaaggtcttggagtggatagggntggatcagcgacaaacagtggtanacacaccactatgcacgaaggaacggttccggggacaggactcccgtcttacggaccctactacgaacaccaacgtcccaacggacggaaccacggtacccttaacggttgggagggttgaagttcggacgggtccccttaggaacctaacgttcgtacggaacccgaccggtacccgggtacccgttaccttaaccgtttcggtacggtaacggaaccgaaaggggaaacgaccgtaaacgtcggttaaaaccttcccgttaggtaacggaccggtaacggtcggggaaccgagggggtaaaccttcggtaaccgg

SEQ ID NO: 412906 - DNA, 666 bp, Homo sapiens
  misc_feature: GZ8MTXP01BZ0JF.45.69.G03.1.454.CMB.2.raw
  modified_base (194)..(194): a, c, t, g, unknown or other
  modified_base (284)..(284): a, c, t, g, unknown or other
  modified_base (307)..(307): a, c, t, g, unknown or other
  modified_base (370)..(370): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctgganctgaggtgaagagctggggcctgagtgaggtctccgtgcgcgacttcgaggtctcgcctttacggagtctattggtttctggcgtgggtnccggacgaccgggccccgggaanaacggtcttggaggttggataggagtggatcgagcgaacaaacgaagtggagacacacactancgacacgaaaggaacggttccggggataacggtacgtcccttcgttacggacctactacgaacccaactaccaccgaacggaacggaacgtaccgtacccttaacggttagggacggttagaacgttggacggggtacttaggaacctacgttccgaacggaaccgaaccgacccgggtccgttacccttacgttcgtcgaacggacgaaagggacggttaccaaacgtacgggttaaaccttccgttagtaacggaccgtaacggcgggggacgaggggtaaaccttcggtccgg

SEQ ID NO: 412907 - DNA, 601 bp, Homo sapiens
  misc_feature: GZ8MTXP01EW5DU.45.69.G03.1.454.CMB.2.raw
  modified_base (303)..(303): a, c, t, g, unknown or other
  modified_base (351)..(351): a, c, t, g, unknown or other
  modified_base (365)..(365): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggcgcatccttttcttggtggcagcagcaacaggtgcccactcccaggtccagctggtgcagtctggagctgaggtgaagaagcctggggcctcagtgagggtctcctgcgcgacttcaggtctcgccttttagagtcatggtttctggctggggtgcgacgacgggcccccgggaanaagggtcttggagttggatagggatggaatcgagcgacaaacagtggnaacacaaccactangacacaaagggacgttccggggcaagacgtcctcgttgaccactcgactacactaccgaacggacggtaacacgtacctacgttagggagtagtaagtgaacggtccgtagacattcgacgaccgaccgacgggtccctactttaccttcgtgtcgacgaaagggaacggacaacgttacggaaacttccgttaggtaacgacggtaacgtgggggacacgggtaacgcggtaacg

SEQ ID NO: 412908 - DNA, 706 bp, Homo sapiens
  misc_feature: GZ8MTXP01B4WAK.45.69.G03.1.454.CMB.2.raw
  modified_base (317)..(317): a, c, t, g, unknown or other
  modified_base (366)..(366): a, c, t, g, unknown or other
  modified_base (406)..(406): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcattccttttcttggtggcagcagcaacaggtgcccactcccaggtccagctggtgcagtctggagctgaggtgaagaagccgtggggcctgagtgagggtctccgtgcgcgtacttcgaggtcctcgtcctttacggagtctagttggtttctggcgtggggtcgcggacgacgggcccccgggaanaacggtcttggaggtggataggatggatcgagcgacaaacgagtggtanacacactactatcgacaacgaaggtaacggttccgggganaggtactcctcgttacgacctacgtgacacactacgaccggaggaacacgtccttaacgttgggacggtgaagtggaacggtccgtaggtactaacgttccgtacggaaccgaccggtaacccggtccgttaccgttaaccgttcgtacggttaacgggaaacccgttaaaggggaaacggttaccgtaaaaccggtaacgggttaaaaccttccccggttagggtaaccgggaaccggtaaccggggttaccgggggaacccgttaacgggggtaaacccgttaaccgggtttcccggg

SEQ ID NO: 412909 - DNA, 725 bp, Homo sapiens
  misc_feature: GZ8MTXP01BM5VB.45.69.G03.1.454.CMB.2.raw
  modified_base (310)..(310): a, c, t, g, unknown or other
  modified_base (358)..(358): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagccgtggggcctcgagtgagggtctcctgcgcgacttcgaggtctcgtcctttacgagtctagttggtttctggtcgtgggtgcggacgacgggccccggganaaggtcttggagtggataggatggatcgagcgaacaaacgagtggtanacacaaccactagtcgacaacgaaagggtaacgggttcccgggggataacgggtacgttcccttacgttacggaaccctacgtacgaaccaacctacgtacccgaacggaacggtaaccgacggtacccgttaacggttaggggagggtagtaagttacgggaacggtacccgtaggaacctagttccgtacggaacccggtaaccgaacccggggttcccttaccgttaccgtttcgtcggtaacggaacggaaacggggtaaacggaccgtaaaccggtaaggttaaaccgttcccgttagggtaaccggacgggtaacgggtacgggggacccgttaagggggtaaccttcgggttaacccggg

SEQ ID NO: 412910 - DNA, 712 bp, Homo sapiens
  misc_feature: GZ8MTXP01API37.45.69.G03.1.454.CMB.2.raw
  modified_base (304)..(304): a, c, t, g, unknown or other
  modified_base (324)..(324): a, c, t, g, unknown or other
  modified_base (390)..(390): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctcagtgagggtctcctgcgcgacttcgaggtctcgtcctttacgagtctattggtttctggctgggtgcgacgacgggccccggganaaggcttggagtggataggntggatcagcgacaaacgagtggtagacacaaccactatcgacacgaaaggtaacggttccgggganaacgtacgttccctacgttacgacctactacgaacaccgaactcccgaacggacggtaccaacggtcccttaaccggtttaggggaacgggttacgaagttcggaaccgggtccgttacggaacctaacgttccgtacggaacccggaccgtacccggggtacccgtttcctaacgtttccgtggtaacgaacgttaaacgggggaacgttcccgtaaaacgttcgggttaaaacccgttccccggttaggggtaaccggtaacgggaaccgggtcggggggaccccgttaaggggaaacgttaaccccgggtttaaccggg

SEQ ID NO: 412911 - DNA, 572 bp, Homo sapiens
  misc_feature: GZ8MTXP01ACYLX.45.69.G03.1.454.CMB.2.raw
  modified_base (219)..(219): a, c, t, g, unknown or other
  modified_base (279)..(279): a, c, t, g, unknown or other
  modified_base (286)..(286): a, c, t, g, unknown or other
  modified_base (302)..(302): a, c, t, g, unknown or other
  modified_base (306)..(306): a, c, t, g, unknown or other
  modified_base (314)..(314): a, c, t, g, unknown or other
  modified_base (318)..(318): a, c, t, g, unknown or other
  modified_base (321)..(321): a, c, t, g, unknown or other
  modified_base (329)..(329): a, c, t, g, unknown or other
  modified_base (332)..(332): a, c, t, g, unknown or other
  modified_base (337)..(337): a, c, t, g, unknown or other
  modified_base (347)..(347): a, c, t, g, unknown or other
  modified_base (369)..(369): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctnagtgagggtctccgtgcgcgtacttcaggtctcgtcctttacgagtcagttcggtttcgngcgtggngcgacgacggccgganagtntgagtganagangangagacaanaangtganacacacatancgacagtaaaggtacgtcgganacgtacgtcctactacgactagcacacgactaccgagacgactacgtacttacgtaggagtagagtcgacggtcgtagactacgtcgacgaccgtaccgccggtccttactcgttgtggtaagaacgaaaggacgttaacgtaaacgtacgaacgttccgttaggtaacgacggtaacggcgggacgacggtaacgttcgtcg

SEQ ID NO: 412912 - DNA, 725 bp, Homo sapiens
  misc_feature: GZ8MTXP01AS1VK.45.69.G03.1.454.CMB.2.raw
  modified_base (219)..(219): a, c, t, g, unknown or other
  modified_base (268)..(268): a, c, t, g, unknown or other
  modified_base (271)..(271): a, c, t, g, unknown or other
  modified_base (293)..(293): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagagccgtggggcctnagtgagggtctcctgcgcgacttcgaggtctcgcttacgatcatgttcngcngggtgcgacgacggccccgganaaggcttggagtggataggatggatcgagacgacaaacagtggacgacacaccactagtcgacacgaaggaacggttccggggacagtacgttcctgttacgacctacgtcgacaacgactacccgaaggacggaacctacgtacccgttaacggttgggacggttagaacgttcggacggtccgttaacggacctaacgtttccgaaggtaacccgaacggtaaccccgggggttcccttacctttaaacccgtttggtcgggttaacgaaacccggttaaaagggggtaaaccggacccgtaaaaccgtttaacgggggaaaacccctttccccgggttagggttaaccccgggaacccggggttaaccggggttaccgggggggtaacccgaaacggggggtaaaccccttccgggtttaaccccgggg

SEQ ID NO: 412913 - DNA, 612 bp, Homo sapiens
  misc_feature: GZ8MTXP01CQ0K1.45.69.G03.1.454.CMB.2.raw
  modified_base (218)..(218): a, c, t, g, unknown or other
  modified_base (262)..(262): a, c, t, g, unknown or other
  modified_base (305)..(305): a, c, t, g, unknown or other
  modified_base (349)..(349): a, c, t, g, unknown or other
  modified_base (377)..(377): a, c, t, g, unknown or other
  modified_base (403)..(403): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagagccgtgggcctnagtgaggtctccgtgcgcgacttcgaggtcctcgtcctttacgngtcagttggtttctgcgtgggtgcggacgacgggaccccgganaacggtacttggaggttggaataggataggatcgaggaccgaanaaacgagttcggagacacaaccacttangaacacaaagggtacgttccgggganagtacgtcctcgttacgacccagtcgacaactacgaccgacggaggaactacgtcctacggttggagtgagtgagccgtagacctagtcgacgacgacgtaccggcttccgtactcgtgaacgaacgaaaggacgaacgtaaacgtagttaaaccgttccgttagtaacggacgtaacggtcgggacgaacgggtaacgcgttaaccgg

SEQ ID NO: 412914 - DNA, 553 bp, Homo sapiens
  misc_feature: GZ8MTXP01CE6QU.45.69.G03.1.454.CMB.2.raw
  modified_base (285)..(285): a, c, t, g, unknown or other
  modified_base (295)..(295): a, c, t, g, unknown or other
  modified_base (369)..(369): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctcagtgagggtctcctgcgcgacttcaggtctcgcctttacgagtcatggtttctgctgggtgcgacnggccccgganaaggcttgagtggataggatggatcgagcgacaaacatggtagacacaccactatgcacaagaagttccggggnagcgtcctcttcgaccactgacacactccgagaggacagcctagtggagtgagtgaggcctaggactatcgtgaccgacgaccgggtccttctacttctggtcgacgaagggaacgcgaaacgtggaaacgttcccgttagtcggaccgtcggtcgggggccgaggggtaaccgttcgtccggg

SEQ ID NO: 412915 - DNA, 612 bp, Homo sapiens
  misc_feature: GZ8MTXP01AVEGH.45.69.G03.1.454.CMB.2.raw
  modified_base (277)..(277): a, c, t, g, unknown or other
  modified_base (304)..(304): a, c, t, g, unknown or other
  modified_base (363)..(363): a, c, t, g, unknown or other
  modified_base (429)..(429): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagccgtggggcctcagtgagggtctccgtgccgcgacttcgaggtctcgtccttacgagtcagttggttcngcgtgggtgcgacgacggccccggganaaggtcttgaggtggatggatggatcgagcgacaaacagtggtacgacacaacactagngaccagaacgtaacgggttccggggataacggcgttccctgttcggaacctacgtacgacactacnccgaacgaggacagcccttagttgggagtgagtcggacgtcctaggactactcgcggaacaccggtacgggtccgttaccttacgtttccgtggtcgaacggttaaagggaccgacgtaacgtacgttaaaccgttccgttaggcggaccgtaacggcggggacacgggtaacgaagttccgg

SEQ ID NO: 412916 - DNA, 672 bp, Homo sapiens
  misc_feature: GZ8MTXP01AMWVY.45.69.G03.1.454.CMB.2.raw
  modified_base (286)..(286): a, c, t, g, unknown or other
  modified_base (307)..(307): a, c, t, g, unknown or other
  modified_base (348)..(348): a, c, t, g, unknown or other
  modified_base (355)..(355): a, c, t, g, unknown or other
  modified_base (417)..(417): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagagccgtggggcctgagtgagggtctcgtgcgcgacttcgaggtctcgtctttagagtcagttggtttcggtcgtggggtcncggacgcgggacccccggganaaggctttaggagttgggaataggatggatcgagaccgaanaaaacgngttgggacaactacaacctactagtgaccaacgtaagggtaaaccgggttcccgggggaaanacggttaccgttccttacgtacgaacctacgtacgaaccaccgtaacgtacccggaacggacggtaaccgtacggtaccgttacggttgggagtgtagtcggacgtcgtacgacgtacgtacgacgaccgaccggtaccggtccttcgttacgttcgtggaacgaacggaaacgggacgaacgtaaacggtacgttaacgttccggttacggaacggacggtaacgggacgggacgttacggtaacgttcgtcgg

SEQ ID NO: 412917 - DNA, 706 bp, Homo sapiens
  misc_feature: GZ8MTXP01CIG5G.45.69.G03.1.454.CMB.2.raw
  modified_base (305)..(305): a, c, t, g, unknown or other
  modified_base (326)..(326): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctggaggtagaagaagccgtggggcctgagtgaggtctcgtgcgcgacttcgagttctcgtcctttaacgatctagttggtttctgcgtgggtcgcgacgacggcccgganaaggcttggagtggagtaggntaggatcgagacgaacaaactagtgacacacaccatatcgacacgaaacggacggttcgggatacggtcgttacctcgtacgaacctacgtacgacctacacgacccgaaggacggaccgtacgtaccttacggtgggtaaggtgagtacggacgtcccgttaggaacttacgtcgtaccggaacccgtaccggaacccggttcctttaccgtttaccgtttccgttgggtaaacccggaacgggaaacggggaaacgttacccgtaaacggttacccgggttaaaaccctttcccgggttacgggtaaccgggaaaccgggttaaccggggtaacgggggaccccgaagggggtaaacccgttccggtttaaccccggg

SEQ ID NO: 412918 - DNA, 624 bp, Homo sapiens
  misc_feature: GZ8MTXP01D0TU0.45.69.G03.1.454.CMB.2.raw
  modified_base (194)..(194): a, c, t, g, unknown or other
  modified_base (275)..(275): a, c, t, g, unknown or other
  modified_base (280)..(280): a, c, t, g, unknown or other
  modified_base (300)..(300): a, c, t, g, unknown or other
  modified_base (305)..(305): a, c, t, g, unknown or other
  modified_base (332)..(332): a, c, t, g, unknown or other
  modified_base (343)..(343): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtgcagcagcaacaggtgcccactcccaggtccagctggtgcagtctggganctggaggtgaagaacgcctggggcctcgagtggagggtctctgcgcacttcaggtctcgcctttacgagtctatggtttcngtcgnggcgcgacgacggaccgganaggtntggagtgataggagtgatacgagcaanaacgtagcganacacacctatagcgacaacgtaaggtaacgggtcgggatacgtactcctcgtacgactactcaacacgtacgaccgaagacgtaacacgtaccgttagtagggtagtagacgtaggacgtcgtagtaactacgtaccgacggaccgaccgtaccggtccttcgttaccgttcgtaggtaacggaacggaaacgggtaacgttaaacgttaacgtaacggaaccgttccggttaggtaaccggaacggaacggtacgggaccgaacggtccgttaacgtccg

SEQ ID NO: 412919 - DNA, 654 bp, Homo sapiens
  misc_feature: GZ8MTXP01DS3HW.45.69.G03.1.454.CMB.2.raw
  modified_base (276)..(276): a, c, t, g, unknown or other
  modified_base (290)..(290): a, c, t, g, unknown or other
  modified_base (320)..(320): a, c, t, g, unknown or other
  modified_base (357)..(357): a, c, t, g, unknown or other
  modified_base (548)..(548): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatcctttttcttggtggcagcagcaacaggtcgcccactcccaggtccagctggtgcagtctggagctggaggtagaagaacggccgtggggcctcgaggtggagggttcctccgtgcgcgtacttcgaggtcctcgtctttacgngtctagttggttcngtcgtgggtcgcgacgccgggacccggaanaaggtcttggagtggataggagtggatcgagacgaanaaacgtagtcgtacgacacaccactagcgacacgaaacggtacggtcggggataggtacgtcctcgtacgaccagtacgaactacactaccgacggacgaccgtacgttacccgtagttagggaacgtggtaagtcgacgtccgtaagtacctagtacgacgaacgaccgtaccggtccgtcttacgttgngtaacggaacgaaagggaccgttacgtaaacggtacgaaaccgttccggttaggtaacggaccgggcgggtaccggggacgttaacgggtaaccgttaacgtccgg

SEQ ID NO: 412920 - DNA, 688 bp, Homo sapiens
  misc_feature: GZ8MTXP01AB88D.45.69.G03.1.454.CMB.2.raw
  modified_base (279)..(279): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagccgtggggcctcagtgagggtctcctgcgcgacttcgaggtctcgtcctttacgagtctagttggtttcgngtcgtggcgcgacgacggacccggagaaggtgttggaggtggagtaggagtggatcgacgacgaactaaacgtagtcggacaaccaacaaccctactagacgacgtaacggtaaacgggtaccgggttccgggactaacggtaccttcccgttacgtacgaaccctaacgtacgaacctactacgtaaccgaaggaacggaccgtacgttaccgttacgggtagggacgtagacgtacggacggtcgtagtacctagtcgacggaaccgaccgtaccggtccttcgttacgtcgtggtaacggaaacgaaggggaacgttaaccgtaaacggtaacgttaccgttccggttaggtaaccggacggtcgggtaccggggaaccgttaacgggtaaccgttaacggtccgg

SEQ ID NO: 412921 - DNA, 535 bp, Homo sapiens
  misc_feature: GZ8MTXP02GHL8N.45.69.G03.1.454.CMB.2.raw
  modified_base (294)..(294): a, c, t, g, unknown or other
  modified_base (377)..(377): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctcagtgagggtctcctgcgcgacttcaggtctcgcctttacgagtcatggtttctgctggtgcgacaggccccgganaaggacttgagtggataggatggatcagcgacaaacgatggtgacacaccactatgacacagaagttccggggcagagtcctnttgaccactgacacataccacgaggacagcctacttggagtgatgagcctgacatctagacgacacggccgtctacttctgtcgacgaaggacgacgaaacgtacggaaaactcccgtagtcgaccgacgtcgggggaccacggggaacacgtaccgg

SEQ ID NO: 412922 - DNA, 566 bp, Homo sapiens
  misc_feature: GZ8MTXP02ISB9R.45.69.G03.1.454.CMB.2.raw
  modified_base (259)..(259): a, c, t, g, unknown or other
  modified_base (272)..(272): a, c, t, g, unknown or other
  modified_base (281)..(281): a, c, t, g, unknown or other
  modified_base (298)..(298): a, c, t, g, unknown or other
  modified_base (378)..(378): a, c, t, g, unknown or other
  modified_base (489)..(489): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctgggcctcagtgagggtctcctgcgcgacttcgaggtctcgcctttagngtcagtggtttcngcgtgggtncgacgacggccccgganaaggacttggagtggataggatggatcgagcgacaaaacagtggtagacacacactatgcagaggaacgttccggggganaggacgtccctacgttcgaacctactacgacacactccgaacgacgacacgcctaacgttgggagtgagtgacgcctgactatcgagaccgacaccgggcctcgtacttcnggtacgacgaaagggacgaccgtaaagtcggtaaactcccagtaacgacgacgtcggggaccagggaaccacgtcgg

SEQ ID NO: 412923 - DNA, 542 bp, Homo sapiens
  misc_feature: GZ8MTXP02J0R4P.45.69.G03.1.454.CMB.2.raw
  modified_base (295)..(295): a, c, t, g, unknown or other
  modified_base (377)..(377): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccggctggtgcagtctggagctgaggtgaagaagcctggggcctcagtgagggtctcctgcgcgacttcaggtctcgcctttacgagtcatggtttctgctgggtgcgacaggccccgganaaggcttgagtggataggatggatcgagcgacaaacatggtgacacacacctatgcacagaagttccggggcagacgtcctnttgaccatcgacacatccacgaggacagccctacgtggaggtgatgacgcctgacatcgtagaccgacgaccggccgttctacttcgtgtcgacgaaagggacgacaacgtaggaaactcccgtagtacgaacgacgtcgggggaccaaggggacacgtcgtccg

SEQ ID NO: 412924 - DNA, 559 bp, Homo sapiens
  misc_feature: GZ8MTXP02FUDBB.45.69.G03.1.454.CMB.2.raw
  modified_base (271)..(271): a, c, t, g, unknown or other
  modified_base (295)..(295): a, c, t, g, unknown or other
  modified_base (375)..(375): a, c, t, g, unknown or other
  modified_base (387)..(387): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctcagtgagggtctcctgcgcgacttcaggtctcgcctttacgagtcatggttcngctgggtgcgacacggccccgganaggactgagtggataggatggatcgagcgacaaacagtggtagaacacaccactatgacacaggaacggttccggggganaggacgtccctnttcgacctactagacacataccacgagacacgtacctacgtggagtgagtgacgtccgtgactatcgtcgacgacgacggtccgtcctacttcgtgtacgacgaaaggaacgacaaacgtacgaaactcccgtagtcgacgacggtacggggaccgaacgggacacgtacgg

SEQ ID NO: 412925 - DNA, 599 bp, Homo sapiens
  misc_feature: GZ8MTXP02IXYZI.45.69.G03.1.454.CMB.2.raw
  modified_base (219)..(219): a, c, t, g, unknown or other
  modified_base (272)..(272): a, c, t, g, unknown or other
  modified_base (279)..(279): a, c, t, g, unknown or other
  modified_base (298)..(298): a, c, t, g, unknown or other
  modified_base (336)..(336): a, c, t, g, unknown or other
  modified_base (349)..(349): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctnagtgagggtctcctgcgcgacttcaggtctcgcctttacgaatcatggtttcngcgtggngcgacgacggccccggaanaaggtacttggagtggaataggatggactcgagacganaaaacagtggtanaacaacaacctactagacgacacgaagtaacggtccgggacgagtacgtacctcgtacgacactacgacacacacacgacgacgacgactacgtaggagtagagtagacgacgtacgacactacgtacgacgacgacgtccgtacttacttcgttacgtacgacgaaacggaaacggaacgaaacgtaacgtaaaccgtaccgtacgtaacgaacgaacggtacgggaccggaacggaacgtaacgtacg

SEQ ID NO: 412926 - DNA, 563 bp, Homo sapiens
  misc_feature: GZ8MTXP02HBRGB.45.69.G03.1.454.CMB.2.raw
  modified_base (275)..(275): a, c, t, g, unknown or other
  modified_base (300)..(300): a, c, t, g, unknown or other
  modified_base (345)..(345): a, c, t, g, unknown or other
  modified_base (356)..(357): a, c, t, g, unknown or other
  modified_base (374)..(374): a, c, t, g, unknown or other
  modified_base (384)..(384): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctcagtgagggtctcctgcgcgacttcgaggtctcgtcctttacgagtcattggtttcngcgtggtgcgacgacggccccgganaaggcttggagtggataggatggatcgagcgacaaacagtggtanacacacactannacagagacgtccggggnagacgtcctnttacgaccatcgacacactaccgacgagacacgcctacgtggagtgagtgacgcctagactactcgtacgacgacgccggtaccgtctacgttctgtacgacgaaaggacgtacaaacgtacggtaaacctccgtagtcgacggacggtacggggaccgaacgggacctacggtaccgg

SEQ ID NO: 412927 - DNA, 660 bp, Homo sapiens
  misc_feature: GZ8MTXP02JFTGS.45.69.G03.1.454.CMB.2.raw
  modified_base (220)..(220): a, c, t, g, unknown or other
  modified_base (263)..(263): a, c, t, g, unknown or other
  modified_base (301)..(301): a, c, t, g, unknown or other
  modified_base (360)..(360): a, c, t, g, unknown or other
  modified_base (382)..(382): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagccgtggggcctnagtgagggtctcctgcgcgacttcgaggtctcgtcctttacgngtcattggttctgcgtgggtgcgacgacggccccgganaaggactgagtggataggatggatcgagcgacaaacgtagtggtagaacacaccactangacacgagaacggtccgggganaggtacgtccgtcttacgaccctacgtcgaaccaactactacccgacggacggaccacggtacccttaacgttagggaggtgtagtacggacgtaccgttagacctagttccgaggaccgtaaccggaccggtacccgttacgtttaccgttcgtacggttacggaaccggaaaaggggaacggaacgtaaacgtacgggtaaaaccttcccggtaggttaacggaaccggtacggggtaccgggggtaaccgaacggggaaccgtacggttaccggg

SEQ ID NO: 412928 - DNA, 651 bp, Homo sapiens
  misc_feature: GZ8MTXP02GKHA6.45.69.G03.1.454.CMB.2.raw
  modified_base (303)..(303): a, c, t, g, unknown or other
  modified_base (340)..(340): a, c, t, g, unknown or other
  modified_base (359)..(359): a, c, t, g, unknown or other
  modified_base (382)..(382): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccggctggtgcagtctggagctggaggtgaagaagccgtggggcctcagtgagggtctccgtgcgcgacttcaggtctcgtcctttagagtcagttggtttctgcgtgggtgcgacgacggccccgganaaggacttgagtggataggatggatcgagcgacaaanagtggtagacacacactancgacacgagtacggttccggggnaggacgttccctgttacgaccctagtacgaccacaactacccgaacggaacggaaccgacgtacccgttaacgttggggaaggttgaagttagacgtacccgtgaactagtaccgtacggaaccggtaacccgaccgggtcccgtaccgttaccgtttacgtacggttacggaacgaaacggggaaacggtacgtaaacggtacgtaaaacgtccgtaggtacgaaccggacggtacggggaccgaacggtaacgacgtacggtacccg

SEQ ID NO: 412929 - DNA, 569 bp, Homo sapiens
  misc_feature: GZ8MTXP02IBP2K.45.69.G03.1.454.CMB.2.raw
  modified_base (297)..(297): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctcagtgagggtctcctgcgcgacttcgaggtctcgcctttacgagtcatggtttctgctgggtgcgacacggccccgganaaggacttgagtggataggatggatcgagcgacaaacataggtgaacacaaccactatcgacacgaaggaacgttccgggggacaggacgttcctcgttgacctactgacacactccaacggagacacgtcctactgggagtgatgagcctgacagtctcgacgtacgaccggtccgttctacgttctggtacgaccgaaaggaacgacaaacgtacggaaacttccgtagtaacgacggacggtcggggaccgacggggaacacggtccgg

SEQ ID NO: 412930 - DNA, 527 bp, Homo sapiens
  misc_feature: GZ8MTXP02HKGBC.45.69.G03.1.454.CMB.2.raw
  modified_base (272)..(272): a, c, t, g, unknown or other
  modified_base (294)..(294): a, c, t, g, unknown or other
  modified_base (367)..(367): a, c, t, g, unknown or other
  modified_base (431)..(431): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctcagtgagggtctcctgcgcgacttcaggtctcgcctttacgagtcatggtttcngctggtgcgacaggccccgganaaggacttgagtggataggatggatcagcgacaaacatggtagacacacactatgcacagaagttccgggganagagtcctcttgaccactgacacactccacgagacagcctacgtggagtgagtgagctagactntactgacgacacggccgtctactcgtgtcgacgaaggacgacaacgtacggaaactcccgtagcgacgacggtcggggacgacgggactacgtcgg

SEQ ID NO: 412931 - DNA, 530 bp, Homo sapiens
  misc_feature: GZ8MTXP02J1A4X.45.69.G03.1.454.CMB.2.raw
  modified_base (296)..(296): a, c, t, g, unknown or other
  modified_base (370)..(370): a, c, t, g, unknown or other
  modified_base (523)..(523): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctcagtgagggtctcctgcgcgacttcaggtctcgcctttacgagtcatggtttctgctgggtgcgacaggccccggganaaggcttgagtggataggatggatcgagcgacaaacatggtgacacaccactatgacacaggagttccgggggnaggagtcctctcgaccactgacacatcccacgagacagctacttggagtgagtgacgctgacatcgtgacgacacggtccgtctacgttctgtcgacaaggacggacaacgtcggaaactcccgtagtcgacgacgtcggggaccagggaacncgtacgg

SEQ ID NO: 412932 - DNA, 744 bp, Homo sapiens
  misc_feature: GZ8MTXP02IJD29.45.69.G03.1.454.CMB.2.raw
  modified_base (275)..(275): a, c, t, g, unknown or other
  modified_base (302)..(302): a, c, t, g, unknown or other
  modified_base (388)..(388): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagccgtggggcctcagtgagggtctcctgcgcgacttcgaggtctcgcctttacgagtcattggtttcngcgtgggtgcgacgacggccccggganaaggactttggagtggataggatggatcgagcgacaaaacagtggtagacacaaccactatgacacaggtaacggttccggggganaaggtacgttcccgttacgttacggaaccctacgtacgaccaaccgacgtacccgaaacgggaacgggaaccgtaacggtaccccgttaacggttacgggggtaacgggttaggtaacgttacgggaaccgtacccgttaggaacctaacgttccgttacggaaacccggtaccgtaaccggggtccccgtttacgttaacccgtttcgttacggttacggaacggtaaaacggggaaacggtacccgtaaaaccggttaacggggtaaaaccttcccccggtttaggaaccggtaaccggtaaaccggttacgggggaacccgtaaacggggaaaccgttaccgtttacccgggg

SEQ ID NO: 412933 - DNA, 570 bp, Homo sapiens
  misc_feature: GZ8MTXP02H9WOM.45.69.G03.1.454.CMB.2.raw
  modified_base (258)..(258): a, c, t, g, unknown or other
  modified_base (270)..(270): a, c, t, g, unknown or other
  modified_base (296)..(296): a, c, t, g, unknown or other
  modified_base (377)..(377): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactccaggtccagctggtgcagtctggagctgaggtgaagaagcctggggcctcagtggagggtctctgcgcgacttcaggtctcgcctttagngtcatggtttcngcgtgggtgcgacgacggccccgganaaggcttgagtggataggatggatcgagcgacaaacagtggtagacacaccactatcgacacgaggaacggttccgggganagacgtcctcttcgacctactcgacacactcccgaacggagacagcctacgtgggagtcgatgacgctagactagtcgtagacgacgaccggtccgttacttaccgttctggtacgacgaagggaacacgaaacgtacgaaacttcccgaggtaacgacgacggtcggggaccgacggggaacctacgtccgg

SEQ ID NO: 412934 - DNA, 600 bp, Homo sapiens
  misc_feature: GZ8MTXP02I0LU7.45.69.G03.1.454.CMB.2.raw
  modified_base (300)..(300): a, c, t, g, unknown or other
  modified_base (346)..(346): a, c, t, g, unknown or other
  modified_base (358)..(358): a, c, t, g, unknown or other
  modified_base (363)..(363): a, c, t, g, unknown or other
  modified_base (378)..(378): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagccgtggggcctcagtgagggtctcctgcgcgacttcaggtctcgcctttacgagtcattggtttctgcgtgggtgcgacgacggccccgganaaggtacttgagtggataggatggatcgagcgacaaacagtggtanacacaccactangacanagaacgtccgggganagacgtcctctacgaccactacgacacactaccgaacgacggacacgtacctacgttgggaggtcgagtcgacgcctagactagtcgtacgaccggacgaccggtccgttaccttacgttcgtcgtacgaccgaaagggaacgacgaaacgtacggaaaccttcccgtagtaaccggacggtacggtcgggggaaccgaacggggtaacctacggttaccgg

SEQ ID NO: 412935 - DNA, 614 bp, Homo sapiens
  misc_feature: GZ8MTXP02H7X20.45.69.G03.1.454.CMB.2.raw
  modified_base (267)..(267): a, c, t, g, unknown or other
  modified_base (306)..(306): a, c, t, g, unknown or other
  modified_base (390)..(390): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtcccagctggtgcagtctgggagctgaggtagaagaagccgtggggcctcagtgagggtctcctgcgcgacttcgaggtctccgtcctttacgngtcattggtttctgcgtgggtgcgacgacggccccgganaggacttggagtggataggatggatcgagcgacaaacgagtggtagacacacactatcgacacgaaggaacggttccggggganaggtacgtccctacttcgaacctactacgacacacgtaccgaacggacggacacgtaccgttacgtggggagtgtaagtaggtacgctagacctagttcgacggaacgacgacggtcccgttactacgttacgtgtacgacgaaagggtaacggaccaacgtacggaacttcccgtagtaaccgtaacgacggtacggggaccgaacggggtaacacgttacgg

SEQ ID NO: 412936 - DNA, 546 bp, Homo sapiens
  misc_feature: GZ8MTXP02FNY0C.45.69.G03.1.454.CMB.2.raw
  modified_base (272)..(272): a, c, t, g, unknown or other
  modified_base (280)..(280): a, c, t, g, unknown or other
  modified_base (286)..(286): a, c, t, g, unknown or other
  modified_base (296)..(296): a, c, t, g, unknown or other
  modified_base (350)..(350): a, c, t, g, unknown or other
  modified_base (369)..(369): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccggctggtgcagtctggagctgaggtgaagaagcctggggcctcagtgagggtctcctgcgcgacttcaggtctcgcctttacgagtcatggtttcngctgggtncgacgnggccccgganaaggcttgagtggataggatggatcgagcgacaaacatggtagacacacactangacacagaagttccggggnagacgtcctacgttcgaaccacgtgacacactccgaagacggacacgcctacgttggagtgatgacgcctgactatcgagaccgacgaccggtccgtactacttcgtgtgacgaaggacgacaaacgtggaaactccgtagtacgaacgtacgcgggacagggacacgtcggtaccg

SEQ ID NO: 412937 - DNA, 559 bp, Homo sapiens
  misc_feature: GZ8MTXP02HE0U6.45.69.G03.1.454.CMB.2.raw
  modified_base (299)..(299): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccggctggtgcagtctggagctgaggtgaagaagccgtggggcctcagtgagggtctcctgcgcgacttcaggtctcgtcctttacgagtcatggtttctgctgggtgcgacgacggccccgganaaggcttggagtggataggatggatcgagcgacaaacagtggtgaacacacacctatcgacacagaacggttccggggcagtacgtcctacttcgaccactgacacactcccgacgaggacagtccctacgttggagtgagtgacgcctgacactcgtagacgacgcggtccgtctacttcgtgtcgacgaaggagcaaagtacggaactccgtagtacgaacgacggtcggggaccaagggacctacggtacggtaccc

SEQ ID NO: 412938 - DNA, 534 bp, Homo sapiens
  misc_feature: GZ8MTXP02I2VPF.45.69.G03.1.454.CMB.2.raw
  modified_base (280)..(280): a, c, t, g, unknown or other
  modified_base (295)..(295): a, c, t, g, unknown or other
  modified_base (368)..(368): a, c, t, g, unknown or other
  modified_base (377)..(377): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctcagtgagggtctcctgcgcgacttcaggtctcgcctttacgagtcatggtttctgctgggtncgacaggccccgganaaggcttgagtggataggatggatcagcgacaaacagtggtgaacacaccactatgacacagaagtccggggnagagtcctnttgaccatgacacactaccagagacagcctatcggagtgatgagcctgacagtctgacgacgacggcgtctacttctgtcgacgaaacggacggacgaacgtacggaaaactcccgtagtaacgacgacgtacggggaccgaacgggactacgtcgg

SEQ ID NO: 412939 - DNA, 656 bp, Homo sapiens
  misc_feature: GZ8MTXP02F7TBK.45.69.G03.1.454.CMB.2.raw
  modified_base (262)..(262): a, c, t, g, unknown or other
  modified_base (274)..(274): a, c, t, g, unknown or other
  modified_base (297)..(297): a, c, t, g, unknown or other
  modified_base (343)..(343): a, c, t, g, unknown or other
  modified_base (363)..(363): a, c, t, g, unknown or other
  modified_base (381)..(381): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagccgtggggcctcagtgagggtctccgtgcgcgacttcaggtctcgcctttacgngtcatggtttcngctggtgcgacgaggccccgganaaggacttggagtggataggatggatcgagcgacaaacgagtgganaacacaccgactatgacaanaggaacgttccggggganaaggtacgttccctcttacgaccctacgtacgaccaaccactacccgaacggaacgggaccaacgtacccttaacggtttagggagggttgaaagtcggaaacgtccctggaacctaagttccgtacgaaccggacgaaccgggtcccggttacttaccgttcgtcggtacgacggaaagggaacggactaaaccggtacgtaaaacgttccccgtaggtaacggacccgtaacgggtaccgggggaccgaaacgggtaaccgacgtttaccggg

SEQ ID NO: 412940 - DNA, 739 bp, Homo sapiens
  misc_feature: GZ8MTXP02GXWCZ.45.69.G03.1.454.CMB.2.raw
  modified_base (218)..(218): a, c, t, g, unknown or other
  modified_base (275)..(275): a, c, t, g, unknown or other
  modified_base (307)..(307): a, c, t, g, unknown or other
  modified_base (388)..(388): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagagccgtgggcctnagtgaggtctccgtgcgcgtacttcaggtctcgtcctttacgagtcagttggtttcngtcgtgggtcgcgaccgacggacccccggganaacggtacttggaggtgggaagtaggagtaggatacgagtaccggacaaaacgtagtaggtacgaacaacaccgtacttancggacaacggtaacggtaacgggtttcccgggggactaacgggtaccgttacccgttaccgttaacgaccccgtaacgtacgaaaccctaaacctaaccgtacccggaaaccggaaacgggaacccgtaaccggtaccccgtttaacgggttaggggtagggttacggtaaagtcggtaaaccggtccttaacggactaaacgttccgtaaccggaaccggaacccggtaccgggtacccgtttaccttaaccgtttcgtcggtacgaacggtaaaggggaaacgactaacgtaacggtaacctccgtagtaacgacgtacggtacggggaccgaacggactacggtacgg

SEQ ID NO: 412941 - DNA, 642 bp, Homo sapiens
  misc_feature: GZ8MTXP02J41Z9.45.69.G03.1.454.CMB.2.raw
  modified_base (223)..(223): a, c, t, g, unknown or other
  modified_base (333)..(333): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatcccttttcttggtggcagcagcaacaggtgcccactcccaggtccagctggtgcagtctggagctgaggtgaagagcctggggcctcagtnagggtctcctgcgcgacttcaggtctcgccttagagtcatgttcgtgcgtggtggcgacgacggccccgggaccgacgtacgtagtgtaggtagtacgtagtagtgtaancgacgacaacgtcaatacgagtcgtaccacactcactagtacgttacgcgaacgtaacggggtccgtcgtaacgtccgtaccttcggtaccgtacctacgtacaccgacgacaccgacgacgtacgacgaccgtacgtaggtaggtacggtacgttagacgtacgtacgacggactacgtacgtaccgtacgtaaccggtccgtaccgttaccgtacgttacgtacgtacggtaacggtaacgtaaccgtaacggtacgtaacgtacgtacggtaccgtacggtaccgtacggtacggttaacccgggg

SEQ ID NO: 412942 - DNA, 654 bp, Homo sapiens
  misc_feature: GZ8MTXP02IVPQY.45.69.G03.1.454.CMB.2.raw
  modified_base (295)..(295): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctggaggtgaagaagcctggggcctcagtgagggtctccgtgcgcgacttcaggtctcgcctttagagtcatggtttctgctggtgcgacaggccccgganaaggacttgagtggataggatggatcgagcgacaaacagtggtagacacaccactatgacacagaacgttccgggggcagacgtcctcgttcgacctactagacaccactaccgacgagacacgaccttaacgttgggaggtagagtaggacgtcccgttaggaacctacgttaccgttacggacccggtaaccgacccggggtaccccgtttaccgttaaccgtttcgtacggttacggtaccgaaaacgggggtaaacggtaccgaaacggttacgggaaaaccgttccccgtaggttaaccggaaccggtaccggttacgggggacccgtaaacggggaacctaacggttaccggg

SEQ ID NO: 412943 - DNA, 669 bp, Homo sapiens
  misc_feature: GZ8MTXP02GNC3Q.45.69.G03.1.454.CMB.2.raw
  modified_base (260)..(260): a, c, t, g, unknown or other
  modified_base (271)..(271): a, c, t, g, unknown or other
  modified_base (283)..(283): a, c, t, g, unknown or other
  modified_base (293)..(293): a, c, t, g, unknown or other
  modified_base (377)..(377): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctcagtgagggtctcctgcgcgacttcgaggtctcgcctttagngtcatggttcngctggtgcgacnggccccgganaaggcttgagtggataggatggatcgagcgacaaacagtggtagacacaccactatcgacaacgaggtaacggttccggggganacggtacgtccctgttacgacctactgacacactccgaaggacggacacgacctacgttagggaggtgaaagtggaaacgtcccgtaggaacctagttaccgacggaaccgtaaccgaaccggggtcccgtttaccttacgtttaccgttcggttacggaaccggtaaaaggggaaacgggacctaaaaccggttacggggtaaaaaccttcccccgttagggtaacggaaacccggtaacggggttaccgggggaacccgaaacgggggtaaaccaacggtttacccgggg

SEQ ID NO: 412944 - DNA, 528 bp, Homo sapiens
  misc_feature: GZ8MTXP02FH038.45.69.G03.1.454.CMB.2.raw
  modified_base (348)..(348): a, c, t, g, unknown or other
  modified_base (366)..(366): a, c, t, g, unknown or other
  modified_base (375)..(375): a, c, t, g, unknown or other
  modified_base (430)..(430): a, c, t, g, unknown or other
  modified_base (452)..(452): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctcagtgagggtctcctgcgcgacttcaggtctcgcctttacgagtcatggttctgctgggtgcgacaggccccgggacaaggacttgagtggataggatggatcagcgcaaacatggtgacacaccactangcacagaagttccggggnagagtcctnttgaccactgacacatcacgaggacagcctacttggagtgatgagcctgacatcngacgacacggccgtctacttcngtcgcaaagggaacggcaaacgtacgggaaaactcccctagtcgacgacgtcgggggccaggggaactactacggg

SEQ ID NO: 412945 - DNA, 624 bp, Homo sapiens
  misc_feature: GZ8MTXP02HWYK2.45.69.G03.1.454.CMB.2.raw
  modified_base (277)..(277): a, c, t, g, unknown or other
  modified_base (303)..(303): a, c, t, g, unknown or other
  modified_base (361)..(361): a, c, t, g, unknown or other
  modified_base (385)..(385): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctggaggtgaagaagccgtggggcctcagtgagggtctctgcgcgacttcgaggtctcgtcctttagagtctagttggtttcnggcgtgggtgcgacgcggccccgganaggacttggagtggataggatggatcgagcgacaaacagtggtacgacacacactagngacacaaggtacggttccgggganaaggtacctcccgttacgtcgaaccctactacgaacctaccgaatacccgaacggaacgggacctacggtccttaacggttgggaggtagtaacgttggaccgcgttagactagtcgtacgaaccgacggtacccggtccttaccgtactttccgagttacgacggtaaaggacggactaaacggacgtaaaccgtcgtagtaacgacgacggtcggggaccgaacgggacaacggtcg

SEQ ID NO: 412946 - DNA, 616 bp, Homo sapiens
  misc_feature: GZ8MTXP02G6YO8.45.69.G03.1.454.CMB.2.raw
  modified_base (298)..(298): a, c, t, g, unknown or other
  modified_base (377)..(377): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctcagtgagggtctccgtgcgcgacttcgaggtctcgcctttagagtctagtggtttctgctgggtgcgacaggccccgganaaggcttggagtggataggatggatcagcgacaaacatggtagacacaccactatcgacacagaacggttccggggganagacgtcctcgttacgacccacgtacgaccaactactaccgaacggaggacacgccttacgtggaggtgatggagtccgtagacagttcacggaaccgacgaccggtccggttacttaccgtttcgtcggtacggaccgaaagggaacggtacgtaaacgtacgggtaaaactcccgttaaggaaccgtaacgggtaccggtacgggggacccgaaacgggaaccgtacggttacccgg

SEQ ID NO: 412947 - DNA, 530 bp, Homo sapiens
  misc_feature: GZ8MTXP02FV3ML.45.69.G03.1.454.CMB.2.raw
  modified_base (295)..(295): a, c, t, g, unknown or other
  modified_base (349)..(349): a, c, t, g, unknown or other
  modified_base (377)..(377): a, c, t, g, unknown or other
  modified_base (453)..(453): a, c, t, g, unknown or other
  modified_base (492)..(492): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctcagtgagggtctcctgcgcgacttcaggtctcgcctttacgagtcatggttctgctgggtgcgacaggccccggganaaggacttgagtggataggatggatcagcgcaaacaatggtagacacacactangcacagaagttccgggggcagagtcctnttgaccactgacacatcacgagacagcctacttggagtgatcgagctgacagtcacgacgacacggctctacttcngtgacaagggaacggcaaactcggaaaactcccgttagngaccggtaagcgggggacccaaggggaactcgtacggg

SEQ ID NO: 412948 - DNA, 596 bp, Homo sapiens
  misc_feature: GZ8MTXP02JOVB2.45.69.G03.1.454.CMB.2.raw
  modified_base (272)..(272): a, c, t, g, unknown or other
  modified_base (280)..(280): a, c, t, g, unknown or other
  modified_base (326)..(326): a, c, t, g, unknown or other
  modified_base (337)..(337): a, c, t, g, unknown or other
  modified_base (348)..(348): a, c, t, g, unknown or other
  modified_base (556)..(556): a, c, t, g, unknown or other
tcagacgcgatcgacacgaccggtgctcgatttagtcgctgcgtaaaggagaaaggggacccaaaaaccacacccctcctcgggagaatctcctagatcacagctcctcaccatggactggacctggagcatccttttcttggtggcagcagcaacaggtgcccactcccaggtccagctggtgcagtctggagctgaggtgaagaagcctggggcctcgagtgagggtctcctgcgcgacttcaggtctcgcctttacgagtcatggttcngctgggtncgacacggccccggaaaggcttgagtggataggatggatcagcganaaacagtggtnacacacactancgacaacgagtacggttccggggataggacgttcctcgtttcgacccactagaaccactacgtcccaacggacgaccgacggtacccttaagttaggggaggttacggattagggacgtcctagaccgagttcgacggaacgacgaccggtccgttactcctcgtaggtcgacgaaagggacgtaccaaagttacggaaacttcccgnggtacgaccggtacggcggggaccgaacgggtacgtacgg

SEQ ID NO: 412949 - DNA, 669 bp, Homo sapiens
  misc_feature: GZ8MTXP02FRMUI.45.69.G03.1.454.CMB.2.raw
tcagacgcgatcgacacgaccggtgctcgatttagtcgctgcgtaaaggagaaaggggacccaaaaaccacacccctcctcgggagaatcccctagatcacagctcctcaccatggactggacctggagcattccttttcttggtggcagcagcaacaggtgcccactcccaggtccagctggtgcagtctggagctgaggtgaagagccgtggggcctcagtggagggtctcctgcgcgacttcgaggtctcgtcctttacgagtctattggttctgctgggtgcgacgcgggccccggagaaggacttggagtggagtaggatggatcgaggaccgacaaaacgagtcggtagacaacaccgtactagtcgaccaacgaaggtaaacgggtttcccgggggactaaacggtaccgttccccgttacgttacgaacccgtactacgaaccaacgacctacccgaacggaagggtaccacgtacccgttaacgttgggacggtgtagtgacgcgtagactagtactcggaccgacgtacggtcccgttactacttcgtagacgtaacggaaacggtaacggaaccgtaaacgtaacgaaaaccttcccgttaggtaacggaacggtacggtacgggggaaccgaaacggggtaaccgtccgttaaccgg

SEQ ID NO: 412950 - DNA, 607 bp, Homo sapiens
  misc_feature: GZ8MTXP02FRBTK.45.69.G03.1.454.CMB.2.raw
  modified_base (309)..(309): a, c, t, g, unknown or other
  modified_base (371)..(371): a, c, t, g, unknown or other
  modified_base (396)..(396): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagccgtggggcctcagtggagggtctccgtgcgcgtacttcgaggtctcgtcctttacgagtctagttggtttctgcgtgggtgcggacgacggccccggaanaaggtacttggagtggagtaggatggatcgagcgacaaacgagtggtagacacaaccactangacacgaaggtaacggtccgggganacggtacgtccctcgttacgacctagtacgactacactaccgaacggagacacgtccgttacgtggagtgagtcgagcctagacagtcgtacgacgaccgaccggtcctactacgttcgagtacgacgaaaggacgtaacgaacgtagtaaacctccgtaggaacgtaccgggaacggtaccggggacgtaacggggaacctacggtaccg

SEQ ID NO: 412951 - DNA, 543 bp, Homo sapiens
  misc_feature: GZ8MTXP02FK8F8.45.69.G03.1.454.CMB.2.raw
  modified_base (194)..(194): a, c, t, g, unknown or other
  modified_base (352)..(352): a, c, t, g, unknown or other
  modified_base (468)..(468): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctgganctgaggtgaagaagccgtggggcctcagtgagggtctcctgcgcgacttcaggtctcgcctttacgagtcagtggtttctgctgggtgcgacacggccccggacaaggacttgagtggataggatggatcagcgcaaacatggtagacacaccactangacacagaagttccggggcagagtcctcttacgaccatcgacacactaccgacgagacacgtcctacgttggagtgagtgagccgtgacatctacgacgacacggcctctacttcncgtcgacgaaggaacgacaacgtacgaaaactccgtagcgacgacgtacggggacctaacgggaaccacgtacgg

SEQ ID NO: 412952 - DNA, 589 bp, Homo sapiens
  misc_feature: GZ8MTXP02FJ0MR.45.69.G03.1.454.CMB.2.raw
  modified_base (376)..(376): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctcagtgagggtctcctgcgcgacttcaggtctcgcctttacgagtcatggttctgctggtgcgacacggccccggacgaaggcttgagtggataggatggatcgagcgacaaaacgatggtgacacaccactatgacacgaaggaacggttccgggggnaaggcgtccctcttagaccactcgactacactaccgacggaggacacgtacctacgttggacgtgagtgacgctagacagtcgtacgaccgacgtaccgggtcccgttactactttcgtgttacggacgtaaagggaacgacgaaacgtacgtaaacgtcccgttagaacggaaccggaccgtacggggaccgaacggggaacacggtaccgg

SEQ ID NO: 412953 - DNA, 599 bp, Homo sapiens
  misc_feature: GZ8MTXP02GP89K.45.69.G03.1.454.CMB.2.raw
  modified_base (218)..(218): a, c, t, g, unknown or other
  modified_base (274)..(274): a, c, t, g, unknown or other
  modified_base (300)..(300): a, c, t, g, unknown or other
  modified_base (359)..(359): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtgcagtctggagctgaggtgaagagccgtgggcctnagtgaggtctcctgcgcgacttcaggtcctcgtcctttacgagtcagttggtttcngcgtgggtgcgacgacggccccgganaggtcttgagtggataggatggatcgagcgacaaacgagtggtacgaacacaccactangacagagacgggttccggggacaggtacgtcctctacgacctacgtagacaacactacccgaagacggaactcgtaccttacggtgggagtagagtagacgtccgtagactagtcacgtacgaccgtaccggtcctacttacgtcgttacggacgaacgaaaggtacgacctaaacggttacggaaaccttcccgtaggaacgacggacggtacgggacgaacggacctacggtacccgg

SEQ ID NO: 412954 - DNA, 651 bp, Homo sapiens
  misc_feature: GZ8MTXP02JUR4J.45.69.G03.1.454.CMB.2.raw
  modified_base (184)..(184): a, c, t, g, unknown or other
  modified_base (218)..(218): a, c, t, g, unknown or other
tcagacgcgatcgacacgaccggtgctcgatttagtcgctgcgtaaaggagaaaggggacccaaaaaccacacccctcctcgggagaatcccctagatcacagctcctcaccatggactggacctggagcatccttttcttggtggcagcagcaacaggtgcccactcccaggtccagctggtncagtctggagctgaggtgaagagccgtgggcctnagtgaggtcctccgtgcgcgacttcgagtctcgcctttagagtcagttggttctgtcgtggtgccgacgcgggaccccggagaaggtacttaggacgtaggagtaggatggatcggagacgaacaaacgagttggacgacgtaacaccgtaactagacgaccgagaacggtaacggttccggggactaaggtacgttaccgtcgttaacgaccctaacgtccgaaaccaaccgtacgtaacccgaacggaacggaccgaacgtacccgtacggttaaggggtacgtagtagtagacgtaccgtagactatacgcgaacgacgaccgggtctaccttacgtacgagtacgacgaagggaacgtacgaaacgtacgggaaacctccgtagtcggaaccgtacggacggggaccgaacggacctacggtaacccgg

SEQ ID NO: 412955 - DNA, 489 bp, Homo sapiens
  misc_feature: GZ8MTXP01E0T9A.44.65.F10.1.454.CMB.2.raw
  modified_base (351)..(351): a, c, t, g, unknown or other
  modified_base (453)..(453): a, c, t, g, unknown or other
  modified_base (475)..(475): a, c, t, g, unknown or other
  modified_base (481)..(481): a, c, t, g, unknown or other
  modified_base (488)..(488): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggctcccaggctcctcatctatggtgcatccacagggccatggtatcccagccaggttcagtggcagtgggtctgggaacagngttcactctcaccatcagcagcctgcagtctgaagtatttgctagtttattactgtcagcagtataatgactggcctccgtcgccaagggcaacgcttgganataaacgaacttgttggctgcnccatcngtcttcnc

SEQ ID NO: 412956 - DNA, 495 bp, Homo sapiens
  misc_feature: GZ8MTXP01BXU37.44.65.F10.1.454.CMB.2.raw
  modified_base (293)..(293): a, c, t, g, unknown or other
  modified_base (355)..(355): a, c, t, g, unknown or other
  modified_base (457)..(457): a, c, t, g, unknown or other
  modified_base (481)..(481): a, c, t, g, unknown or other
tcagacagtatatacacgaccggtgctcgatttagctacgctctaaggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggctcccaggctcctcatctatggtncatccacagggccactggtactcccagccaggttcagtcggcaggtgggtctggggaacagngttcactctcaccatcagcagcctgcagtctagaagtatttgctagtttatactgtcagtcagtataatgactggcctccgtcgcaagggcaacgcttgganattaaacgattgttggctgcaacntcttgtcttctaac

SEQ ID NO: 412957 - DNA, 516 bp, Homo sapiens
  misc_feature: GZ8MTXP01DGPRL.44.65.F10.1.454.CMB.2.raw
  modified_base (269)..(269): a, c, t, g, unknown or other
  modified_base (278)..(278): a, c, t, g, unknown or other
  modified_base (290)..(290): a, c, t, g, unknown or other
  modified_base (347)..(347): a, c, t, g, unknown or other
  modified_base (361)..(361): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaccagcaacttagcctggtaccacagaacctggcaggcnccaggctcnatctatggaacntccaccagggccactggtactccccacccaggttcagtggcaggtgggtccccgganagagttcactctcnccatcagcgcctgcagtctgaggtatttgctagtttattactgtcagcagtataataacgtggcctctcacgttcgggcgggggacaagggtgagatacaaagaactgttggcttgcacattcttgttcttcaacttctcccgctaacttctaag

SEQ ID NO: 412958 - DNA, 492 bp, Homo sapiens
  misc_feature: GZ8MTXP01D1PLS.44.65.F10.1.454.CMB.2.raw
  modified_base (293)..(293): a, c, t, g, unknown or other
  modified_base (356)..(356): a, c, t, g, unknown or other
  modified_base (469)..(469): a, c, t, g, unknown or other
  modified_base (478)..(478): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccacctctcctgcagggccagtcagagtgttagcagcaacttagcctcgtaccagcagaaatctggccaggctcccaggctcctcatctatggtncatcccaccagggccactggtactcccagccaggttcagtcggcagtgggtctggggaacagngttcactctcaccatcagcagcctgcagtctagaagtatttgctagtttatactgtcagtcagtataatgactggcctcctggccaagggcaagcttggagataaacgattgngctgcaacntcttgtcttctaac

SEQ ID NO: 412959 - DNA, 523 bp, Homo sapiens
  misc_feature: GZ8MTXP01EQ3SA.44.65.F10.1.454.CMB.2.raw
  modified_base (361)..(361): a, c, t, g, unknown or other
  modified_base (374)..(374): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagagccaccctctcctgcagggccagtcagagtgttagcagcaacttagcctcgtaccagcagaaatctggccaggctcccaggcctcctcatctatggtgcatcccaccgagggcccactggtactcccagccaggttcagtcggcaggtgggtctgggaacagngttcactctcacntcagcagcctgcagtctagagtattttgactagtttattactgtacgagtactagtaataatgacttggacccttccgtcggacagggcaacggacttaggattaagttaaacgacgttgttggctgcaactatcttcgtcttctaacc

SEQ ID NO: 412960 - DNA, 534 bp, Homo sapiens
  misc_feature: GZ8MTXP01DCGET.44.65.F10.1.454.CMB.2.raw
  modified_base (196)..(196): a, c, t, g, unknown or other
  modified_base (293)..(293): a, c, t, g, unknown or other
  modified_base (358)..(358): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaanagccacctctcctgcagggccagtcagagtgttagcagcaacttagcctcgtaccagcagaaatctggccaggctcccaggctcctcatctatggtncatcccaccagggccactggtactcccagccaggttcaggtcggcaggtgggtctggggaacagngttcactctcaccatcagcagcctgcagtctagtaagtattttgcttagtttattactgtcagctaagtataatgacttggacccttcccgttcggaccgaacggggacaacggtacgttgggaagttaacgttaaacgacgttggttggctggcaactatcttgttcttcgtaac

SEQ ID NO: 412961 - DNA, 512 bp, Homo sapiens
  misc_feature: GZ8MTXP01AN0RD.44.65.F10.1.454.CMB.2.raw
  modified_base (194)..(194): a, c, t, g, unknown or other
  modified_base (348)..(348): a, c, t, g, unknown or other
  modified_base (385)..(385): a, c, t, g, unknown or other
  modified_base (485)..(485): a, c, t, g, unknown or other
tcagacagtatatacacgaccggtgctcgatttagctacgctctaaggggaggaactgctcagttaggacccagacggaaccatggaagcccagcgcagcttctcttcctcctgctactctggctcccagataccactggagaaatagtgatgacgcggtctccagccaccctgtctgtgtctccaggggaaangccaccctctcctgcagggccagtcagagtgttagcagcaacttagcctcgtaccagcagaaatctggccaggctcccaggctcctcatctatggtgcatccacagggccactggtactccagccaggttcagtggcagtggtctgggaacagngttcactctcaccatcagcagcctgcagtctagagtntttgctagtttatactgtcagctagtaataatgactggtccctacccgttcggacccaaaggggccaacggacttgggaagaagttaaacggaacttggnggctgcaaccagtccttgtccttcaac

SEQ ID NO: 412962 - DNA, 531 bp, Homo sapiens
  misc_feature: GZ8MTXP01EMPS6.44.65.F10.1.454.CMB.2.raw
  modified_base (195)..(195): a, c, t, g, unknown or other
  modified_base (269)..(269): a, c, t, g, unknown or other
  modified_base (281)..(281): a, c, t, g, unknown or other
  modified_base (351)..(351): a, c, t, g, unknown or other
  modified_base (365)..(365): a, c, t, g, unknown or other
  modified_base (499)..(499): a, c, t, g, unknown or other
  modified_base (511)..(511): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaangccaccctctcctgcagggccagtcagagtgttaccagcaacttagcctggtaccacagaaacctgggcaggcncccaggctcctnatctatggaacatccaccagggccactggtactccccacccaggttcagtggcaggtcgggtccccgganagagttcactctcnccatcagcgcctgcagtctgaggtatttgctagtttattactgtcagcagttaataataacgtcggtacctctctacgttcgggcgggggtaccaagggtggagatacgaaacgaactgttggcttggcaccgnttcttgtcttcncttccttcccgctaattctg

SEQ ID NO: 412963 - DNA, 523 bp, Homo sapiens
  misc_feature: GZ8MTXP01BPHKL.44.65.F10.1.454.CMB.2.raw
  modified_base (204)..(204): a, c, t, g, unknown or other
  modified_base (367)..(367): a, c, t, g, unknown or other
  modified_base (502)..(502): a, c, t, g, unknown or other
tcagacagtatatacacgaccggtgctcgatttagctacgctctaaggggaggaactgctcagttaggacccagacggaaccatggaagcccagcgcagcttctcttcctcctgctactctggctcccagataccactggagaaatagtgatgacgcagtctccagccaccctgtctgtgtctccaggggaaatagccaccctntcctgcagggccagtcagagtgttaccagcaacttagcctggtaccaccagaaacctgggcaggctcccaggctcctcatctatggaacatccaccagggcccactggtactccccacccaggttcagtggcagtcgggtccccgggacagagttcactctcnccatcagcggcctgcagtctgaggtatttgctagtttattactgtcagcagtataataacgtggacctctctacttcggcgggggacaagggtgtagatacgaaagaactgttaggcttggcacagttcttagtntcaatcttccgctaattctaa

SEQ ID NO: 412964 - DNA, 523 bp, Homo sapiens
  misc_feature: GZ8MTXP01AJ5UL.44.65.F10.1.454.CMB.2.raw
  modified_base (196)..(196): a, c, t, g, unknown or other
  modified_base (272)..(272): a, c, t, g, unknown or other
  modified_base (355)..(355): a, c, t, g, unknown or other
  modified_base (484)..(484): a, c, t, g, unknown or other
  modified_base (492)..(492): a, c, t, g, unknown or other
  modified_base (494)..(494): a, c, t, g, unknown or other
  modified_base (507)..(507): a, c, t, g, unknown or other
  modified_base (518)..(518): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttaccagcaacttagcctggtaccaccagaaacctgggcaggcncccaggctcctcatctatggaacatcccaccagggccactggtactcccacccaggttcagtggcaggtcggggtccccgganagagttcactctcaaccatcagcgctgcagtctgagtatttgctagtttatactgtcagctagtataatacgtggtcctctcgtacgtttcgggcgggggaccgagggtggagatacgaaacgaactgnggcttgcncngttcttgtcttcnctctcccgctnttctg

SEQ ID NO: 412965 - DNA, 598 bp, Homo sapiens
  misc_feature: GZ8MTXP01DWVLW.44.65.F10.1.454.CMB.2.raw
  modified_base (194)..(194): a, c, t, g, unknown or other
  modified_base (203)..(203): a, c, t, g, unknown or other
  modified_base (256)..(256): a, c, t, g, unknown or other
  modified_base (264)..(264): a, c, t, g, unknown or other
  modified_base (272)..(272): a, c, t, g, unknown or other
  modified_base (282)..(282): a, c, t, g, unknown or other
  modified_base (300)..(300): a, c, t, g, unknown or other
  modified_base (336)..(336): a, c, t, g, unknown or other
  modified_base (348)..(348): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccacctgtctgtgtctcgaggggaangccaccctntcctgcagggccagtcagagtgttaccagcaacttgcctggaccacagaaccnggcaggcnccagctcnatctatgacntccacaggccatggtacnccccaccaggttcagtcggcaggtgggtccccgganagagttcactcncaacatcagcgcctgctagtctgaggtatttgctagtttatactgtctagctaagtaataagttaacgtcgggtccttcttaccgtaccggttttccggggcggggggtaacccgtaaagggggtcggaaggtaacttaacggaaaacggtaacgttggttacgggcgttacggacctaacccgttagttccgttcggttaacctttacgtaactttccccgtttccccggacctaacgttccgttaagg

SEQ ID NO: 412966 - DNA, 573 bp, Homo sapiens
  misc_feature: GZ8MTXP01CO8M3.44.65.F10.1.454.CMB.2.raw
  modified_base (196)..(196): a, c, t, g, unknown or other
  modified_base (270)..(270): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccaccctctcctgcagggccagtcagagtgttagcagcaacttagcctggtaccaccagaacctgggcaggcncccaggctcctcatctatggaacatcccaccgagggcccaactggtactccccacccgtaggttccagtcggcgaggtcggggtccccgggacaggagttccacgtcctcaacccgatccgagccggcctggcagtcgtgaggtatttgctagtttattactgtcagtcagtataagttaacgtggtcctctcgtacgtttcgggcgggggtacctaagggtggagacgtacgaaacgtaacgtgttgggtcttggactacattcttcgtcttctaacttccgttccgcctaacgttcgtaag

SEQ ID NO: 412967 - DNA, 554 bp, Homo sapiens
  misc_feature: GZ8MTXP01AY8RH.44.65.F10.1.454.CMB.2.raw
  modified_base (197)..(197): a, c, t, g, unknown or other
  modified_base (292)..(292): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangccaccctctcctgcagggccagtcagagtgtagcagcaacttgcctgtaccagcagaaatctggccaggctcccaggcctcctcatctatggtncatcccaaccgagggccacgtggtactcccgagccaggttcaggtcggcaggtgggtctggggaacaggtgttcactctcacatcagcagcctgcagtctagaagtatttgacttagtttatactgtacagtctaagtataaagtgacgtcggtcccttcccgttcgggacctaaaggggccaacggtacgttgggaaagttaagttaaaacgaacttggttcggactaagccctaacgtacttcttcgttccttcgtaacc

SEQ ID NO: 412968 - DNA, 494 bp, Homo sapiens
  misc_feature: GZ8MTXP01DN0VK.44.65.F10.1.454.CMB.2.raw
  modified_base (205)..(205): a, c, t, g, unknown or other
  modified_base (269)..(269): a, c, t, g, unknown or other
  modified_base (353)..(353): a, c, t, g, unknown or other
  modified_base (477)..(477): a, c, t, g, unknown or other
  modified_base (480)..(480): a, c, t, g, unknown or other
  modified_base (489)..(489): a, c, t, g, unknown or other
tcagacagtatatacacgaccggtgctcgatttagctacgctctaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaatagccaccctntcctgcagggccagtcagagtgttaccagcaacttagcctggtaccacagaacctgggcaggcnccaggctctcatctatgaacatccacaggccatggtactcccaccaggtcagtgcagtgggtccccggacagagttcactctcnccatcagcgcctgcagtctgagtatttgctagtttatactgtcagcagtataataacgtggctctcgtacgttcggcgggggacaaggtgagatcaaacgaactgttgcttgcacattcttgtntcntctccgctnttctg

SEQ ID NO: 412969 - DNA, 511 bp, Homo sapiens
  misc_feature: GZ8MTXP01DRA4A.44.65.F10.1.454.CMB.2.raw
  modified_base (198)..(198): a, c, t, g, unknown or other
  modified_base (265)..(265): a, c, t, g, unknown or other
  modified_base (286)..(286): a, c, t, g, unknown or other
  modified_base (296)..(296): a, c, t, g, unknown or other
  modified_base (353)..(353): a, c, t, g, unknown or other
  modified_base (392)..(392): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagngcccaccctctcctgcagggccagtcagagtgttagcagcaacttagcctcgtaccagcagaaatcnggccaggctcccaggctcctnatctatggtncatccacagggccactgtactcccagccaggtcagtcgcagtgggtctgggaacagngttcactctacaccatcagcagcctgcagtctagaagtntttgctagtttatactgtcagctagtataatgactggaccctccgtcggaccaaagggcaacgacgttaggaagaagttaaacgaacttggttcggctgccaacatcttgtcttctaac

SEQ ID NO: 412970 - DNA, 554 bp, Homo sapiens
  misc_feature: GZ8MTXP01COUAL.44.65.F10.1.454.CMB.2.raw
  modified_base (196)..(196): a, c, t, g, unknown or other
  modified_base (289)..(289): a, c, t, g, unknown or other
  modified_base (313)..(313): a, c, t, g, unknown or other
  modified_base (343)..(343): a, c, t, g, unknown or other
  modified_base (394)..(394): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccaccctctcctgcagggccagtcagagtgtagcagcaacttgcctcgtaccagcagaatctggcaggctcccaggctcctcatctatggtncatcccaccagggccactggtacncccagccaggttcaggtcggcaggtggtcnggggaacaggtgttcactctcaccatcagcagcctgcagttctagaagttntttgacttagtttacttacgtgttacgagtctaagtactaatcgacgttcggcccttcccgttcggaccgtaagggacctaacggtacttgggaacgttaagtttaaacggacttggttcggccttaagcccaacgtactcgttacgttccttcgtaacg

SEQ ID NO: 412971 - DNA, 589 bp, Homo sapiens
  misc_feature: GZ8MTXP01BEC92.44.65.F10.1.454.CMB.2.raw
  modified_base (198)..(198): a, c, t, g, unknown or other
  modified_base (295)..(295): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagngccaccctctcctgcagggccagtcagagtgttagcagcaacttagcctcgtaccagcagaaatctggccaggcctccaggctcctcatctatggtncatcccaccgagggccacgtggtactcccagccaggttcaggtcggcaggtgggtctggggaacagtgttcacgttctacaccatcagcagcctgcagtctagaagttatttgcttagtttatactgtcaagtctaagttataatcggtacctcggggtacccctttccccgttacgggacccgtaaagggggccctaaaccggtacgttacggggaaagttaaacgtttaaaacggacgtttagggcggttacctggacctaactacgttcttcgttaacctttcgtaacccg

SEQ ID NO: 412972 - DNA, 581 bp, Homo sapiens
  misc_feature: GZ8MTXP01AG4GQ.44.65.F10.1.454.CMB.2.raw
  modified_base (197)..(197): a, c, t, g, unknown or other
  modified_base (294)..(294): a, c, t, g, unknown or other
  modified_base (306)..(306): a, c, t, g, unknown or other
  modified_base (322)..(322): a, c, t, g, unknown or other
  modified_base (404)..(404): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangccaccctctcctgcagggccagtcagagtgtagcagcaacttgcctcgtaccagcaagaaatctggccaggcctcccaggctcctcatctatggtncatccccaccgngggcccacgtggtacnccccagcctaggttcaggtcggcaggtgggtctggggaacaggtgttcacttctacaccatcagcagcctgcagtcagaatntttgacttagtttattactgtacagctaagttactaagtgacgtcggtacccctcccgttcgggacctaaaggggcaaccggagttagggtaaacgttaaacgtttaaaccggaacgttgggttcggttaccgtggaccctaaccgtactttcgttcgttaacccttgttaaccccg

SEQ ID NO: 412973 - DNA, 522 bp, Homo sapiens
  misc_feature: GZ8MTXP01A0OEF.44.65.F10.1.454.CMB.2.raw
  modified_base (196)..(196): a, c, t, g, unknown or other
  modified_base (206)..(206): a, c, t, g, unknown or other
  modified_base (268)..(268): a, c, t, g, unknown or other
  modified_base (278)..(278): a, c, t, g, unknown or other
  modified_base (289)..(289): a, c, t, g, unknown or other
  modified_base (362)..(362): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangcccaccctntcctgcagggccagtcagagtgtaccagcaacttgcctggtaccacagaacctgggcaggcnccaggctccnatctatgaacntccaccagggcccatggtactccccaccgaggttcagtggcaggtcgggtccccggacaggagttcactctcncatcagcgctgcagtctgaggtatttgctagtttatactgtcagacagtaataataacgtcggcctactcgtacgttcgggcgggggtacagggtgagactacgaaacgaactgttgacttgactacattcttgtctcaactcctaccgctaattcgtaa

SEQ ID NO: 412974 - DNA, 526 bp, Homo sapiens
  misc_feature: GZ8MTXP01DR0W3.44.65.F10.1.454.CMB.2.raw
  modified_base (197)..(197): a, c, t, g, unknown or other
  modified_base (270)..(270): a, c, t, g, unknown or other
  modified_base (352)..(352): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttaccagcaacttgcctggtaccacagaaacctgggcaggcncccaggctctcatctatgaacatccacagggccactggtactccccaccctaggttccagtcggcaggtcgggtccccgganagagttcactctcaaccatcagcggcctgcagtctgagtattgctagtttattactgtcagcagtataataacgtgaccttctcgtacgttcgggcgggggaccaagggtgaagatacaaacgaactggttggcttgcacagttcttgtcttcaacttcctccgctaattctaa

SEQ ID NO: 412975 - DNA, 574 bp, Homo sapiens
  misc_feature: GZ8MTXP01CXSQ3.44.65.F10.1.454.CMB.2.raw
  modified_base (197)..(197): a, c, t, g, unknown or other
  modified_base (364)..(364): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangcccacctctcctgcagggccagtcagagtgtagcagcaacttgcctcgtaccagcagaatctggccaggcctcccgaggcctcctcatctagtggtgcatcccaccgagggcccagtggtactcccgagcctaggttcaggtcggcaggtgggtctggggaacagngttcactctcaccatcagcagcctgcagtctagagtatttcgacttagtttattacgtgtacgagtctaaggttataagtcgtacgtcgggtaccccttcccgttcggaccgtaacgggtcctaacggtacgttagggtaacgttaagttaaaaccgacgttggttcgacgttcggacctaacgtacgtcttacgttccttcgtaacccg

SEQ ID NO: 412976 - DNA, 558 bp, Homo sapiens
  misc_feature: GZ8MTXP01DM15Z.44.65.F10.1.454.CMB.2.raw
  modified_base (196)..(196): a, c, t, g, unknown or other
  modified_base (205)..(205): a, c, t, g, unknown or other
  modified_base (269)..(269): a, c, t, g, unknown or other
  modified_base (279)..(279): a, c, t, g, unknown or other
  modified_base (285)..(285): a, c, t, g, unknown or other
  modified_base (512)..(512): a, c, t, g, unknown or other
  modified_base (540)..(540): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccacctgtctgtgtctccgaggggaaangccaccctntcctgcagggccagtcagagtgttaccagcaacttgcctggtacccacagaacctgggcaggcnccaggctctnatctangaacatccacagggccactggtactcccaaccgtggttcagtggcaggtcggggtaccccgggactaggacgtttcacctaccgtcaaccatccgaaggccggcctgcagtctaggtaggttatttgacttagtttaattacgtgtacagactaagttaataacgtaacgtcggtcttctacgtacgttcggggcggggtacaagggtgagatacgaaagtaactgnggcttcgcacttagttcttacgttctcntcctccgctgttcgtaag

SEQ ID NO: 412977 - DNA, 544 bp, Homo sapiens
  misc_feature: GZ8MTXP01BPU8E.44.65.F10.1.454.CMB.2.raw
  modified_base (294)..(294): a, c, t, g, unknown or other
  modified_base (396)..(396): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagagccaccctctcctgcagggccagtcagagtgttagcagcaacttagcctcgtaccagcagaatctggccaggctcccaggctcctcatctatggtncatcccacagggccatggtactcccagccaggttcaggtcggcaggtggtctggggaacaggtgttcactctcaccatcagcagcctgcgagtctagaagtnttttgctagtttattactgtcagctaagtataatgtactcggtccccttcccgtcgggacctaaggggaccaacggtacgttagggaaagttaacgttaaaaccggacttggttaggcctgcccaactatcttgttccttcgtaaccg

SEQ ID NO: 412978 - DNA, 501 bp, Homo sapiens
  misc_feature: GZ8MTXP01ASCOD.44.65.F10.1.454.CMB.2.raw
  modified_base (196)..(196): a, c, t, g, unknown or other
  modified_base (283)..(283): a, c, t, g, unknown or other
  modified_base (293)..(293): a, c, t, g, unknown or other
  modified_base (354)..(354): a, c, t, g, unknown or other
  modified_base (384)..(384): a, c, t, g, unknown or other
  modified_base (454)..(454): a, c, t, g, unknown or other
  modified_base (485)..(485): a, c, t, g, unknown or other
  modified_base (498)..(498): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccaccctctcctgcagggccagtcagagtgttagcagcaacttagcctcgtaccagcagaaatctggccaggctcccaggctcctnatctatggtncatcccacagggccactggtactcccagccaggttcagtcggcaggtggtctgggaacagngttcactctcacatcagcagcctgcagtcngaagtattttgcttagtttatactgtcagtcagtataatgactggcctcccttcggccaagggcaacggnttagggattataaaccgattgttggactgcnccatcttgtcttnaac

SEQ ID NO: 412979 - DNA, 585 bp, Homo sapiens
  misc_feature: GZ8MTXP01ESMLU.44.65.F10.1.454.CMB.2.raw
  modified_base (198)..(198): a, c, t, g, unknown or other
  modified_base (265)..(265): a, c, t, g, unknown or other
  modified_base (298)..(298): a, c, t, g, unknown or other
  modified_base (403)..(403): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagngccaccctctcctgcagggccagtcagagtgttagcagcaacttagcctcgtaccagcaagaaatcnggccaggctcccgaggcctcctcatctatggtncatcccaccgagggccagtggtactcccgagccaggttcaggtcgcaggtgggtctggggaacagcgttcactctcaccatcagcagcctgcagtctagaagttntttgacttagtttatactgtcgagtctaagtataatcgactcggtccccttcccgttcgggaccgaaaggggcaacggtacgttaggggaaacgttaaacgttaaaaccggtaacgttgggttcgggttaccttaacggaccctaacccgtattccgttacggttcctttaaccgtaacccg

SEQ ID NO: 412980 - DNA, 547 bp, Homo sapiens
  misc_feature: GZ8MTXP01B009X.44.65.F10.1.454.CMB.2.raw
  modified_base (196)..(196): a, c, t, g, unknown or other
  modified_base (355)..(355): a, c, t, g, unknown or other
  modified_base (396)..(396): a, c, t, g, unknown or other
  modified_base (521)..(521): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangcccaccctccctgcagggccagtcagagtgttagcagcaacttagcctcgtaccagcagaaatctggccaggctcccaggctcctcatctatggtgcatccacagggccactggtatccccagccaggttcagtggccaggtgggtctggggacaagngttcactctcaccatcagcagcctgcagtctagaaagtttntttgctagtttatctgtcaggtactaagttataacgtgtaccgtcggtcccttccgtcggaccgaagggaccacggtaagtggaagtaacttaaacgagtggttacggttcttacgaacctactnttcgtcgttccttcgttaacgttccc

SEQ ID NO: 412981 - DNA, 608 bp, Homo sapiens
  misc_feature: GZ8MTXP01ED94S.44.65.F10.1.454.CMB.2.raw
  modified_base (197)..(197): a, c, t, g, unknown or other
  modified_base (269)..(269): a, c, t, g, unknown or other
  modified_base (278)..(278): a, c, t, g, unknown or other
  modified_base (284)..(284): a, c, t, g, unknown or other
  modified_base (289)..(289): a, c, t, g, unknown or other
  modified_base (351)..(351): a, c, t, g, unknown or other
  modified_base (363)..(363): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttaccagcaacttagcctggtaccacagaacctggcaggcnccagctctnatctangaacntccacaggccatggtactcccaccctaggttcaggtggcaggtcggggtaccccggataggngttccactctcncatcgagccggtcctgctagtctgtaggtatttgcttagtttattacgttgtcagactaagtaattaactaacgtcggtccttctacgtaccggtttcggggacgggggtaaccgtaagggtcgggaagtaacgtaccggaaaaggtaaaccgttggttcgggtacgttacggacctaacccgttagttccttacggttcctttacgtaaccttcccgtttaccccggacttaacgttccttaag

SEQ ID NO: 412982 - DNA, 523 bp, Homo sapiens
  misc_feature: GZ8MTXP01BNUYS.44.65.F10.1.454.CMB.2.raw
  modified_base (294)..(294): a, c, t, g, unknown or other
  modified_base (369)..(369): a, c, t, g, unknown or other
  modified_base (397)..(397): a, c, t, g, unknown or other
  modified_base (493)..(493): a, c, t, g, unknown or other
  modified_base (504)..(504): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagagccaccctctcctgcagggccagtcagagtgttagcagcaacttagcctcgtaccagcagaatctggccaggctcccaggctcctcatctatggtncatcccacgagggccacgtggtactcccgagcctaggttcagtcggcaggtgggtctgggaacagtgttcactcncacatcagcagcctgcagtctagaagtntttgcttagtttatactgtacagtcaagtataatgactcggccctccgttcggaccaagggccaagacgttggaaacttaagttaaacgacttggnggctgcaactntcttcgtaacttcgtaacc

SEQ ID NO: 412983 - DNA, 638 bp, Homo sapiens
  misc_feature: GZ8MTXP01DBP8N.44.65.F10.1.454.CMB.2.raw
  modified_base (195)..(195): a, c, t, g, unknown or other
  modified_base (300)..(300): a, c, t, g, unknown or other
  modified_base (326)..(326): a, c, t, g, unknown or other
  modified_base (435)..(435): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccacctgtctgtgtctcgaggggaaancgcccaccctctcctgcagggccagtcagagtgtagcagcaacttcgcctacgtaccagacaagaaatcgtggccaggcctcccgaggcctcctcatctatggtncatcccacgacgggccacgtggtacncccagcccgtaggttcaggtcggactaggtcggggtctaggggaaacaggtcgttccaacgttcctacaaccctatccagcacgcctgactagttacgtagtaacgttnttttacggacttaagtttattacgtgtacgtaaggtactaaagttataagtcgtacgtccggtaccccttacccgttaccgaaacccggaaagggaccctaacggacgttagggaaacgttaaacgtttaaaaccgggcgttagggttcggaccgttaacggaccctaacctacgttctttcggtttcccttccgttaacccg

SEQ ID NO: 412984 - DNA, 590 bp, Homo sapiens
  misc_feature: GZ8MTXP01BV0YB.44.65.F10.1.454.CMB.2.raw
  modified_base (197)..(197): a, c, t, g, unknown or other
  modified_base (259)..(259): a, c, t, g, unknown or other
  modified_base (288)..(288): a, c, t, g, unknown or other
  modified_base (421)..(421): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangccacctctcctgcagggccagtcagagtgtagcagcaacttgcctcgtaccagcagaatcnggcaggctccaggctcctcatctatggtncatcccacgagggccacgtggtactccccagcctaggttcaggtcggctaggtcggggtctggggaaactagggtaacgttccaacttcctaccgaccatcgaacgcacgcctagctagttctaggtaagttnttttgacttagtttactttactggttcagtctaagttataagtcgacgtcggtacccttcccggtcggaccgtaaacgggcaaccggtacgttagggtaaacgttaaacgttaaacgtaacgttgggcggttactcggaccaaccgttatcgttcgttcttccgtaacg

SEQ ID NO: 412985 - DNA, 601 bp, Homo sapiens
  misc_feature: GZ8MTXP01DG8SY.44.65.F10.1.454.CMB.2.raw
  modified_base (198)..(198): a, c, t, g, unknown or other
  modified_base (275)..(275): a, c, t, g, unknown or other
  modified_base (285)..(285): a, c, t, g, unknown or other
  modified_base (296)..(296): a, c, t, g, unknown or other
  modified_base (310)..(310): a, c, t, g, unknown or other
  modified_base (342)..(342): a, c, t, g, unknown or other
  modified_base (357)..(357): a, c, t, g, unknown or other
tcagacagtatatacacgaccggtgctcgatttagctacgctctaaggggggaggaactgctcagttaggacccagacggaaccatggaagccccagcgcagcttctcttcctcctgctactctggctcccagataccactggagaaatagtgatgacgcagtctccagccacctgtctgtgtctccgaaggggaaancgcccaccctctcctgcagggccagtcagatgttaccagcaaacttgcctaggtaccaacagaaacctgggcaggcncccagctctnatcatgaacanccacaggccatgancccaccagtcagtggcaggtgggtccccgganagagttcactctacnccatcgaacgcggcctgcaggtctagaggtatttgcttagtttaatactgtacagacaagtaataaattaacgtcggtcccttactaccggttacgtttccgggggacggggggtaaccctaaaaggggttgggaagtaagttaaccgaaaacggtaacgttggttacgggacttacgacctaacaacgttcttacggttccttacgtaacgttccctttaccccggccttaagttccgttaag

SEQ ID NO: 412986 - DNA, 550 bp, Homo sapiens
  misc_feature: GZ8MTXP01D0D2H.44.65.F10.1.454.CMB.2.raw
  modified_base (197)..(197): a, c, t, g, unknown or other
  modified_base (261)..(261): a, c, t, g, unknown or other
  modified_base (280)..(280): a, c, t, g, unknown or other
  modified_base (290)..(290): a, c, t, g, unknown or other
  modified_base (368)..(368): a, c, t, g, unknown or other
  modified_base (394)..(394): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangccacctctcctgcagggccagtcagagtgttagcagcaattgcctcttaccagcaagaaatcnggcaggctcccaggcctcnatctatggtncatcccacgagggcccatggtactccgagccaggttcagtcgcaggtgggtctgggaacagtcgtcaactctcaaccntcacgcagcctgcagtctagaagttntttgcttagtttatacgtgtcgaagtctaagttataataacgtcgaccttactcgtacggtttcggggacgggggtaaccgaagggtaggagtaacgttacgaaacgtaacgttggttcgcgtcgactaacgtatccttgttaaccttcgtaaccg

SEQ ID NO: 412987 - DNA, 569 bp, Homo sapiens
  misc_feature: GZ8MTXP01B2GGP.44.65.F10.1.454.CMB.2.raw
  modified_base (197)..(197): a, c, t, g, unknown or other
  modified_base (298)..(298): a, c, t, g, unknown or other
  modified_base (414)..(414): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangccaccctctcctgcagggccagtcagagtgttagcagcaacttagcctcgtaccagcaagaatctggccaggcctcccgaggcctcctcatctatggtcncatcccacgagggccctacgtgggtactccccgagccctaggttcaggtcggctagggtgggtctggggaacagtgttcactctcaccatcagcagcctgctagtctaggaagttntttgcttagtttatactgtcagtctagtatagtgtacgtcggtccctcccgtcggaccgtaagggccaacggacgttagggaacgttaacgttaaacggtacgttggttcggttctcggcctaacctatccttacggttaacctttccgtaaccg

SEQ ID NO: 412988 - DNA, 564 bp, Homo sapiens
  misc_feature: GZ8MTXP01D5EWK.44.65.F10.1.454.CMB.2.raw
  modified_base (263)..(263): a, c, t, g, unknown or other
  modified_base (277)..(277): a, c, t, g, unknown or other
  modified_base (286)..(286): a, c, t, g, unknown or other
  modified_base (420)..(420): a, c, t, g, unknown or other
tcagacagtatatacacgaccggtgctcgatttagctacgctctaagggggaggaactgctcagttaggacccagacggaaccatggaagccccatcgcagcttctcttcctcctgctactctggctcccagataccactggagaaatagtgatgacgcggtctccagccaccctgtctgtgtctccgaggggaaagacgccacctctcctgcagggccagtcagagtgttagcagcaacttagcctacgaccagcagaatcngcagctccagctcnatctagtgngcactcccacgagggccacgtcggtactcccgagccctaggttcaggtcggcgtagggtgggtcgtggggaaaccaggtcgttcaccttctaccacctatcgaagccagtcctgacctagttactagtaagttnttttgacttagtttacttagtgtacaagtctaagtataagtcgacttcgggacccttcggtcgaaccgacgggacaacgtagttgggaaacttaaagtaaaccggtattggttcgactcgcctctacttcttacttcttcgtcc

SEQ ID NO: 412989 - DNA, 603 bp, Homo sapiens
  misc_feature: GZ8MTXP01EOG0M.44.65.F10.1.454.CMB.2.raw
  modified_base (197)..(197): a, c, t, g, unknown or other
  modified_base (359)..(359): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagngccaccctctcctgcagggccagtcagagtgttagcagcaacttagcctcgtaccagcagaaatctggccaggctcccaggctcctcatctatggtgcatccaccagggcccactggtactcccgagccaggttcagtcggctaggtgggtctgggaacagngttcacgtctcaccatcagcagcctgcagtcgtaggtaggtatttgacttagtttattactgtcgagtctaagtataagtaacttcggtcctcttcgtaccggtttcgggggaccggggggtaaccgtaaacgggtgggaacggtaacgttaaaccgtaaaaccggtaacgttaggggttccgggttaccgttcgggacctaacccgttaactccgtttacggtttcccgtttccttaacccgg

SEQ ID NO: 412990 - DNA, 591 bp, Homo sapiens
  misc_feature: GZ8MTXP01BCAA5.44.65.F10.1.454.CMB.2.raw
  modified_base (196)..(196): a, c, t, g, unknown or other
  modified_base (297)..(297): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccacctgtctgtgtctccgaggggaaangccaccctctcctgcagggccagtcagagtgttagcagctaacttagcctcgtaccagcaagaaatctggccaggctcccgaggcctcctcatctatggtncactcccacgagggccacgtggactcccgagcctaggttcaggtcggcgtaggtggggtctggggaaaccaggtcgtttccactctacaccatcacgcagcctgctagtctagtaagttattttgacttagtttatacgttgcagtactaagttataagtcgacctcggtccctcccggttacggaccgtaaagggccaaccggtaagttagggaaacgttaaacgtaaacggtaacgttgggttcggttactaacggacctaacccgtattccgttcgttccttaaccgttcc

SEQ ID NO: 412991 - DNA, 502 bp, Homo sapiens
  misc_feature: GZ8MTXP01CDQDX.44.65.F10.1.454.CMB.2.raw
  modified_base (195)..(195): a, c, t, g, unknown or other
  modified_base (268)..(268): a, c, t, g, unknown or other
  modified_base (288)..(288): a, c, t, g, unknown or other
  modified_base (340)..(340): a, c, t, g, unknown or other
  modified_base (379)..(379): a, c, t, g, unknown or other
  modified_base (459)..(459): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccacctgtctgtgtctccaggggaaangccaccctctcctgcagggccagtcagagtgttaccagcaacttagcctggtaccacagaacctgggcaggcnccagctctcatctatgaacntccacaggccactggtactcccaccaggttcagtgcagtcgggtccccgganagagtcactctcaacatcagcggcctgcagtctgaggtntttgctagtttatactgtcagcagtataataacgtgcctctctacgttcggcggggacaggtgagagtacaacgaactgngcttgctacacttcttcgtctctcttctcccgctaattctaag

SEQ ID NO: 412992 - DNA, 547 bp, Homo sapiens
  misc_feature: GZ8MTXP01AFX7C.44.65.F10.1.454.CMB.2.raw
  modified_base (197)..(197): a, c, t, g, unknown or other
  modified_base (270)..(270): a, c, t, g, unknown or other
  modified_base (280)..(280): a, c, t, g, unknown or other
  modified_base (286)..(286): a, c, t, g, unknown or other
  modified_base (291)..(291): a, c, t, g, unknown or other
  modified_base (342)..(342): a, c, t, g, unknown or other
  modified_base (345)..(345): a, c, t, g, unknown or other
  modified_base (354)..(354): a, c, t, g, unknown or other
  modified_base (356)..(356): a, c, t, g, unknown or other
  modified_base (523)..(523): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangcccaccctctcctgcagggccagtcagagtgttagcagcaacttgcctggtaccacagaacctgggcaggcnccaggctccnatctangaacntccacagggccatggactcccacctaggttcagtgcaggtcgggcccgganagngttcactcncncatcagccggctgctagtctgaggtatttgcttagtttatactgtacagtctaagtataagtacgtggtcccttctacgtacggtttcggggcgggggtaaccaaaggggtggaagtagtaacgaaacggaactggttggcttgccaaccttagttcttagtcttcncttcccttccgcctaacttcgtaa

SEQ ID NO: 412993 - DNA, 591 bp, Homo sapiens
  misc_feature: GZ8MTXP01AG0ZG.44.65.F10.1.454.CMB.2.raw
  modified_base (197)..(197): a, c, t, g, unknown or other
  modified_base (304)..(304): a, c, t, g, unknown or other
  modified_base (442)..(442): a, c, t, g, unknown or other
  modified_base (576)..(576): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccacctgtctgtgtctccgaaggggaaanacgcccaccctctcctgcagggccagtcagagtgttagcagcaacttagcctcgtaccagacagaaatcgtggccaggcctcccgaggcctcctcatctagtggtcncactccaccgacgggccacgtggtactcccgagcctaggttcaggtcggcgtaggtgggtcgtgggaacagtaacgttcaaccttctaccacctatccgaacgccacggtccctgacgtagttcgttagtaaacgttnttttcgactttaagttttactacgtgtacaggtactaagttactaagtcgtaccgtcggtccccttcccgtcgggaccgtaagggccaagcgttaggaacttaacgttaaacgacgttggcggctcgctaactntcgttctcttctccg

SEQ ID NO: 412994 - DNA, 627 bp, Homo sapiens
  misc_feature: GZ8MTXP01BQ78A.44.65.F10.1.454.CMB.2.raw
  modified_base (197)..(197): a, c, t, g, unknown or other
  modified_base (206)..(206): a, c, t, g, unknown or other
  modified_base (297)..(297): a, c, t, g, unknown or other
  modified_base (402)..(402): a, c, t, g, unknown or other
  modified_base (454)..(454): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctntcctgcgagggccagtcagagtgttaccagtcaacttagcctaggtacccaaccgagaaaccctggggacaggcctcccgaggcctccctnattcctatacggaacactccccaaccgtaggggccctacgtcggtacctcccccgaacccgagggtttccaaggttcgggaccagggttcggggtacccccgganaggtacgttccacgtcctacaaccagtccgaggccgctgactagtctgagtntttgcttagtttattactgtacatctaagtaataagtaacgtggtccttcgtacgtacggttccgggacgggggacctaaagggtggaagtactacgaaacgtaacgtggttacggcttcgactcgttacgttcgttcgtcttctaacttccctacccgcctaattccgtaag

SEQ ID NO: 412995 - DNA, 594 bp, Homo sapiens
  misc_feature: GZ8MTXP01EPJN7.44.65.F10.1.454.CMB.2.raw
  modified_base (198)..(198): a, c, t, g, unknown or other
  modified_base (305)..(305): a, c, t, g, unknown or other
  modified_base (423)..(423): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaaggggaaancgcccaccctctcctgcagggccagtcagagtgtagcagctaacttcgcctacgtaccagcaagaaatcgtggccaggcctcccgaggcctcctcatctagtggtcncactcccacgacgggcctagtcggtactcccgagacgtaggttcaggtcggcgtaggtgggtctgggaacagtcttcactcacagcatcgagcggacgtgggacgtccgtggaaggtntttccgaggtacttagtttatacgtgtacgagtcgtagttagttggttcgcctaccgttcgtacggtaccggttccggaaccgaaaggggtaaccgtaaagggttacgtaaacttacgaaacggtacttcgttgacctgacctaacgtactcgttgttccttcgtaacccg

SEQ ID NO: 412996 - DNA, 589 bp, Homo sapiens
  misc_feature: GZ8MTXP01CI9KL.44.65.F10.1.454.CMB.2.raw
  modified_base (196)..(196): a, c, t, g, unknown or other
  modified_base (357)..(357): a, c, t, g, unknown or other
  modified_base (403)..(403): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctcgaggggaaangccaccctctcctgcagggccagtcagagtgtagcagcaaacttgcctcgtaccagcagaatctggccaggctcccaggctcctcatctatgctgcactcccaccgagggccaacgtggtactcccgagccaggttcaggtggcaggtgggtctagggacnggagttcacttcacacatcagcagcctgcagtactagtaaagtttntttgacttaagtttacttacgtggtacgtagtactaagttaataaacgtacgtcgtcctcgtccgttacggttccgggggacgggggtaacgtaaggggttaggtaacgttaacgtaaacggtaaacgttacggttcggttacggtccgtagtaacccgtactacgttcgttcgttccgttaaccg

SEQ ID NO: 412997 - DNA, 582 bp, Homo sapiens
  misc_feature: GZ8MTXP01A5PV7.44.65.F10.1.454.CMB.2.raw
  modified_base (197)..(197): a, c, t, g, unknown or other
  modified_base (300)..(300): a, c, t, g, unknown or other
  modified_base (309)..(309): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaancgccaccctctcctgcagggccagtcagagtgttagcagcaacttagcctcgtaccagcagaaatcgtggcccaggcctcccgaggcctcctcatctatggtncatccacgngggccacgtggtactcccgagcctaggttcaggtcggctaggtggggtctggggaacagtcgttccacgtctacaccatcagcacgcctaggcctagttctaggtaattatttgacttaagtttatacgtgtacgagtcgtaagtataatcgaccgttcggtacccttcccgtaggacccgaaaggccaacggtaacgttaggaaacgttaaagttaaacccgaagttggttcggctcggaccctaactattcgttcgttccttcgtaacccg

SEQ ID NO: 412998 - DNA, 612 bp, Homo sapiens
  misc_feature: GZ8MTXP01C4QDW.44.65.F10.1.454.CMB.2.raw
  modified_base (196)..(196): a, c, t, g, unknown or other
  modified_base (593)..(593): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangcccacctccctgcagggccagtcagagtgttagcagcaacttacgcctcgtaccagacagaaatctggccaggctcccgaggctcctcatctatggtgcactcccaccgacgggccctacgtggtactccccgagtccctaggttccaggtcggccgacggttggggtcgtggggaactagtaacgtttcactcctcaaccccgatcaggtcacgcctcggcaagttcgttagtaaagttacttttgacttaagtttacttcgtagtacctaggtactaagtttaaactaagtcgaccgttcggtccctccggttacggaccgtaagggacctacggtaagtacgggagtaaacgttaaacgacgtttggacgttccttagcccaacttcttcgtnttccttaagcctttccccg

SEQ ID NO: 412999 - DNA, 595 bp, Homo sapiens
  misc_feature: GZ8MTXP01EUGWL.44.65.F10.1.454.CMB.2.raw
  modified_base (197)..(197): a, c, t, g, unknown or other
  modified_base (264)..(264): a, c, t, g, unknown or other
  modified_base (400)..(400): a, c, t, g, unknown or other
  modified_base (424)..(424): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangccaccctctcctgcagggccagtcagagtgttagcagcaacttagcctcgtaccagcaagaaatcnggccaggcctcccgaggcctcctcatctagtggtgcactcccaccgagggccctagtcggtaactccccgagcctaggttcaggtcggctaggtgggtctggggaaacaggtcgttcactcctacaaccatcgaanctacgcctgctagtctagaagttnttttgacttagtttatacgtgtacagtactaagtataatcgtactcggtcccttcccgttacggaccgtaaacgggactaacggtacgttaggggtaaacttaacgttaaaacggacttggttcgggacttcggacctaaccgtacttccgttcgttcctttccgtaaccc

SEQ ID NO: 413000 - DNA, 763 bp, Homo sapiens
  misc_feature: GZ8MTXP01BAR93.44.65.F10.1.454.CMB.2.raw
  modified_base (196)..(196): a, c, t, g, unknown or other
  modified_base (282)..(282): a, c, t, g, unknown or other
  modified_base (296)..(296): a, c, t, g, unknown or other
  modified_base (754)..(754): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaancgccaccctctcctgcagggccagtcagagtgttaccagactaacttagcctaggtacccaccgaagaaaccctggggcacggccncccaggcctcctanatctatcggaaccactcccaccgagggccccaacgtcggtacctcccccgaacccgtagggtttccaggttcgggaccgtaagggggttccgggggtacccccggggaactagggtacggtttacccaaccgttccctacccgaaccctacgtacccgacgggcccggggtacccttggggaccttaacggttccgttaggttaacgggttaatttttcgggacctttaagggttttttaactttaccgttgggttaccaacggtacgtaaagtttaaacgttaaacttaaacggggtcgggttaccccttaccgttacccggttaaccgggtttccgggggaccggggggtaacctaaagggggttccggaagtaacgtaaccgaaaacggaacgtttgggcggtcttcggacctaccgttattcgttcgttccttctaacttcccgttccgacctnttcgttaag

SEQ ID NO: 413001 - DNA, 553 bp, Homo sapiens
  misc_feature: GZ8MTXP01CR9B2.44.65.F10.1.454.CMB.2.raw
  modified_base (196)..(196): a, c, t, g, unknown or other
  modified_base (269)..(269): a, c, t, g, unknown or other
  modified_base (281)..(281): a, c, t, g, unknown or other
  modified_base (355)..(355): a, c, t, g, unknown or other
  modified_base (530)..(530): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttaccagcaacttagcctggtaccacagaacctgggcaggcncccaggctcctnatctatggaacatccaccagggcccactggtactccccacccgtaggttcagtggcaggtcggggtccccgganaggagttccactctcaaccatcagcgcctgcagtctgaggtatttgcttagtttattactgtcagctagttaataataacgtcggtcctctacgtacgtttcggggcgggggaactaagggtcggagactacgaaaggaactggcggtcttcggactaccgattcttcgtcttcncttcctcccgctaacttcgtaag

SEQ ID NO: 413002 - DNA, 551 bp, Homo sapiens
  misc_feature: GZ8MTXP01BN8CW.44.65.F10.1.454.CMB.2.raw
  modified_base (198)..(198): a, c, t, g, unknown or other
  modified_base (263)..(263): a, c, t, g, unknown or other
  modified_base (294)..(294): a, c, t, g, unknown or other
  modified_base (382)..(382): a, c, t, g, unknown or other
  modified_base (409)..(409): a, c, t, g, unknown or other
  modified_base (423)..(423): a, c, t, g, unknown or other
  modified_base (443)..(443): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagngccaccctctcctgcagggccagtcagagtgttagcagcaacttagcctcgtaccagcagaatcnggccaggctcccaggctcctcatctatggtncactcccaccgagggcctacgtggtactcccagcctaggttcaggtcggctaggtggggtctggggaacaggtcgttcactctcaccntcagcacgcctggctagtctagaattntttcgcttagtttntactgtcagctaagtataancgtacgtcggtccctcccgtcggaccgaacgggtcaacggagttaggaacttaagttaaaccgattcggttggactggaccaactatcgttacgtcctttaacaaccg

SEQ ID NO: 413003 - DNA, 524 bp, Homo sapiens
  misc_feature: GZ8MTXP01B8X8K.44.65.F10.1.454.CMB.2.raw
  modified_base (196)..(196): a, c, t, g, unknown or other
  modified_base (350)..(350): a, c, t, g, unknown or other
tcagacagtatatacacgaccggtgctcgatttagctacgctctaaggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagngccaccctctcctgcagggccagtcagagtgttagcagcaacttagcctcgtaccagcagaatctggccaggctcccaggctcctcatctatggtgcatccaccagggccacgtggtactcccagccaggttcagtcgcagtggctggaacagngttcactctcaccatcagcagcctgcagtctagagtatttgctagtttattactgtcgtagcgtagtataatgacgtggtccctcccgttcgggccgtaagggccaacggcgttgggagttaacgttaaacggacttggttgcctgcaacccgtatcttagttcctttcgtaac

SEQ ID NO: 413004 - DNA, 553 bp, Homo sapiens
  misc_feature: GZ8MTXP01AH9J5.44.65.F10.1.454.CMB.2.raw
  modified_base (198)..(198): a, c, t, g, unknown or other
  modified_base (272)..(272): a, c, t, g, unknown or other
  modified_base (283)..(283): a, c, t, g, unknown or other
  modified_base (294)..(294): a, c, t, g, unknown or other
  modified_base (356)..(356): a, c, t, g, unknown or other
  modified_base (509)..(509): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaancgcccaccctctcctgcagggccagtcagagtgttaccagcaacttgcctggtaccacagaacctgggcaggcnccaggctcctnatcatggaacntccacagggccagtggtactccccaccgaggttccaggttggcaggtggggtacccccgganagtagttccactcctcaaccatccaggcggcctgcagtctgagtatttgctagtttatactgtcagctaagtattaataacggtcggccttctcgtacggttcggggacgggggactaagggtggaagagtacgaaacgtaacgtggttggcngtaccacttattcttgtctctaactcctcccgctaacttctaag

SEQ ID NO: 413005 - DNA, 558 bp, Homo sapiens
  misc_feature: GZ8MTXP01D9C4L.44.65.F10.1.454.CMB.2.raw
  modified_base (196)..(196): a, c, t, g, unknown or other
  modified_base (292)..(292): a, c, t, g, unknown or other
  modified_base (352)..(352): a, c, t, g, unknown or other
  modified_base (366)..(366): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccaccctctcctgcagggccagtcagagtgttagcagcaacttgcctcgtaccagcagaaatctggccaggctcccaggctcctcatctatggtncatcccacgagggcccagtggtactccagccaggttcagtcgcaggtggctgggaacagngttcactctcaccntcagcagtcctgcagtctagtaagtattttgacttagtttattactgttacgagtctaagttataagtgacgtcgcccttcccgttcggacctaacggggccaacggtacgttgggtaaacgttaaagtttaaaaccggacgttaggttcggaccgttaagacccaactatccttgttcccttaacgtcccg

SEQ ID NO: 413006 - DNA, 582 bp, Homo sapiens
  misc_feature: GZ8MTXP01BBHRY.44.65.F10.1.454.CMB.2.raw
  modified_base (260)..(260): a, c, t, g, unknown or other
  modified_base (291)..(291): a, c, t, g, unknown or other
  modified_base (363)..(363): a, c, t, g, unknown or other
  modified_base (405)..(405): a, c, t, g, unknown or other
tcagacagtatatacacgaccggtgctcgatttagctacgctctaagggggaggaactgctcagttaggacccagacggaaccatggaagcccagcgcagcttctcttcctcctgctactctggctcccagataccactggagaaatagtgatgacgcggtctccagccacctgtctgtgtctccgaggggaaagagccaccctctcctgcagggccagtcagagtgttagcagcaacttgcctgtaccagcagaaatcnggccaggctcccaggctcctcatctatggtncatccaccgagggcccacgtggtactcccgagccgaggttcaggtcggcaggtgggtctggggaacagggtnttccacttctacaccatcagcagcctgcagtctagaagtttnttgacttagtttatactgtacgtagtacgtagttaactaagtcgtacgtccggttacccttcccggtacgggaaccgaaacggggacctaacggtaacggttagggtaaacgttaacgttaaaacgtacgttggttcgccgtcgacctaaccgtcttcgttacttccttccgtaacg

SEQ ID NO: 413007 - DNA, 683 bp, Homo sapiens
  misc_feature: GZ8MTXP01DMLJX.44.65.F10.1.454.CMB.2.raw
  modified_base (196)..(196): a, c, t, g, unknown or other
  modified_base (232)..(232): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaanacgccaccctctcctgcagggccagtcagagtgtancagcaacttagcctcgtaccagcagaaatcgtggccaggctccaggctcctcatctatggtgcactccaccgtagggcctacgtcgggtaactccccgagccctaaggtttccaggttcggctaggggttggggtccgtagggggaaacctaggtcggtttcccacttaccttacacccctaattccaaggcctaacgccccgttgcgtaacgttacctaggtaaaagttttcgttttaggactttaagtttaactttacgttagttacggaacgtaacgttaaagttaacgttaacgtacgtacgttccggtaccccgttacccggttaccgggaaccgtaaacggggtaactaaaccggtacgttagggtaaacgttaaacgttaaaaccggtacgttaggcggttactaacggacctaacgtacttcgttcgttaaccgttcgtaacc

SEQ ID NO: 413008 - DNA, 672 bp, Homo sapiens
  misc_feature: GZ8MTXP01AFNYV.44.65.F10.1.454.CMB.2.raw
  modified_base (199)..(199): a, c, t, g, unknown or other
  modified_base (277)..(277): a, c, t, g, unknown or other
  modified_base (289)..(289): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggaagaaatagtgatgacgcagtctccagccaccctgtctgtgtctccgaaggggaaancgcccaccctctcctgcagggccagtcagagtgtaccagcaacttagcctggtaccaccagaaccgtgggacaggccnccgaggcctccnactctatggaacactccaccgagggccacgtgtactcccaccctaggttcaggtggcaggtcggggtcccggactagtacgttcacgtctaccaaccataccgaggcccgggtacctgggcctaggtacctggtaaggttagttttcgacgttagtttactttcgtgtaccaggtactaagttaacttaaacgttaacggtcggtacctttaccgtacgtaccgggtttccggggacgggggtaaccgtaaaggggtcggaacggtaactaaccggtaaacggtaacgttgggttcggtaccgttacgaccgtaaccgttacgttccgttacggttcccttacgtaacctttcccgtcccccggttataaccgttccgttaag

SEQ ID NO: 413009 - DNA, 574 bp, Homo sapiens
  misc_feature: GZ8MTXP01AB81J.44.65.F10.1.454.CMB.2.raw
  modified_base (198)..(198): a, c, t, g, unknown or other
  modified_base (300)..(300): a, c, t, g, unknown or other
  modified_base (384)..(384): a, c, t, g, unknown or other
  modified_base (409)..(409): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaaggggaaancgcccaccctctcctgcagggccagtcagagtgtagcagctaacttgcctcgaccagcaagaaatctggccaggcctcccgaggcctcctcatctagtggtnccactcccacgagggcctagtcggtactccgagcctaggttcaggtcgcgaggtgggtctggggaacagtcgttcactctcacntcagcacgtctgcagtctagagttntttgacttagtttatactgtacagtctaataactaagtcgtaccgtcggtaccccgttccgtacgggaaccgtaaacgggacctaacggtagttacgggaaattaaacgttaaaccggagttcggttacggctaacgactaacgtactcttctcgttctaacccg

SEQ ID NO: 413010 - DNA, 610 bp, Homo sapiens
  misc_feature: GZ8MTXP01A622P.44.65.F10.1.454.CMB.2.raw
  modified_base (198)..(198): a, c, t, g, unknown or other
  modified_base (280)..(280): a, c, t, g, unknown or other
  modified_base (293)..(293): a, c, t, g, unknown or other
  modified_base (370)..(370): a, c, t, g, unknown or other
  modified_base (597)..(597): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaancgcccaccctctcctgcagggccagtcagagtgttaccagcaacttagcctaggtaacccacgagaaaccgtgggcaggccnccgaggcctcctnatcatggaacatcccaccgaggccacgtggtactccccgacctaggttcaggtggacaggtcggggtcccccggganaggtacgttcacgtctaccaaccgtatccgacggtccgggcctgacctagtctaggtaggttatttgacttagtttacttactgtacagtctaagtaatactaacgtcggtccttacgtcgtacgtttccgggggacgggggtaacctaagggtcggaagtactaaccgaaacggtaatgggttacgcttcgactaccagttcttacgttcttcaacttcccgtccncctaagttctaag

SEQ ID NO: 413011 - DNA, 580 bp, Homo sapiens
  misc_feature: GZ8MTXP01AX0VB.44.65.F10.1.454.CMB.2.raw
  modified_base (198)..(198): a, c, t, g, unknown or other
  modified_base (262)..(262): a, c, t, g, unknown or other
  modified_base (270)..(270): a, c, t, g, unknown or other
  modified_base (279)..(279): a, c, t, g, unknown or other
  modified_base (289)..(289): a, c, t, g, unknown or other
  modified_base (567)..(567): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaancgccaccctctcctgcagggccagtcagagtgttaccagcaacttgcctggtaccacagaaccnggcaggcnccagctccnatcatgaacntccacaggccagtgtactcccaccaggttcaggtcggcgtaggtcggggtccccggataggtacgttccacgtccaccaaccgatcccgacgggtccggccctggctaggtcgtaggtaggttatttcggacgttagtttacgttacgtgtaccgtagactaagttaataaataacgtcgtacttctacgtacggttcggggacggggtacagggtgacgataacgaacgtaagtggcgcttcgacacttagttcttgtcttcgtccttccgtcccgntaacgttcgtaag

SEQ ID NO: 413012 - DNA, 660 bp, Homo sapiens
  misc_feature: GZ8MTXP01CT878.44.65.F10.1.454.CMB.2.raw
  modified_base (199)..(199): a, c, t, g, unknown or other
  modified_base (483)..(483): a, c, t, g, unknown or other
tcagacagtatatacacgaccggtgctcgatttagctacgctctaaggggggaggaactgctcagttaggacccagacggaaccatggaagccccagcgcagcttctcttcctcctgctactctggctcccagataccactggagaaatagtgatgacgcggtctccagccaccctgtctgtgtctccgaaggggaaancgcccaccctctcctgcgagggccagtcagtagtgttagcagcaacttagcctacgtaccagcaagaaatcgtggccaggcctcccgaggcctcctcatctagtggtcacctactccccgaaccgacggggtccctacggttcgggtaacctccccgaggcccgtaagggttccgagggttccggaccgtaggggttcggggtccgtaggggaaacctagggtcgttccaccttcctaccaacctatcgaacgcacgcctgccgtaagttacgtagtaacgttnttttcggactttaagtttattacgtagtacgtagtactaagtaatagtcgtacctcggtaccctccggtacggacgaacgggcaacgtacgttaggtaaacgttaacgttaaaacggcgttaggttcggaccttaaggaccctaacgttacttcgttacgttcccttcgtaaccccg

SEQ ID NO: 413013 - DNA, 773 bp, Homo sapiens
  misc_feature: GZ8MTXP01EC4L5.44.65.F10.1.454.CMB.2.raw
  modified_base (194)..(194): a, c, t, g, unknown or other
  modified_base (204)..(204): a, c, t, g, unknown or other
  modified_base (207)..(207): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatgtgatgacgcagtctccagccacctgtctgtgtctccgaggggaancgccaccctntcngcgagggccagtcagtagttcgttaccagtactaacttcgcctacggtaacccaccgaaggaaacccgtggggacaacggcctaccccgaggtcccttccactattcctaagtacggaaacctacgtacccgaaccgaggggccctaacgtcggtaacctccccgaacccgtaggttcaggttcggacgtaggggtcggggtaccccgggactaggtacgtttcccaccgttacctaccgaaccgtagtcccggaacgggtcccggtacccttagggcccgttaagggttccgtagggttacgggtttattttacgggacctttaaaggttttttactacgttggttaccaggtcctacggttccgtttaccccgtacggggccggtcccgttccgttaccgggttaccggggtttcccggggggaccgggggttaaccgtaaagggggttcggtaagtaccgtacggaacgggtaaacgtcgttcgggacggttcacgggtaccttaccgtttcttccgttcgtttcctaaccgttaccttcccgttacccgtcgttcgttaacg

SEQ ID NO: 413014 - DNA, 549 bp, Homo sapiens
  misc_feature: GZ8MTXP01AOD4A.44.65.F10.1.454.CMB.2.raw
  modified_base (197)..(197): a, c, t, g, unknown or other
  modified_base (271)..(271): a, c, t, g, unknown or other
  modified_base (279)..(279): a, c, t, g, unknown or other
  modified_base (290)..(290): a, c, t, g, unknown or other
  modified_base (343)..(343): a, c, t, g, unknown or other
  modified_base (346)..(346): a, c, t, g, unknown or other
  modified_base (359)..(359): a, c, t, g, unknown or other
  modified_base (362)..(362): a, c, t, g, unknown or other
  modified_base (507)..(507): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccaccctctcctgcagggccagtcagagtgttaccagcaacttgcctggtaccacagaacctgggcaggcnccagctcnatctatgaacntccacaggccatgtactcccaccgaggttcagtggcaggtcgggtccccgganagngttccactctacnctntcgacggcgcctgcagtctgaggtatttgcttagtttatactgtacagctagtaataactacggtgtaccttctcgtaccgttcggggcgggggaactaggggtgaaggtactacgaaagtaagtggttagcttagctaaccttnttccgttacgtcttcaacttccccgtaccgctaattcgtaag

SEQ ID NO: 413015 - DNA, 694 bp, Homo sapiens
  misc_feature: GZ8MTXP01DOE8A.44.65.F10.1.454.CMB.2.raw
  modified_base (199)..(199): a, c, t, g, unknown or other
  modified_base (273)..(273): a, c, t, g, unknown or other
  modified_base (283)..(283): a, c, t, g, unknown or other
  modified_base (289)..(289): a, c, t, g, unknown or other
  modified_base (294)..(294): a, c, t, g, unknown or other
  modified_base (349)..(349): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaagggggaaanacgcccaccctctcctgcagggccagtcagagtgttacagcaacttgcctggtaccacagaacctgggcaggcncccaggctcnatctangaacntccacaggccatgtactcccaccaggttcagtcggcaggtcgggtaccccggganagacgtttccacttaccgtaccaacctataccgacggtccgggccttagggtacgttcgtagggtaagggttatttttcggacgttaaggtttttaacttaccgttaggttacaacggtactaaggttaaattaaacgttaaaccgttcgggggttaccccttacgtttacccgtaaccggggttttaccgggggacccggggggtaaacccgtaaagggggttacgggaaacggtaacgttaaccggaaaaaccggtacggttggttacgggcttacgggcctaaccgtacttcgttgttaccctttcaacgtttccttaccccgccttaatccgttaagtaac

SEQ ID NO: 413016 - DNA, 672 bp, Homo sapiens
  misc_feature: GZ8MTXP01BNCDC.44.65.F10.1.454.CMB.2.raw
  modified_base (195)..(195): a, c, t, g, unknown or other
  modified_base (313)..(313): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactgagaaatagtgatgacgcggtctccagccacctgtctgtgtctccgaggggaaancgccaccctctcctgcagggccagtcagagtgttagcagctaacttacgcctacgtaccagacaaggaaatcgtcggacccacggcctacccgacggcctcctacattctagtggtcncctactcccgaaccgacgggccctacgtcggtacctcccgacgccgtacggttcgacggtcggcgtaaggggttcggggtccgtaggggaaacctaagggttcgttaccgaacccttccgtaccaacccgtacgtacgacgcacggccctgaccgtagttcgtaagtaagtttacttttgacgttagttttactacgtgtacgagtacgtaaattataagtcgtacgttcgggtaccccttccggtacggaccgtaacgggactaacggaacgttaggaaacgttaaacgttaaaaccggagttacggttcggaccttaacggacctaactacttcgttacgttccttaacgtaacccg

SEQ ID NO: 413017 - DNA, 661 bp, Homo sapiens
  misc_feature: GZ8MTXP01C6C8H.44.65.F10.1.454.CMB.2.raw
  modified_base (198)..(198): a, c, t, g, unknown or other
  modified_base (304)..(304): a, c, t, g, unknown or other
  modified_base (330)..(330): a, c, t, g, unknown or other
  modified_base (589)..(589): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagcccaccctgtctgtgtctccgaggggaaancgcccaccctctcctgcagggccagtcagagtgtaagcagactaacttcgcctacgtaccagacaagaaatcgtggccaggcctcccaggcctcctcatctatggncactcccacgagggccacgtggtacnccgagccgtaggttcaggttccggcgtagggtgggtcgtggggaaactaggtgttcaaccgtctaccaacctactccaaggcacgtcctagccgtaagttacgtaaggtaacggtttattttacggactttaaagttttacttaaaccgttggtaacctaagttaaccgtaaaggttaattaaacgtcggtaaccttccgggtaaccccttcccggttacgggacccgaaaggggcctaacggtacggttagggtaaanaaacgtttaaaacgggcgttgggttcgttcgtaacgaccctcgtacgttccgttattccgttccttaacccg

SEQ ID NO: 413018 - DNA, 687 bp, Homo sapiens
  misc_feature: GZ8MTXP01C6ZES.44.65.F10.1.454.CMB.2.raw
  modified_base (198)..(198): a, c, t, g, unknown or other
tcagacagtatatacacgaccggtgctcgatttagctacgctctaaggggggaggaactgctcagttaggacccagacggaaccatggaagccccagcgcagcttctcttcctcctgctactctggctcccagataccactggagaaatagtgatgacgcggtctccagccacctgtctgtgtctccgaaggggaaancgcccacctctcctgcagggccagtcagagtgtagcagctaacttgcctacgtaaccagcaagaaatcgtaggccaggcctccgaggcctcctcatctatggtcaccacgtacccaccgacggggccctacgtcgggtacctccccgaggtcccgtaagggtttcaacgggttcggaccgtagggttggggtcctagggggaaactaacggtcgtttccaaccttcctaccaaccctagtccgacggtaccctaggtcccttaggcttaacggttacgtaagttaacgtttatttttacgacgtttaaagttttacttaccttggttactaacggtactaaagtttacgtaaatccgtaaccgttcggtaccccttcccgttacgggaccgaacgggtacaaccggtacgttaggggtaaacttaaacgttaaacggacgttggcggttacttcgacctaacgtacttcgttacttcccttcgtaaccc

SEQ ID NO: 413019 - DNA, 764 bp, Homo sapiens
  misc_feature: GZ8MTXP01EC0R9.44.65.F10.1.454.CMB.2.raw
  modified_base (195)..(195): a, c, t, g, unknown or other
  modified_base (205)..(205): a, c, t, g, unknown or other
  modified_base (221)..(221): a, c, t, g, unknown or other
  modified_base (294)..(294): a, c, t, g, unknown or other
  modified_base (671)..(671): a, c, t, g, unknown or other
  modified_base (724)..(724): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaanagccaccctntcctgcggacgctagngagtgttactacgagactaacgtcgcgtacgacccaacgaacgtaacggtgacgacgtcccacgagtcctcanacttactagaacgaactactaccccgaacggacggacctacggttagtaccccacccccgtaacggttagtcgtaggtcgacgaggggttccggggaacccgactaggtacctaccctacgttcccaaccaaccgtagtacccggacgggcccgtcgttacgacggtaaccttggtaagggttaacgttttcgttacggttaaacggttttaaatttttaaacggtcgttacgggaaacctaagggttactaaaattttaaaacgtaaaccgttacgggggtttcctcccgtttaactaaccgggttttaccggggggtaccgggggaaaccgggtaagtttaaagggcggtaaataacggtaaaaccccgtaaagnggtttggccggttacgacgtaacccctaattcggtttcgttccttaacttacnccccgtttttccccggaacccctttataacgtttgtaacg

SEQ ID NO: 413020 - DNA, 488 bp, Homo sapiens
  misc_feature: GZ8MTXP02IGFTZ.44.65.F10.1.454.CMB.2.raw
  modified_base (345)..(345): a, c, t, g, unknown or other
  modified_base (347)..(347): a, c, t, g, unknown or other
tcagacagtatatacacgaccggtgctcgatttagctacgctctaaggggaggaactgctcagttaggacccagacggaaccatggaagccccagcgcagcttctcttcctcctgctactctggctcccagataccactggagaaatagtgatgacgcggtctccagccacctgtctgtgtctccaggggaagagccaccctctcctgcagggccagtcagagtgttagcagcaacttagcctcgtaccagcagaatctggccaggctcccaggctcctcatctatggtgcatcccaccagggccactggtatcccagcccaggttcagtgcagtggctgggacngngttcactctcaccatcagcagcctgcagtctgagtatttgctagtttattactgtcagcagtataatgactggcctccgttcggcctaagggacacgactaggagattaaacgactagtgctgcacactctcgtcttctac

SEQ ID NO: 413021 - DNA, 503 bp, Homo sapiens
  misc_feature: GZ8MTXP02I2DV9.44.65.F10.1.454.CMB.2.raw
  modified_base (196)..(196): a, c, t, g, unknown or other
  modified_base (355)..(355): a, c, t, g, unknown or other
  modified_base (357)..(357): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttaccagcaacttagcctggtaccacagaacctggcaggctccaggctctcatctatggaacatccaccaggccactggtactcccacccagttcagtgcagtggtcccggacagagttcactctcncntcagccgcctgcagtctgagtatttgctagtttattactgtcagcagtataataactgtctctctacgttcgggcgggggacaggtggagatacgaaacgtacgtgtaggctgcaccatctgtcttcactccttccgcctatctag

SEQ ID NO: 413022 - DNA, 503 bp, Homo sapiens
  misc_feature: GZ8MTXP02GC858.44.65.F10.1.454.CMB.2.raw
  modified_base (356)..(356): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaatctggccaggctcccaggctcctcatctatggtgcatccaccgagggccactggtactcccagccaggttcagtcggcaggtggtctggggacaggngttcactctcaccatcagcagcctgcagtctagatatttgctagtttattactgtcagtcagttataatgactggtcctccgtcggaccgaaggcacggactggaactaacttaaacgactggtagctgacacactctcgtctctac

SEQ ID NO: 413023 - DNA, 510 bp, Homo sapiens
  misc_feature: GZ8MTXP02GF9CN.44.65.F10.1.454.CMB.2.raw
  modified_base (195)..(195): a, c, t, g, unknown or other
  modified_base (353)..(353): a, c, t, g, unknown or other
  modified_base (509)..(509): a, c, t, g, unknown or other
tcagacagtatatacacgaccggtgctcgatttagctacgctctaaggggaggaactgctcagttaggacccagacggaaccatggaagccccagcgcagcttctcttcctcctgctactctggctcccagataccactggagaaatagtgatgacgcggtctccagccaccctgtctgtgtctccaggggaaanagccaccctctcctgcagggccagtcagagtgttagcagcaacttagcctcgtaccagcagaaatctggccagctcccaggctcctcatctatggtgcatccaccagggcccactggtactcccagccaggttcagtggcagtgggtctgggacaggngttcactctcaccatcagcagccctgcagtctgaagtattttgctagtttattactgtcagcagtataatgactcggcctcccgttggacccgaaggggaccacgacgtgggaactaaagttaaaccgaacgtgtaggctgccacatctctcttcnc

SEQ ID NO: 413024 - DNA, 545 bp, Homo sapiens
  misc_feature: GZ8MTXP02I6TUR.44.65.F10.1.454.CMB.2.raw
  modified_base (293)..(293): a, c, t, g, unknown or other
  modified_base (303)..(303): a, c, t, g, unknown or other
  modified_base (358)..(358): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaatctggccaggctcccaggctcctcatctatggtncatcccaccngggccacgtggtactcccagccaggttcagtcggcaggtgggtctggggacaggngttcactctcaccatcagcagcctgcagtctagaagtattttgctagtttattactgtcagctagtataatgactcggcccttccgttcggaccgtaagggaccaacggacgtagggaagtaaacgttaaaacggaacgtaggtcggtacgtaacgacctacccagttcctcggttccttactaccg

SEQ ID NO: 413025 - DNA, 546 bp, Homo sapiens
  misc_feature: GZ8MTXP02GM92N.44.65.F10.1.454.CMB.2.raw
  modified_base (196)..(196): a, c, t, g, unknown or other
  modified_base (262)..(262): a, c, t, g, unknown or other
  modified_base (293)..(293): a, c, t, g, unknown or other
  modified_base (354)..(354): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaanagccacctctcctgcagggccagtcagagtgttagcagcaacttagcctcgtaccagcagaaatcnggccaggctcccaggctcctcatctatggtncatccaccagggccactggtactcccgagccaggttcagtcggcagtgggtctgggacagngttcactctcaccatcagcagcctgcagtctagaagtattttagacttagtttattacgtgtacgagtagtaataatagtacgtacgtccgtccttccggtaccgaacgggaacgacgaaccgtacggtaggaacgttaaaacgtaaacgtacgtaggtcgtacgcgacctactactcgtcttactactccg

SEQ ID NO: 413026 - DNA, 529 bp, Homo sapiens
  misc_feature: GZ8MTXP02IJDPV.44.65.F10.1.454.CMB.2.raw
  modified_base (197)..(197): a, c, t, g, unknown or other
  modified_base (263)..(263): a, c, t, g, unknown or other
  modified_base (271)..(271): a, c, t, g, unknown or other
  modified_base (280)..(280): a, c, t, g, unknown or other
  modified_base (286)..(286): a, c, t, g, unknown or other
  modified_base (290)..(290): a, c, t, g, unknown or other
  modified_base (306)..(306): a, c, t, g, unknown or other
  modified_base (312)..(312): a, c, t, g, unknown or other
  modified_base (316)..(316): a, c, t, g, unknown or other
  modified_base (320)..(320): a, c, t, g, unknown or other
  modified_base (332)..(332): a, c, t, g, unknown or other
  modified_base (335)..(335): a, c, t, g, unknown or other
  modified_base (345)..(345): a, c, t, g, unknown or other
  modified_base (348)..(348): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttaccagcaacttagcctggtaccacaagaaccnggcaggcnccgagctcnatctangacntccacaggcatgtacncccacngtcngtgnaggtggccgganagngtcactctcnccntcagccgtcctgctagtctagaggtatttgcttagtttatactgtcagctaagtataaatacgtcgtactctacgtacggttcgggacgggggtacagggtgaagactaacgaaacgtacgtggtagctagccaactcgtctcgtcctttacactttcccgtacccgtacctacttctaag

SEQ ID NO: 413027 - DNA, 505 bp, Homo sapiens
  misc_feature: GZ8MTXP02H9FOQ.44.65.F10.1.454.CMB.2.raw
  modified_base (194)..(194): a, c, t, g, unknown or other
  modified_base (356)..(356): a, c, t, g, unknown or other
tcagacagtatatacacgaccggtgctcgatttagctacgctctaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaanagccacctctcctgcagggccagtcagagtgttaccagcaacttagcctggtaccaccagaaacctgggcaggctccaggctcctcatctatggaacatccaccaggccactggtactcccaccaggttcagtgcagtggtcccggacagagttcactctcnccatcagcgcctgcagtctgaggtatttgctagtttattactgtcagcagtataataactggctactcactttcgggcgggggacaaggtggagatacgaaaacgaactgtaggctagcaccatctgtcttcactcttccgcctatcta

SEQ ID NO: 413028 - DNA, 524 bp, Homo sapiens
  misc_feature: GZ8MTXP02GZLU3.44.65.F10.1.454.CMB.2.raw
  modified_base (196)..(196): a, c, t, g, unknown or other
  modified_base (294)..(294): a, c, t, g, unknown or other
  modified_base (359)..(359): a, c, t, g, unknown or other
tcagacagtatatacacgaccggtgctcgatttagctacgctctaagggggaggaactgctcagttaggacccagatggaaccatggaagccccagcgcagcttctcttcctcctgctactctggctcccagataccactggagaaatagtgatgacgcggtctccagccaccctgtctgtgtctccaggggaaanagccaccctctcctgcagggccagtcagagtgttagcagcaacttagcctcgtaccagcagaaatctggccaggctcccaggctcctcatctatggtncatcccacgagggccacgtggtactccccgagcccaggttcagtggcaggtggggtctggggacngagttcactctcaccatcagcagcctgcagtctgaagtattttgacttagtttattactgtcagctagtataatgactggcccttccgttcggaccgaagggacacggactgggaacgaacgttaaacgaacttgtacggcgtcgacacctatcttcgtctttcg

SEQ ID NO: 413029 - DNA, 517 bp, Homo sapiens
  misc_feature: GZ8MTXP02I0BGB.44.65.F10.1.454.CMB.2.raw
  modified_base (196)..(196): a, c, t, g, unknown or other
  modified_base (354)..(354): a, c, t, g, unknown or other
  modified_base (356)..(356): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaanagccaccctctcctgcagggccagtcagagtgttagcagcaacttagcctcgtaccagcagaaatctggccaggctcccaggcctcctcatctatggtgcatccaccaggccactggtactcccagccaggttcagtcggcaggtgggtctggggacngngttcactctcaccatcagcagcctgcagtctagagtatttgctagtttattactgtcagcagtataatgactggtcctcccgttcggacctaaaggggacacggactagggaacgtaaattaaacgaacgtgtaggctgcacctatcctacgtcttctacg

SEQ ID NO: 413030 - DNA, 481 bp, Homo sapiens
  misc_feature: GZ8MTXP02JEONV.44.65.F10.1.454.CMB.2.raw
  modified_base (196)..(196): a, c, t, g, unknown or other
  modified_base (262)..(262): a, c, t, g, unknown or other
  modified_base (293)..(293): a, c, t, g, unknown or other
  modified_base (348)..(348): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaanagccaccctctcctgcagtgccagtcagagtgttagcagcaacttgcctcgtaccagcagaaatcnggccaggctcccaggctcctcatctatggtncatccaccagggccactggtactcccagccaggttcagtgcagtggtctgggacngagtcactctcacatcagcagcctgcagtctgaagtatttgctagtttattactgtcagcagtataatgactggcctccgtcgcaagggacacgactaggagactaaacgactgtagctgcacatctcgtctc

SEQ ID NO: 413031 - DNA, 498 bp, Homo sapiens
  misc_feature: GZ8MTXP02IO5AA.44.65.F10.1.454.CMB.2.raw
  modified_base (356)..(356): a, c, t, g, unknown or other
  modified_base (422)..(422): a, c, t, g, unknown or other
  modified_base (450)..(450): a, c, t, g, unknown or other
  modified_base (491)..(491): a, c, t, g, unknown or other
tcagacagtatatacacgaccggtgctcgatttagctacgctctaaggggaggaactgctcagttaggacccagacggaaccatggaagccccagcgcagcttctcttcctcctgctactctggctcccagataccactggagaaatagtgatgacgcagtctccagccaccctgtctgtgtctccaggggaaatagccaccctctcctgcagggccagtcagagtgttaccagcaacttagcctggtaccacagaaacctgggcaggctcccaggctctcatctatggacatccacaggccactggtatcccacccaggttcagtgcagtgggtcccggacagagttcactctcnccatcagccgcctgctagtctgaggtatttgctagtttatactgtcagcagtataataactgcctntcacttcggcggggacaggtggagatanaaacgtactgtggctagctaccatctgtcttcattctcccnctatctg

SEQ ID NO: 413032 - DNA, 527 bp, Homo sapiens
  misc_feature: GZ8MTXP02JS4U1.44.65.F10.1.454.CMB.2.raw
  modified_base (352)..(352): a, c, t, g, unknown or other
  modified_base (366)..(366): a, c, t, g, unknown or other
  modified_base (482)..(482): a, c, t, g, unknown or other
  modified_base (506)..(506): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaatagccaccctctcctgcagggccagtcagagtgttaccagcaacttagcctggtaccaccagaaacctgggcaggctcccaggctcctcatctatggaacatccaccagggccactggtactccccacccaggttcagtggcaggtgggtcccgganagagttcactctcnccatcagcgcctgcagtctgagtatttgctagtttatactgtcagcagtataataactggcctctcgtacgtttcgggacgggggaccaagggtggagatacgaaacgtacgtggnggctgctaccgatcgtgtcttacncttcctcccgctactcgtacg

SEQ ID NO: 413033 - DNA, 524 bp, Homo sapiens
  misc_feature: GZ8MTXP02HUXDX.44.65.F10.1.454.CMB.2.raw
  modified_base (199)..(199): a, c, t, g, unknown or other
  modified_base (355)..(355): a, c, t, g, unknown or other
  modified_base (367)..(367): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggcctcccagataccactggagaaatagtgatgacgcagtctccagccaccctgtctgtgtctccgaaggggaaanacgccaccctctcctgcagggccagtcagagtgttaccagcaacttagcctggtaccacagaaacctgggcaggctccaggctcctcatctatggaacatccaccagggccaactggtactccccacctaggttcagtgcaggtcgggtcccgganagagttcactcncaccatcagccgcctgcagtctgaggtatttgctagtttatactgtcagacagtataaataactgtcctctacacgtttcgggacgggggacaagggtggagatacgaaaacgtactggtggactgacacatctgtctctactctcctcctactcta

SEQ ID NO: 413034 - DNA, 530 bp, Homo sapiens
  misc_feature: GZ8MTXP02GHX1I.44.65.F10.1.454.CMB.2.raw
  modified_base (194)..(194): a, c, t, g, unknown or other
  modified_base (261)..(261): a, c, t, g, unknown or other
  modified_base (292)..(292): a, c, t, g, unknown or other
  modified_base (353)..(353): a, c, t, g, unknown or other
tcagacagtatatacacgaccggtgctcgatttagctacgctctaaggggaggaactgctcagttaggacccagacggaaccatggaagccccagcgcagcttctcttcctcctgctactctggctcccagataccactggagaaatagtgatgacgcggtctccagccaccctgtctgtgtctccaggggaanagccaccctctcctgcagggccagtcagagtgttagcagcaacttagcctcgtaccagcagaaatcnggccaggctcccaggctcctcatctatggtncatcccaccagggccactgggtatcccagccaggttcagtggcagtgggctggggacaggngttcactctcaccatcagcagcctgcagtctagagtatttgctagtttatactgtcagtcagtataatgactggaccttccgttcggaccgtaaaggggacctacggacttgggaagtaaacttaaaacggacgttggtacggaccttggccaaccgtattcctgttcctttctacc

SEQ ID NO: 413035 - DNA, 749 bp, Homo sapiens
  misc_feature: GZ8MTXP02JVI59.44.65.F10.1.454.CMB.2.raw
  modified_base (196)..(196): a, c, t, g, unknown or other
  modified_base (217)..(217): a, c, t, g, unknown or other
  modified_base (223)..(223): a, c, t, g, unknown or other
  modified_base (231)..(231): a, c, t, g, unknown or other
  modified_base (239)..(239): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcggcgcngcgagngttctacnactagtcncgtacgaccacgaacgtaacggtcggacgacggtccctaccggacggtcccttccactacttactaggtaaccggaactacctaccccaacgggcggaccctacggttagtaccccacccccacggttacggtacagggtcgacgtaggggttcggggaccccgagaggttacgtacctactcaccactactcgaccggccgctggactacgtcgtagggtacggttttcttacgtactttagtttactcgtcgtacgaagtacgttaaagttaaacttaaccgttaccggtccgttacccttacggttaccgggttaccgggggttacccgggggaaccggggttaaacggtaggggtacgtaaacctaaaccggtaaaaccggtaaacggtttcggttcgggtacgttccgtaaccgtaacccttaacgtcgtttaccgttttaccgttaaccgttacccgtttaccccgtttcccccgaccccgttacgttaactttaccgttaaag

SEQ ID NO: 413036 - DNA, 548 bp, Homo sapiens
  misc_feature: GZ8MTXP02JH9UH.44.65.F10.1.454.CMB.2.raw
  modified_base (196)..(196): a, c, t, g, unknown or other
  modified_base (261)..(261): a, c, t, g, unknown or other
  modified_base (293)..(293): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaanagccaccctctcctgcagggccagtcagagtgtagcagcaacttgcctcgtaccagcagaaatcnggccaggctcccaggcctcctcatctatggtncatcccaccgagggccacgtggtactcccgagccaggttcagtcggcaggtcggtctggggacagtcgttccactcctccacatcagcacgcctgcagtctagaacgtatttgacttagtttattactgtcagtcagtataatgactcggtcccttcccgttcggaccgtaagggaccacggtacgtaggaaacgtaacttaaacggacgtggtacggtactggacctaaccgtatcctcgttcctttactaccg

SEQ ID NO: 413037 - DNA, 498 bp, Homo sapiens
  misc_feature: GZ8MTXP02HZ0M1.44.65.F10.1.454.CMB.2.raw
  modified_base (262)..(262): a, c, t, g, unknown or other
  modified_base (293)..(293): a, c, t, g, unknown or other
  modified_base (353)..(353): a, c, t, g, unknown or other
  modified_base (367)..(367): a, c, t, g, unknown or other
  modified_base (489)..(489): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccacctctcctgcagggccagtcagagtgttagcagcaacttagcctcgtaccagcagaaatcnggccaggctcccaggctcctcatctatggtncatccaccagggccactggtactcccagccaggttcagtcggcaggtggtctgggacagngttcactctcaccntcagcagcctgcagtctgaagtattttgctagtttattacttgtactagcagtataatgactggcctccgtcgacaaggacacgactaggataataaacgactgtaggctgacacactcgtntctttacac

SEQ ID NO: 413038 - DNA, 584 bp, Homo sapiens
  misc_feature: GZ8MTXP02GD4MB.44.65.F10.1.454.CMB.2.raw
  modified_base (197)..(197): a, c, t, g, unknown or other
  modified_base (265)..(265): a, c, t, g, unknown or other
  modified_base (295)..(295): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaanagcccaccctctcctgcagggccagtcagagtgttagcagcaacttagcctcgtaccagcagaaatcnggccaggctccaggctcctcatctatggtncactcccaccgagggcccacgtggtactcccgagcctaggttcaggtcggcaggtgggtctggggacagtgttcactctacaccatcagcagcctgctagtctagaagttatttgacttagtttattactgtacagtctaagttaataagtcgtacgtcgggtaccccttcccgttacggacccgtaaaggggacctaacggacgttagggaaactaaaacgtttaaaacggaacgttggtacggactaacggacctaaccgtacttccttacgttcctttactacccg

SEQ ID NO: 413039 - DNA, 492 bp, Homo sapiens
  misc_feature: GZ8MTXP02HTMTB.44.65.F10.1.454.CMB.2.raw
  modified_base (294)..(294): a, c, t, g, unknown or other
  modified_base (351)..(351): a, c, t, g, unknown or other
  modified_base (387)..(387): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggctcccaggctcctcatctatggtncatccaccagggccatggtactcccagccaggttcagtcgcagtggtctgggacagngttcactctcaccatcagcagcctgcagtctgaatntttgctagtttatactgtcagcagtataatgactcggcctccgttcggaccaagggacacgactggaacattaaacgactgtaggctgcactatctagtctctac

SEQ ID NO: 413040 - DNA, 547 bp, Homo sapiens
  misc_feature: GZ8MTXP02GTLES.44.65.F10.1.454.CMB.2.raw
  modified_base (196)..(196): a, c, t, g, unknown or other
  modified_base (340)..(340): a, c, t, g, unknown or other
  modified_base (359)..(359): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaanagcccaccctctcctgcagggccagtcagagtgttagcagcaacttagcctcgtaccagcagaaatctggccaggctcccaggcctcctcatctatggtgcatccaccagggccactggtactcccagccaggttcagtcggcnggtgggtctggggacaggngttcactctcaccatcagcagcctgcagtctagaagtattttagacttagtttacttagttgtacgtagtacgtattaatagtacgtcgtaccgtcccttccggtaccgaacggacgacgacgtacggagaaacgtaaacgtaaacgtacgtcgtcgtcgaacgactacgtactcgtctcctactccc

SEQ ID NO: 413041 - DNA, 540 bp, Homo sapiens
  misc_feature: GZ8MTXP02HOLUH.44.65.F10.1.454.CMB.2.raw
  modified_base (299)..(299): a, c, t, g, unknown or other
  modified_base (324)..(324): a, c, t, g, unknown or other
  modified_base (387)..(387): a, c, t, g, unknown or other
  modified_base (410)..(410): a, c, t, g, unknown or other
  modified_base (414)..(414): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagagcccaccctctcctgcagggccagtcagagtgttagcagcaacttagcctcgtaccagcagaaatctggccaggctcccgaggcctcctcatctagtggtncatcccaccgagggccagtggtacncccgagcctaggttcaggtcggctaggtgggtctggggacaggtgttcactctccacctatcngcagccgtgcagtctagaagttnttgnttagtttatagtgtacagtatagtatatcgacgtcgccctccgtacggacgaacggacacgtacgtaggaaactaaacgttaaacgcgtcggtacgctaacgacacgtatcgttcgttacttactc

SEQ ID NO: 413042 - DNA, 559 bp, Homo sapiens
  misc_feature: GZ8MTXP02JBMGG.44.65.F10.1.454.CMB.2.raw
  modified_base (283)..(283): a, c, t, g, unknown or other
  modified_base (293)..(293): a, c, t, g, unknown or other
  modified_base (356)..(356): a, c, t, g, unknown or other
  modified_base (368)..(368): a, c, t, g, unknown or other
  modified_base (372)..(372): a, c, t, g, unknown or other
  modified_base (376)..(376): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttgcctcgtaccagcagaaatctggccaggctcccaggctcctnatctatggtncatcccaccagggccactggtactccccagcctaggttcaggtcggcaggtgggtctgggacngtgttcacttcncacntcancagcctgctagtctagtaagttattttgacgttagtttattacgtgtacagtctagttataagtgtacgtcggtcccttccgtaccggaccgaaacgggaccgaacggtacgtacggtaacgtaaacgttaaaaccgtacgtcggtacgcgtaacgacctactacgtcgttcgttcttactac

SEQ ID NO: 413043 - DNA, 526 bp, Homo sapiens
  misc_feature: GZ8MTXP02GJMYS.44.65.F10.1.454.CMB.2.raw
  modified_base (197)..(197): a, c, t, g, unknown or other
  modified_base (285)..(285): a, c, t, g, unknown or other
  modified_base (291)..(291): a, c, t, g, unknown or other
  modified_base (295)..(295): a, c, t, g, unknown or other
  modified_base (357)..(357): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaanagccaccctctcctgcagggccagtcagagtgttagcagcaacttagcctcgtaccagcagaaatctggccaggctcccaggctcctnatctanggtncatcccacgagggccactggtactcccagccaggttcaggtcgcagtgggtctgggacaggngttcactctcacatcagcagcctgcagtctagaagtattttgacttagtttatacgttgtacagtctagtataatcgtactcggtcccttcccgttcggaccgaagggaccacggacgtaggacgtaaattaaacgaacgtgtggctgacacctagtcctgttctctac

SEQ ID NO: 413044 - DNA, 543 bp, Homo sapiens
  misc_feature: GZ8MTXP02HHY74.44.65.F10.1.454.CMB.2.raw
  modified_base (197)..(197): a, c, t, g, unknown or other
  modified_base (277)..(277): a, c, t, g, unknown or other
  modified_base (288)..(288): a, c, t, g, unknown or other
  modified_base (312)..(312): a, c, t, g, unknown or other
  modified_base (333)..(333): a, c, t, g, unknown or other
  modified_base (336)..(336): a, c, t, g, unknown or other
  modified_base (344)..(344): a, c, t, g, unknown or other
  modified_base (349)..(349): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgtaccagcaatgcctggaccacagaacctgggcaggctccaggctcctnatctatgaacntccacaggccatgtactcccaccngtcagtgcaggtggcccgganagngtcactcncaccntcagccgctgctagtctgaggtatttgctagtttatactgtcagtctaagtaataataactcggtacctctaccgtaacgtttcgggggacgggggaaccgtaaggggtcggaagaagtaacgaaaaacgtacgtaggtcggaccgtaggaccacgtacttctgtccttcacttcctacccgtcctacttctag

SEQ ID NO: 413045 - DNA, 496 bp, Homo sapiens
  misc_feature: GZ8MTXP02FHGY3.44.65.F10.1.454.CMB.2.raw
  modified_base (351)..(351): a, c, t, g, unknown or other
  modified_base (368)..(368): a, c, t, g, unknown or other
tcagacagtatatacacgaccggtgctcgatttagctacgctctaagggggaggaactgctcagttaggacccagatggaaccatggaagccccagcgcagcttctcttcctcctgctactctggctcccagataccactggagaaatagtgatgacgcggtctccagccaccctgtctgtgtctccgaggggaaagagccaccctctcctgcagggccagtcagagtgttagcagcaacttagcctcgtaccagcagaaatctggccaggctcccaggctcctcatctatggtgcatccaccgagggcccacgtggtactcccgagccaggttcagtggcaggtgggtcngggacagcgttcactcncacatcagcagcctgcagtcagaagtatttgactagtttatctgtcagcagtataatgactggcctcctcggcaagggacacgactaggatacgttaaacgactgtaggctgacaccatcagtcttac

SEQ ID NO: 413046 - DNA, 536 bp, Homo sapiens
  misc_feature: GZ8MTXP02IJ8BP.44.65.F10.1.454.CMB.2.raw
  modified_base (195)..(195): a, c, t, g, unknown or other
  modified_base (260)..(260): a, c, t, g, unknown or other
  modified_base (279)..(279): a, c, t, g, unknown or other
  modified_base (289)..(289): a, c, t, g, unknown or other
  modified_base (297)..(297): a, c, t, g, unknown or other
  modified_base (344)..(344): a, c, t, g, unknown or other
  modified_base (346)..(346): a, c, t, g, unknown or other
  modified_base (382)..(382): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaanagccaccctctcctgcagggccagtcagagtgttagcagcaacttgcctcgtaccagcagaatcnggccaggctccaggctctnatctatggtncatccacnggccactggtactcccagccaggttcaggtcgcagtggtctgggacngngttcactctcaccatcagcagcctgcagtctgaatntttgactagtttattactgtcagtcagttataatgactcggtcctcccgttcggacccgtaaaggggaccacggtaccgtaggaacgtaaacgttaaaaccgtacgttaggtacggacttcgaccaccctatcctacgtttccttacttacccg

SEQ ID NO: 413047 - DNA, 567 bp, Homo sapiens
  misc_feature: GZ8MTXP02HACEA.44.65.F10.1.454.CMB.2.raw
  modified_base (197)..(197): a, c, t, g, unknown or other
  modified_base (260)..(260): a, c, t, g, unknown or other
  modified_base (277)..(277): a, c, t, g, unknown or other
  modified_base (309)..(309): a, c, t, g, unknown or other
  modified_base (341)..(341): a, c, t, g, unknown or other
  modified_base (352)..(352): a, c, t, g, unknown or other
  modified_base (354)..(354): a, c, t, g, unknown or other
  modified_base (557)..(557): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanacgccaccctctcctgcagggccagtcagagtgttaccagcaacttgcctggaccacagaacnggcaggcctccagctcncatctatgaacatccaccgaggccagtgtacncccaccctggtcaggtgcaggtcggcccgganagtgtcactcncnccatcacgccgcctgcagtctgagttatttgacttagtttatacgtgtacagtctaaagtattaaactaacgtcggtaccttcgtaccgttacggtttccgggggacgggggtaaccgtaaggggtagggaacgtaacgtacgaaaacggtaacgttggacggtctcggacaccctatcgtgtcctctacttcccgttacccnctacgtactg

SEQ ID NO: 413048 - DNA, 545 bp, Homo sapiens
  misc_feature: GZ8MTXP02JVVYN.44.65.F10.1.454.CMB.2.raw
  modified_base (196)..(196): a, c, t, g, unknown or other
  modified_base (293)..(293): a, c, t, g, unknown or other
  modified_base (363)..(363): a, c, t, g, unknown or other
  modified_base (438)..(438): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccacctctcctgcagggccagtcagagtgtaccagcaacttagcctggtaccaccagaaacctgggcaggctcccaggctcctcatctatggaacntccacaggccatggtactccccaccctaggttcagtggcaggtggggccccggacaggtacgttcactcncaccatcagcgctgctagtctgagtatttgctagtttatactgtcagtctaagtaataaataacgtcggtacctnttacgtacgtttcggggaccgggggacctaaggggtggagtacgtacgaaaacggtacgtggtaggctggacacctatctgtcttcacttccttcccgctactctag

SEQ ID NO: 413049 - DNA, 533 bp, Homo sapiens
  misc_feature: GZ8MTXP02IGMKR.44.65.F10.1.454.CMB.2.raw
  modified_base (196)..(196): a, c, t, g, unknown or other
  modified_base (293)..(293): a, c, t, g, unknown or other
  modified_base (302)..(302): a, c, t, g, unknown or other
  modified_base (351)..(351): a, c, t, g, unknown or other
  modified_base (389)..(389): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccaccctctcctgcagggccagtcagagtgttagcagcaacttgccctgtaccagcagaaatctggccaggctcccaggcctcctcatctatggtncatcccacngggccactggactcccagccaggttcagtcggcagtggtctgggacagngttcacttctcaccatcagcagcctgcagtctgaagtnttttgctagtttattactgtacagctagtataaatgaactggtcctcccgttcggacccaaaggggacccaacggacgttggaagtaaacgttaaaacggacgtacggttggacctgaccacctatcttcggttcctttactac

SEQ ID NO: 413050 - DNA, 567 bp, Homo sapiens
  misc_feature: GZ8MTXP02I8SQ7.44.65.F10.1.454.CMB.2.raw
  modified_base (351)..(351): a, c, t, g, unknown or other
  modified_base (353)..(353): a, c, t, g, unknown or other
  modified_base (362)..(362): a, c, t, g, unknown or other
  modified_base (395)..(395): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggctcccaggctcctcatctatggtgcatccaccagggccactggtactcccagccaggtcagtggcagtgggtctggggacngngttcactcncaccatcagcagccctgcagtctagaaacgttntttgacttagtttattacgtgtacagtactaagttaataagtcgtacgttcggtcccttcccgttaccggaccgtaaacgggacctaacggtacgtagggaacgtaaacgttaaaacggacgttaggtacggtactaacgtaccaccgtacttcgtacgttaccttactacg

SEQ ID NO: 413051 - DNA, 532 bp, Homo sapiens
  misc_feature: GZ8MTXP02F2TB5.44.65.F10.1.454.CMB.2.raw
  modified_base (196)..(196): a, c, t, g, unknown or other
  modified_base (263)..(263): a, c, t, g, unknown or other
  modified_base (294)..(294): a, c, t, g, unknown or other
  modified_base (358)..(358): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaanagccaccctctcctgcagggccagtcagagtgttagcagcaacttgcctcgtaccagcaagaaatcnggccaggctcccaggctcctcatctatggtncatccaccagggccactggtactcccagccaggttcaggtcggcaggtgggtctggggacaggngttcactctcaccatccagcagccctgcagtctagaagtatttgctagtttattactgtcagcagttaataatgacgtggcccttccgttacgaccgtaaagggacacggacgttagggaactaaagttaaaacgaacgtggtacggctaagctaacactcgtagtcttctacg

SEQ ID NO: 413052 - DNA, 547 bp, Homo sapiens
  misc_feature: GZ8MTXP02GNKYK.44.65.F10.1.454.CMB.2.raw
  modified_base (196)..(196): a, c, t, g, unknown or other
  modified_base (296)..(296): a, c, t, g, unknown or other
  modified_base (423)..(423): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccacctgtctgtgtctccgaggggaaancgccaccctctcctgccagggccagtcagagtgtagcagcaacttgcctcgtaccagcaagaatctggccaggcctcccgaggcctcctcatctatggtncactcccaccgagggcccactggtactcccgagcctaggttcaggtcggacgtaggtcggggtactggggaccaggtacgtttccacgttcctacaccatccagcagccctgctagtctagaagttntttgcttagtttacttacttgtcagtcaagttatagtgactcggtccttccgtcggacgaagggacacggtactggaactaaagttaaacgactggtgctgacctactatctacgtcttcgtac

SEQ ID NO: 413053 - DNA, 504 bp, Homo sapiens
  misc_feature: GZ8MTXP02I9DB6.44.65.F10.1.454.CMB.2.raw
  modified_base (296)..(296): a, c, t, g, unknown or other
  modified_base (306)..(306): a, c, t, g, unknown or other
  modified_base (355)..(355): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggcctcccaggcctcctcatctatggtncatccaccgngggccactggtactcccagccaggttcagtcggcagtggctgggacagngttcactctacaccatcagcagcctgcagtcagaatattttgctagtttattactgtacagctagtataatcgactggccctcgtcggaccaagggacacgactggaactaattaaacgactgtacgctaagcacgatctcgtctctac

SEQ ID NO: 413054 - DNA, 517 bp, Homo sapiens
  misc_feature: GZ8MTXP02J11EP.44.65.F10.1.454.CMB.2.raw
  modified_base (196)..(196): a, c, t, g, unknown or other
  modified_base (279)..(279): a, c, t, g, unknown or other
  modified_base (367)..(367): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgtaccagcaacttagcctggtaccacagaacctgggcaggctccaggctccncatctatggaacatccaccagggccacgtggtatccccacccaggttcagtggcaggtcgggtccccgggacaggacgttcactctcnccatcagcggcctgccagtctgaggtattttgctagtttatctgtcagctagtataaataactggctctcacgtttcggcgggggtaccaaggtggagatacgaaacgaactgtagctgcaccatctgtctcactcttcccgctactcta

SEQ ID NO: 413055 - DNA, 548 bp, Homo sapiens
  misc_feature: GZ8MTXP02GYIRK.44.65.F10.1.454.CMB.2.raw
  modified_base (196)..(196): a, c, t, g, unknown or other
  modified_base (282)..(282): a, c, t, g, unknown or other
  modified_base (417)..(417): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccaccctctcctgcagggccagtcagagtgttagcagcaacttgcctcgtaccagcagaaatctggccaggctcccaggcctccncatctatggtgcatccacagggccactggtactcccagccaggttcagtcggcaggtgggtctggggacagtgttcactcctcaccatccagcagccctgcagtctagaagtatttgctagtttattactgtacngactagtataaatacgtggcccttaccgttcggaccgaagggaccacggacgtaggaataacgtttaaaacgaacgtggtacggcttacggaaccaacctacgttcttcgtacctttaccgactttccccg

SEQ ID NO: 413056 - DNA, 527 bp, Homo sapiens
  misc_feature: GZ8MTXP02J2MQY.44.65.F10.1.454.CMB.2.raw
  modified_base (196)..(196): a, c, t, g, unknown or other
  modified_base (289)..(289): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccacccctctgcagggccagtcagagtgttaccagcaacttgcctggtaccacagaaacctgggcaggctcccaggctcctcatctatggtncatccaccagggccacgtggtactccccagccaggttcagtggcagtcgggtctggggacagagttcactctcaccatcagcagcctgcagtctgaagtattttgctagtttatactgtacagcagtaataattgactggcctcccgttacggccaaagggcacgacgtggaacgtaacttaaacgaacgtggtacggctacgactaccaagttcctgtcctttcacttccttccgcc

SEQ ID NO: 413057 - DNA, 675 bp, Homo sapiens
  misc_feature: GZ8MTXP02I3C0V.44.65.F10.1.454.CMB.2.raw
  modified_base (195)..(195): a, c, t, g, unknown or other
  modified_base (278)..(278): a, c, t, g, unknown or other
  modified_base (284)..(284): a, c, t, g, unknown or other
  modified_base (290)..(290): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccacctgtctgtgtctccaggggaaangccacctctcctgcagggccagtcagagtgttaccagcaacttgcctggtaccacagaacctgggcaggctcccaggctcctnatctanggaacnctccaccgagggccacgtggtactccccacccgtaggttcaggtggcagggtcggggtccccggactaggtacgttccacgttcctaccgaccattccgaggtcccgggtacccttggcctaggttccgtaggtaacgggttatttttggacctttaaggtttttaacttaccgttaggttacaacggtactaaggttaaattaaacgttaacgttcggtaccttccgttacgttacccggtttccgggggacgggggtaacctaagggggtacggagtaacgtacgaaaacggtaacgtcgggtacggtctacggacctaccgtacgttcgttacgttccgttaccgtacgttcccctttacccggaccttacgttaccttaag

SEQ ID NO: 413058 - DNA, 554 bp, Homo sapiens
  misc_feature: GZ8MTXP02H5A17.44.65.F10.1.454.CMB.2.raw
  modified_base (196)..(196): a, c, t, g, unknown or other
  modified_base (232)..(232): a, c, t, g, unknown or other
  modified_base (276)..(276): a, c, t, g, unknown or other
  modified_base (288)..(288): a, c, t, g, unknown or other
  modified_base (295)..(295): a, c, t, g, unknown or other
  modified_base (346)..(346): a, c, t, g, unknown or other
  modified_base (365)..(365): a, c, t, g, unknown or other
  modified_base (392)..(392): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaangcccacctctcctgcagggccagtcagagtgtaccngcaacttgcctggtaccaccagaacctggcaggctccaggctcncatctatgaacntccacgnggccacgtggtactccccaccgtggttcaggtgcagggtcggggcccgganagacgttccactctcaccntcacggccgcctgctagtcgtgagttntttgctagttttacttagtgtcagtactagtaataatacgtcggtactctcgtacggttcgggacgggggtactaggtggagtagtacgaaacgtactggtggctacggacctacgtacttctcgttaacttacctacttcccttcccgactacttactacg

SEQ ID NO: 413059 - DNA, 552 bp, Homo sapiens
  misc_feature: GZ8MTXP02F74GI.44.65.F10.1.454.CMB.2.raw
  modified_base (196)..(196): a, c, t, g, unknown or other
  modified_base (314)..(314): a, c, t, g, unknown or other
  modified_base (368)..(368): a, c, t, g, unknown or other
  modified_base (543)..(543): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttaccagcaacttgcctggtacccacagaacctgggcaggctccaggctcctcatctatggaacatccaccagggccacgtggtacnccccacccaggttcagtggcaggtggggtccccggacagagttcactctcaccntcagccggcctgccagtctgagtatttgctagtttattactgtcagcagttaataaataacgtcggtccttctcgtacgtttccggggacgggggtaaccgaggggtaggagactaacgaaaacgtaacgtggtcgcgtagcctacctacgtctacgtcttctactcccttcccnctactctag

SEQ ID NO: 413060 - DNA, 581 bp, Homo sapiens
  misc_feature: GZ8MTXP02JRRB7.44.65.F10.1.454.CMB.2.raw
  modified_base (197)..(197): a, c, t, g, unknown or other
  modified_base (278)..(278): a, c, t, g, unknown or other
  modified_base (290)..(290): a, c, t, g, unknown or other
  modified_base (364)..(364): a, c, t, g, unknown or other
  modified_base (572)..(572): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccacctctcctgcagggccagtcagagtgtaccagcaacttgcctggaccacagaacctgggcaggctcccaggctcctnatctatggaacntccaccgagggccaacgtggtactccccacccgtaggttccaggttcggcagggttcggggtacccccgggganaggtacgttccacttctacacccgtatcgacggccgggccttggcctagtcgtggtacggtatttgcttagtttattactgtctagactagttaataattaacgtcggtaccttctacgtacgtttcggggacgggggtacctaagggtggagtatacgaaaacgtacgtggtgacgtcgcactactcgtcgtcttctactcctcccnctactctag

SEQ ID NO: 413061 - DNA, 509 bp, Homo sapiens
  misc_feature: GZ8MTXP02F1DF7.44.65.F10.1.454.CMB.2.raw
  modified_base (196)..(196): a, c, t, g, unknown or other
  modified_base (276)..(276): a, c, t, g, unknown or other
  modified_base (285)..(285): a, c, t, g, unknown or other
  modified_base (353)..(353): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttaccagcaacttagcctggtaccacagaacctggcaggctccagctcnatcatgacntccacaggccatggtactcccaccaggttcagtggcaggtggggtccccggacagacgttcactctcnccatcagccgcctgcagtctgagtatttgctagtttatactgtcagcagtataatactgcctctctacgtttcgggcgggggtacagggtggagatacgaaacgtacgtggtagctgaccacgtactctgtcttcacttccttcccgctactctag

SEQ ID NO: 413062 - DNA, 554 bp, Homo sapiens
  misc_feature: GZ8MTXP02FV3EG.44.65.F10.1.454.CMB.2.raw
  modified_base (195)..(195): a, c, t, g, unknown or other
  modified_base (293)..(293): a, c, t, g, unknown or other
  modified_base (405)..(405): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccacctgtctgtgtctccgaggggaangccaccctctcctgcagggccagtcagagtgttagcagcaacttagcctgtaccagcaagaatctggccaggctcccaggcctcctcatctagtggtncatccaccgaggggcccaagtggtactccccagccaggttcaggtcggctaggtcggggtctggggacaggtcgttcacgtctcaccatcagcagcctgcagtctagagttntttgctagtttatacgtgtcagtcagtataatcgacgtcggtcccttaccgtcggaccgaagggtaccaacggtacgtagggaacgttaaagttaaacgtaacgttggtacgtcgtaagacctacctagttccgtcgtccttactaccg

SEQ ID NO: 413063 - DNA, 543 bp, Homo sapiens
  misc_feature: GZ8MTXP02II6HY.44.65.F10.1.454.CMB.2.raw
  modified_base (198)..(198): a, c, t, g, unknown or other
  modified_base (287)..(287): a, c, t, g, unknown or other
  modified_base (292)..(292): a, c, t, g, unknown or other
  modified_base (387)..(387): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaagngccaccctctcctgcagggccagtcagagtgttaccagcaacttagcctggtaccaccagaacctggcaggctccaggctctcatctangaacntccacaggccactggtactccccaccctaggttcaggtggcaggtcggggtccccggacagacgttcactcctcaccatcagccgcctgcagtcngagtatttgctagtttatacgtgtcagcagtataataactggtcctctcgtacgtttccggggacgggggtaacctagggtcggagtacgtacgaaaacgtaacgtggtggcgtacgacaccgacttctcgtcttcacttcctaccgctactctag

SEQ ID NO: 413064 - DNA, 535 bp, Homo sapiens
  misc_feature: GZ8MTXP02GAOEC.44.65.F10.1.454.CMB.2.raw
  modified_base (196)..(196): a, c, t, g, unknown or other
  modified_base (350)..(350): a, c, t, g, unknown or other
tcagacagtatatacacgaccggtgctcgatttagctacgctctaagggggaggaactgttcagttaggacccagacggaaccatggaagccccagcgcagcttcttttcctcctgctactctggctcccagataccactggagaaatagtgatgacgcagtctccagccaccctgtctgtgtctccaggggaaangccaccctctcctgcagggccagtcagagtgttaccagcaacttagcctggtaccaccagaaacctgggcaggctcccaggctcctcatctatggaacatccaccagggcccatggtactcccaccaggttcagtggcaggtcgggtccggganacgagttcactctacaccatcagcgcctgcagtctgagtatttgctagtttattactgtcagtcagtataataactcggcctctctacgtttcggggacgggggaccagggtggagagtacgaaacgactggtacggctgcaccagtctacgtcttcaagttccttccgacctatctagattaac

SEQ ID NO: 413065 - DNA, 557 bp, Homo sapiens
  misc_feature: GZ8MTXP02GK20J.44.65.F10.1.454.CMB.2.raw
  modified_base (196)..(196): a, c, t, g, unknown or other
  modified_base (288)..(288): a, c, t, g, unknown or other
  modified_base (298)..(298): a, c, t, g, unknown or other
  modified_base (320)..(320): a, c, t, g, unknown or other
  modified_base (352)..(352): a, c, t, g, unknown or other
  modified_base (354)..(354): a, c, t, g, unknown or other
  modified_base (391)..(391): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaanagccaccctctcctgcagggccagtcagagtgttagcagcaacttagcctcgtaccagcaagaaatctggccaggcctcccgaggcctcctnatctatggtncatccaccagggccatggtacncccagccaggttcagtcgcagtggctgggacngngttcactctcaccatcagcagcctgcagtctagagtntttgctagtttatactgtacagcagtataagtgaactcggtcccttcccgttacgggacccgtaaaaggggaccaacggtaccgtagggaaagtaaacgttaaaaccggaacgttggtacggactaacggaccaacccgtattccgttacgtttacctttactacg

SEQ ID NO: 413066 - DNA, 555 bp, Homo sapiens
  misc_feature: GZ8MTXP02JENVA.44.65.F10.1.454.CMB.2.raw
  modified_base (196)..(196): a, c, t, g, unknown or other
  modified_base (262)..(262): a, c, t, g, unknown or other
  modified_base (295)..(295): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccaccctctcctgcagggccagtcagagtgttagcagcaacttagcctcgtaccagcagaaatcnggccaggctcccaggcctcctcatctatggtcncactcccaccgacggccacgtcggtacctcccgagccgtaggttcaggtcggcgtaggtcgggtcgtgggacagtcgttcactctaccactatcagctcgctcgcagtcgtagtagtagttgtacgtagttattacttagtacgtacgtagtagtataagtacgtacgtcgtccgtccgtccgtacgacgacgacgtacgtacggtacgtaacgtaaacgtacgtacgtacgtacgtcgacactactcgtcgtcttactc

SEQ ID NO: 413067 - DNA, 575 bp, Homo sapiens
  misc_feature: GZ8MTXP02FJ0VJ.44.65.F10.1.454.CMB.2.raw
  modified_base (263)..(263): a, c, t, g, unknown or other
  modified_base (297)..(297): a, c, t, g, unknown or other
  modified_base (410)..(410): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagccctcgtaccagcagaatcnggccaggcctcccgaggcctcctcatctatggtncatcccaccgagggcccagtggtactcccgagccctaggttcaggtcggctaggtgggtctggggacaggtgttcactctccaccatcagcagccctgctagtctagaagttnttttgcttagtttattacgtgtcagtactaagtaattaagtcgtactcggtcccttcccgttcggaccgaagggaccacggtacgtaggaaacgtaaacgtttaaaaccgacgttacggtcggactaaggacctaacccgtattccttacgttctttacctaccg

SEQ ID NO: 413068 - DNA, 516 bp, Homo sapiens
  misc_feature: GZ8MTXP02HGJTF.44.65.F10.1.454.CMB.2.raw
  modified_base (196)..(196): a, c, t, g, unknown or other
  modified_base (295)..(295): a, c, t, g, unknown or other
  modified_base (351)..(351): a, c, t, g, unknown or other
  modified_base (365)..(365): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttaccagcaacttagcctggtaccacagaaacctgggcaggctcccaggctcctcatctatggaacntccaccagggccactggtactccccacccaggttcagtggcaggtgggccccgganagagttcactctcnccatcagcgcctgcagtctgaggtatttgctagtttattactgtcagcagtataataactggcctctcgtacgttcgggcgggggtaccaagggtggagagtacgaaacgactgtggactgcacactctgtctcactccttccgcatctag

SEQ ID NO: 413069 - DNA, 522 bp, Homo sapiens
  misc_feature: GZ8MTXP02JR0X7.44.65.F10.1.454.CMB.2.raw
  modified_base (197)..(197): a, c, t, g, unknown or other
  modified_base (261)..(261): a, c, t, g, unknown or other
  modified_base (288)..(288): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaanagccacctctcctgcagggccagtcagagtgttagcagcaacttagcctcgtacagcagaatcngcaggctccaggctctcatctatggtncatccacgagggccagtggtactcccgagccaggttcagtcgcaggtggtctgggacagtgttcactctcacatcagcagcctgcagtctagtagtatttgctagtttactactgtacagtcaagttactaatcgactcggtcccttcgttacggacacgggacacggtacgtagggaacgtaacgttaaaacggactacggtagcctaagactaccattctcgttctactacc

SEQ ID NO: 413070 - DNA, 601 bp, Homo sapiens
  misc_feature: GZ8MTXP02GL24K.44.65.F10.1.454.CMB.2.raw
  modified_base (196)..(196): a, c, t, g, unknown or other
  modified_base (313)..(313): a, c, t, g, unknown or other
  modified_base (321)..(321): a, c, t, g, unknown or other
  modified_base (393)..(393): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttaccagcaacttgcctggtaccacagaaacctgggcaggctcccaggctcctcatctatggaacatccaccaggccactggtacnccccaccnggttcagtggcaggtcggggtccccgggacagagttcactcctcaccatcagccgcctgcagtctggaggtntttgctagtttatactgtcagctagtaataataacgtcggtcctctcgtacgtttcggggacgggggtaaccaagggtcggagtagtaccgaaaacgtaacgtggtacggtcgtacggaccgtaacctacgttaccgtttcggttaacccgtttaccgtaactttacccccggtttcccccgtaccccgttaacttcccggtttaacg

SEQ ID NO: 413071 - DNA, 566 bp, Homo sapiens
  misc_feature: GZ8MTXP02GOODB.44.65.F10.1.454.CMB.2.raw
  modified_base (196)..(196): a, c, t, g, unknown or other
  modified_base (263)..(263): a, c, t, g, unknown or other
  modified_base (399)..(399): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaanagccaccctctcctgcagggccagtcagagtgttagcagcaacttagcctcgtaccagcagaaatcnggccaggcctcccaggcctcctcatctatggtgcatcccaccgagggccacgtggtactcccgagccaggttcagtcggcaggtggtctggggacagtgttcactctcaccatcagcagcctgcagtctagaagtntttgctagtttattactgtcagctagtataatgacgtcggtcccttcccgttcggacccgaaaggggaccaacggtacgtagggaaacgtaaacgttaaaaccggaacgttaggtacggtccgtaacggacctaaccgtacttccgtttcgttacctttactaaccg

SEQ ID NO: 413072 - DNA, 546 bp, Homo sapiens
  misc_feature: GZ8MTXP02J3H08.44.65.F10.1.454.CMB.2.raw
  modified_base (197)..(197): a, c, t, g, unknown or other
  modified_base (225)..(225): a, c, t, g, unknown or other
  modified_base (274)..(275): a, c, t, g, unknown or other
  modified_base (280)..(280): a, c, t, g, unknown or other
  modified_base (284)..(284): a, c, t, g, unknown or other
  modified_base (307)..(307): a, c, t, g, unknown or other
  modified_base (349)..(349): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagngtgtaccagcaacttgcctggaccacagaacctggcaggctccagctcnntctangacntccacaggcatgactccccaccnggttcagtggcaggtcgggtcccggacagacgttcactctcnccatcgagccggcctgctagtcgtaggagttattttgacttagtttacttactggtcagtactagtattaatacgtggtccttctaccgtacgtttccggggacgggggtaccaaggggtggaagtagaacgaaacgtacgtggtcggacgtcgacacgtactccttgtccttctactccttacccgctacttctag

SEQ ID NO: 413073 - DNA, 529 bp, Homo sapiens
  misc_feature: GZ8MTXP02JHQHD.44.65.F10.1.454.CMB.2.raw
  modified_base (196)..(196): a, c, t, g, unknown or other
  modified_base (348)..(348): a, c, t, g, unknown or other
  modified_base (364)..(364): a, c, t, g, unknown or other
  modified_base (520)..(520): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccacctctcctgcagggccagtcagagtgtaccagcaacttgcctggtaccacagaaacctgggcaggctcccaggctcctcatctatggaacatccacgacggccactggtactcccacccaggttcagtggcaggtgggtccccggganaggacgttcactctcnccatcagccggctgcagtctgaggtatttgctagtttattactgtcagcagtatataactcgtacctctcgacgtttcgggccgggggtacaagggtggagacgtacgaaacggtaacgtggtggctcgactacactctcgtctactctcttcccnctactctag

SEQ ID NO: 413074 - DNA, 622 bp, Homo sapiens
  misc_feature: GZ8MTXP02HLWW0.44.65.F10.1.454.CMB.2.raw
  modified_base (197)..(197): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccagtcagagtgttaccagctaacttagcctggaccacaagaacctgggcaggctccgaggctcctcatctatggaacactccacgaggcccagtcggtactccccaccctaggttcaggtcggcagggtcgggtccccgggacagtcgttcactcctcgacctatcacggtccgcctggctagtcgtaggtaggttagttttcgactttaagttttattacgttgtactagtacaagtttaaataaacttaacgtcggtcccttacgttaccggtacggtttccgggggaccgggggtaccgaaaggggttggaacgtagtaaccgaaaacggtaacgttggtacggcgtacgaccaaccgtacttcgtacttctcgtacttccctaccctctactttcgtaac

SEQ ID NO: 413075 - DNA, 547 bp, Homo sapiens
  misc_feature: GZ8MTXP02FYTFU.44.65.F10.1.454.CMB.2.raw
  modified_base (197)..(197): a, c, t, g, unknown or other
  modified_base (259)..(259): a, c, t, g, unknown or other
  modified_base (281)..(281): a, c, t, g, unknown or other
  modified_base (291)..(291): a, c, t, g, unknown or other
  modified_base (367)..(367): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangccaccctctcctgcagggccagtcagagtgtagcagcaacttgcctgtaccagcagaatcnggccaggcctccaggcctcctnatctatggtncatcccaccgagggccagtggtactcccacgccaggttcaggtcgcagtgggtctgggacagtgttcactctcacntcagcagcctgcagtctagaatattttgacttagtttattacgtgtacagtactaagtataagtcgacgttcggcccttccgtcggaccgaagggaccacggacgtaggaactaaacgttaaacggaacgttggtacggtacttaacgactaaccgtattccgtacgttccttactaccg

SEQ ID NO: 413076 - DNA, 556 bp, Homo sapiens
  misc_feature: GZ8MTXP02IWH18.44.65.F10.1.454.CMB.2.raw
  modified_base (261)..(261): a, c, t, g, unknown or other
  modified_base (282)..(282): a, c, t, g, unknown or other
  modified_base (292)..(292): a, c, t, g, unknown or other
  modified_base (363)..(363): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttgcctcgtaccagcagaatcnggccaggctcccaggcctccnatctatggtncatcccaccgagggcccacgtgggtactcccgagccctagggttcaggtcggcaggtggtctggggacagngttcactctcaccatcagcagccctgcagtctagaagtatttgcttagtttattactgtcagtctaagttataaagtgacgtcggcccttacccgttcggaccgaagggacctacggacgttagggaataaacgttaaaacgacgttaggtcggcttaacggacctaaccgtactccgtcggttccttactac

SEQ ID NO: 413077 - DNA, 521 bp, Homo sapiens
  misc_feature: GZ8MTXP02JFQ2D.44.65.F10.1.454.CMB.2.raw
  modified_base (196)..(196): a, c, t, g, unknown or other
  modified_base (281)..(281): a, c, t, g, unknown or other
  modified_base (349)..(349): a, c, t, g, unknown or other
  modified_base (363)..(363): a, c, t, g, unknown or other
  modified_base (383)..(383): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgttaccagcaacttagcctggtaccacagaaacctggcaggctcccaggctcctnatctatggaacatccaccagggccactggtactccccacccaggttcagtgcaggtgggtccccgganagagttcactctcnccatcagccgcctgcagtcngaggtatttgctagtttatactgtcagcagtataataactgtcctctctacgtttcggcgggggtaccagggtggagatacgaaacgaactgtaggctgacaccgatctagtcgttcacttcctcccgactactctag

SEQ ID NO: 413078 - DNA, 590 bp, Homo sapiens
  misc_feature: GZ8MTXP02FSPA4.44.65.F10.1.454.CMB.2.raw
  modified_base (197)..(197): a, c, t, g, unknown or other
  modified_base (294)..(294): a, c, t, g, unknown or other
  modified_base (407)..(407): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaanagccaccctctcctgcagggccagtcagagtgtagcagcaacttgcctcgtaccagcaagaaatctggccaggctcccaggcctcctcatctatggncactcccaccgagggccacgtggtactcccagccaggttcaggtcgctaggtgggtctaggggacaggtacgttcacgttcctacaccatcagcagcctgcagtctagaattntttgacttagtttactttactgtactaggctaagttaataatcgactcggtcccttacccgtacgaaaccgaaagggacccaacggtacgttagggaaacgtaaaacgtttaaaaccggaacgttaggtaccggtactaacggacctaaacccgttattccgttacggttcctttacgtaacc

SEQ ID NO: 413079 - DNA, 605 bp, Homo sapiens
  misc_feature: GZ8MTXP02FNL09.44.65.F10.1.454.CMB.2.raw
  modified_base (198)..(198): a, c, t, g, unknown or other
  modified_base (282)..(282): a, c, t, g, unknown or other
  modified_base (288)..(288): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaancgcccaccctctcctgcagggccagtcagagtgtaccagcaacttgcctggtaccacagaacctgggcaggctccaggctcctnatctangaacactccaccgagggccctacgtggtacctcccccacccgtaggttccaggtcggacgtagggttcggggtaccccgggactaggtacgtttccacgttcctacacccatccgaggccgcctgctagtcgtggtaggttatttggacttaagttttactacgtgtacaggtactaagttaaataactaacgtcggtccttacgtacgtacggttccgggggacgggggaactaagggtcggaagtactaacgaaacgtagtgacggactacgactacgtactctacgtcttacacttccgtaccactatcttaag

SEQ ID NO: 413080 - DNA, 558 bp, Homo sapiens
  misc_feature: GZ8MTXP02F26G3.44.65.F10.1.454.CMB.2.raw
  modified_base (197)..(197): a, c, t, g, unknown or other
  modified_base (263)..(263): a, c, t, g, unknown or other
  modified_base (288)..(288): a, c, t, g, unknown or other
  modified_base (296)..(296): a, c, t, g, unknown or other
  modified_base (305)..(305): a, c, t, g, unknown or other
  modified_base (530)..(530): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaanagccaccctctcctgcagggccagtcagagtgttagcagcaacttagcctcgtaccagcagaatcnggccaggcctcccgaggcctcctcntcatggtncatccaccngggccacgtggtactcccagccaggttcagtcggcgtaggtcggggtctggggaactaggtcgttccaacgttcctaccacctatccgagcacgcctgcagtctagagttattttgacttagtttacttacgtgtacagtactaagttaactaatcgactcggtcctccgtcgaccgaaggcacgtacgtaggaacgtaaacgttaaacgacgtaggtcggtacncgaccactacgtccgtcgttctacttac

SEQ ID NO: 413081 - DNA, 556 bp, Homo sapiens
  misc_feature: GZ8MTXP02G6PQU.44.65.F10.1.454.CMB.2.raw
  modified_base (196)..(196): a, c, t, g, unknown or other
  modified_base (466)..(466): a, c, t, g, unknown or other
  modified_base (536)..(536): a, c, t, g, unknown or other
  modified_base (556)..(556): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgtaccagcaacttagcctggtaccacagaacctgggcaggctccaggctcctcatctatcggaacactccaccgaggggcccacgtcggtactccccaacccgtaggttcacgttgggctagggtcggggtacccgggacagtacgttccactctccaccgtactcgacggtccgacctgcctagtcgtggaggtatttggacttagtttattactgtcagcagttataatactgtcctntctacgttcggcggggacaggtcggagtagtacaaacgtacgtggtgactgacacctagtctgtcttacnctccgttccactactacgtn

SEQ ID NO: 413082 - DNA, 511 bp, Homo sapiens
  misc_feature: GZ8MTXP02IDQVM.44.65.F10.1.454.CMB.2.raw
  modified_base (260)..(260): a, c, t, g, unknown or other
  modified_base (291)..(291): a, c, t, g, unknown or other
  modified_base (363)..(363): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaagagccacctctcctgcagggccagtcagagtgttagcagcaacttagcctcgtaccagcagaatcnggccaggctcccaggctcctcatctatggtncatcccaccaggggcccacgtggtactccccgagccctaggttccagtcggctaggtgggtctggggacagngttcactctcaccatcagcagcctgcagtctagagtattttgactagtttattactgtacagctagtataatgactcggcctccgttcggacgaagggcacgacgtggacgtaataaacgacgtagtgctgcacgatctcgtctctac

SEQ ID NO: 413083 - DNA, 686 bp, Homo sapiens
  misc_feature: GZ8MTXP02I6G2I.44.65.F10.1.454.CMB.2.raw
  modified_base (263)..(263): a, c, t, g, unknown or other
  modified_base (295)..(295): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagtgccagtcagagtgtagcagcaacttagcctcgtaccagcaagaaatcnggccaggctcccaggcctcctcatctatggtncactcccaccgagggcccaacgtggtactccccgagcccgtaaggtttccaaggtcgggacctagggtggggtctaggggaacagggtacgtttccaaccttccgtaccaaaccctattacccgaaagccaaacggtccccttaggaccctaaggtttcctaaggtaaaagtttcgtttttaggacctttaaaggtttttaattaaaccgttgttaaccgaggtactaaagggtttaaataaacgttacggtaaccgttcggggtccccttaccccggttacggggaccccgtaaaaggggaccaacggtaacgtaggggtaaacgtaaacgttaaaaccggaacgttggtacggaacttacggaccaccgtacttcttacgtctttaccg

SEQ ID NO: 413084 - DNA, 606 bp, Homo sapiens
  misc_feature: GZ8MTXP02G4A3E.44.65.F10.1.454.CMB.2.raw
  modified_base (197)..(197): a, c, t, g, unknown or other
  modified_base (264)..(264): a, c, t, g, unknown or other
  modified_base (299)..(299): a, c, t, g, unknown or other
  modified_base (433)..(433): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangccaccctctcctgcagggccagtcagagtgttagcagctaacttgcctcgtaccagacaagaatcnggccaggcctcccgaggcctcctcatctagtggtncactcccacgacgggccacgtggtactcccgagccgtaggttcaggtcgcgtaggtcgggtcgtggggacaggtcgttccacgttcctaccacctatcgaagtccgagtccctgacctaggttctagtaagttnttttaggactttagtttattacgttgttacagtactagttaattaagtcgtacgttcgggacccttcccggtacggaccgtaaaggggaccctacggtacgtaggaaacgtaaacttaaaacggacgtcggtacgggactcgaccaccttattcgttcttacctacttacccg

SEQ ID NO: 413085 - DNA, 594 bp, Homo sapiens
  misc_feature: GZ8MTXP02G2EE7.44.65.F10.1.454.CMB.2.raw
  modified_base (296)..(296): a, c, t, g, unknown or other
  modified_base (360)..(360): a, c, t, g, unknown or other
  modified_base (393)..(393): a, c, t, g, unknown or other
tcagacagtatatacacgaccggtgctcgatttagctacgctctaagggggaggaactgctcagttaggacccagacggaaccatggaagccccagcgcagcttctcctcctcctgctactctggctcccagataccactggagaaatagtgatgacgcggtctccagccaccctgtctgtgtctccgaggggaagagcccaccctctcctgcagggccagtcagagtgttagcagcaacttagcctcgtaccagcagaatctggccaggcctcccaggcctcctcatctatggtncatccacagtcgccactggtactcccgagcctaggttcaggtggctaggtcgggtctggggacnggtagttcacgtctacaccatcagcagcctgcngtctagtagttatttgacttagtttattacgtgtcgtagctaagttactaagtcgtacgttccgggtccccttaccccggttaccgggaccgaaacggggtaccctacgggtaacggttacgggtaaacgtaaacgtttaaaaccggaaccgttgggtacggtcgtacggaccctaccgtattccgttacgttctttaccg

SEQ ID NO: 413086 - DNA, 572 bp, Homo sapiens
  misc_feature: GZ8MTXP02F4IMC.44.65.F10.1.454.CMB.2.raw
  modified_base (198)..(198): a, c, t, g, unknown or other
  modified_base (299)..(299): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagngccaccctctcctgcagggccagtcagagtgttagcagcaacttagcctcgtaccagcaagaatctggccaggcctcccgaggcctcctcatctagtggtncatcccaccgagggccaacgtggtactcccgagcctaggttcaggtcggcaggtgggtctggggacaggtagttccactcctacaccagtcagcagcctgctagtctagatagttttgcttagtttatacttgtcagctagtatatcgtactcggtccttcccgtcggaccgaaacgggtaccaacggtacgtaggaacgtaaacgttaaaaccggaacgttagggtacggactaacggtaccacctacgttccgttcgttaccttctaaccc

SEQ ID NO: 413087 - DNA, 548 bp, Homo sapiens
  misc_feature: GZ8MTXP02F0H4F.44.65.F10.1.454.CMB.2.raw
  modified_base (196)..(196): a, c, t, g, unknown or other
  modified_base (284)..(284): a, c, t, g, unknown or other
  modified_base (294)..(294): a, c, t, g, unknown or other
  modified_base (354)..(354): a, c, t, g, unknown or other
  modified_base (368)..(368): a, c, t, g, unknown or other
  modified_base (395)..(395): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaangccaccctctcctgcagggccagtcagagtgtagcagcaacttagcctcgtaccagcaagaaatctggccaggctcccaggcctcctnatctatggtncatcccaccagggccactggtactcccagccaggttcagtcgcagtgggtctgggacagngttcactctcaccntcagcagcctgcagtctagaaagtttntttgcttagtttactactgtacagtactaagttaataaataacgtcgtacctcgtacgtacggttcgggggacgggggaacgtaagggtaggaagtacgtaaacgaaacgtacgtcggtaggctcgaccactacttcgtacgtccttactacg

SEQ ID NO: 413088 - DNA, 714 bp, Homo sapiens
  misc_feature: GZ8MTXP02FSJTC.44.65.F10.1.454.CMB.2.raw
  modified_base (198)..(198): a, c, t, g, unknown or other
  modified_base (262)..(262): a, c, t, g, unknown or other
  modified_base (290)..(290): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagngcccaccctctcctgcagggccagtcagagtgtagcagcaacttgcctcgtaccagcagaatcnggcagctccaggctcctcatctatggtncatccaccgagggcccacgtggtactcccgagtccaggttcaggtcggcctagggtggggtctggggaactagggtcggttccacgttcctacccaaccctatccgaagaccgacgcccttagaccgtagttccgttaggtaaacgtttagttttttacgacctttaaggtttttaactttaaaccgtttcggttaccgtaaggtaccttaaagggtttaaaattaaacgttcggtaaccgtttccggggtaccccctttcccccggtttaccgggaacccggtaaaacgggggaaccctaaaccggtaccggttaggggaaacgttaaaacggtttaaaaccgtaaacgttacgggtcggggtacctaacggtacccgtaaaccctacgttacccgtttaggttacccctttacgttaccccg

SEQ ID NO: 413089 - DNA, 576 bp, Homo sapiens
  misc_feature: GZ8MTXP02ITD5X.44.65.F10.1.454.CMB.2.raw
  modified_base (196)..(196): a, c, t, g, unknown or other
  modified_base (298)..(298): a, c, t, g, unknown or other
  modified_base (441)..(441): a, c, t, g, unknown or other
  modified_base (462)..(462): a, c, t, g, unknown or other
  modified_base (480)..(480): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctcgaggggaaancgccacctctcctgcagggccagtcagagtgttagcagcaacttgcctcgtaccagcaagaatcgtggccaggcctcccgaggcctcctctatctagtggtncactcccgaccgacgggcctacgtggtacctcccgagccgtaaggttcaggttcggacgtagggtcgggtacgtagggaactaggtacgtttccacttccaccaaccgtatcgacgcacgccctagactagtctagtaagttntttgacttagtttattacgtntacgagtctaagtataancgtactcggtcccttcgtacggacgaaagcaacggatgggaaactaaacgttaaacgacgttgacggcaacgtacactacgtctcgttactctacc

SEQ ID NO: 413090 - DNA, 533 bp, Homo sapiens
  misc_feature: GZ8MTXP02GTQA5.44.65.F10.1.454.CMB.2.raw
  modified_base (197)..(197): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangccaccctctcctgcagggccagtcagagtgtagcagcaacttgcctcgtaccagcaagaatctggccaggcctcccgaggcctcctcatctatggtgcactccaccgagggcccagtggtactcccagccaggttcaggtcggcaggtgggtctgggacagtcgttcacttcctcaccatcgagcagccctgcagtctagtaagtatttgacttagtttattactgtcagtctagtataatgactcggcccttccgttcggaccgaagggacacggacgtaggaactaacgtaaacgactggcgactcgacctacgtacttcgtcgtcttactcc

SEQ ID NO: 413091 - DNA, 532 bp, Homo sapiens
  misc_feature: GZ8MTXP02GRMWF.44.65.F10.1.454.CMB.2.raw
  modified_base (198)..(198): a, c, t, g, unknown or other
  modified_base (265)..(265): a, c, t, g, unknown or other
  modified_base (274)..(274): a, c, t, g, unknown or other
  modified_base (280)..(280): a, c, t, g, unknown or other
  modified_base (320)..(320): a, c, t, g, unknown or other
  modified_base (344)..(344): a, c, t, g, unknown or other
  modified_base (348)..(348): a, c, t, g, unknown or other
  modified_base (364)..(364): a, c, t, g, unknown or other
  modified_base (500)..(500): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaaangccaccctctcctgcagggccagtcagagtgtacagcaattgcctggaccacagaacctggcaggcnccagctctnatctangaacatccaccaggccatggtactcccaccagttcagtgnaggtggcccggacagattcactcncacntcagccgctgcagtcngagtatttgctagtttatactgtcagacagtaaataaataactggaccttctactaacgtttccgggacgggggaaccaaaggggtgaagaactacgaaaaccgtaacgtggtaggactcggacaccgtactcgtntaacttcacttccttccccgactacttactag

SEQ ID NO: 413092 - DNA, 514 bp, Homo sapiens
  misc_feature: GZ8MTXP02G7FPY.44.65.F10.1.454.CMB.2.raw
  modified_base (197)..(197): a, c, t, g, unknown or other
  modified_base (423)..(423): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaanagccaccctctcctgcagggccagtcagagtgttagcagcaacttgcctcgtaccagcagaaatctggccaggcctcccgaggcctcctcatctatggtgcatcccaccgagggccacgtggtactcccgagccaggttcaggtcggcaggtcggtctgggacagtgttcactctcaccatcagtcagcctgctagtctagaagtatttgactagttactactgtnagctagtatatcgactgcctccgtggaccaagggccacgacgaggactaaacgttaaacgactggtagctcgacactatctgtctactacc

SEQ ID NO: 413093 - DNA, 572 bp, Homo sapiens
  misc_feature: GZ8MTXP02F6P3J.44.65.F10.1.454.CMB.2.raw
  modified_base (198)..(198): a, c, t, g, unknown or other
  modified_base (302)..(302): a, c, t, g, unknown or other
  modified_base (372)..(372): a, c, t, g, unknown or other
  modified_base (453)..(453): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaaggggaaanagcccaccctctcctgcagggccagtcagagtgttagcagcaacttagcctcgtaccagcaagaaatcgtggccaggcctcccgaggcctcctcatctatggtncactcccaccgagggccactggtactccccgagccctaggttcaggtcggctaggtgggtctgggacagngttcacttctcaccatcagcagccctgactagtctagaagttattttgcttagtttattacgtgtacagtctaagtataancgtactcggtcccttcccgtcggaccgaaaggggaccaacggtacgtaggaaacgtaaacgttaaacgaacgtggtacggtactaacggaccacgttactctcgttaccttactaaccg

SEQ ID NO: 413094 - DNA, 563 bp, Homo sapiens
  misc_feature: GZ8MTXP02FTI7Z.44.65.F10.1.454.CMB.2.raw
  modified_base (354)..(354): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagcccaccctctcctgcagggccagtcagagtgtagcagcaacttgcctcgtaccagcagaatctggccaggctcccaggctcctcatctatggtgcatccaccagggccactggtactcccagccaggttcaggtggcagtgggtctggggacaggngttcaactctcaccatcagcagcctgcagtctagaatattttgctagtttattactgtacagcagtataatgactcggcccttcccgttcggaccgtaaaggggaccaacggacgttagggaaacgtaaactttaaaaccggaacgttaggtacgggtacgtaacggaccctaaaccgtacttaccgttggttaccctttactaacccg

SEQ ID NO: 413095 - DNA, 577 bp, Homo sapiens
  misc_feature: GZ8MTXP02FVY8U.44.65.F10.1.454.CMB.2.raw
  modified_base (197)..(197): a, c, t, g, unknown or other
  modified_base (263)..(263): a, c, t, g, unknown or other
  modified_base (299)..(299): a, c, t, g, unknown or other
  modified_base (420)..(420): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangcccaccctctcctgcagggccagtcagagtgttagcagcaacttgcctcgtaccagcaagaatcnggccaggcctccccgaggcctcctcatctagtggtncactccaccgagggccacgtgggtactcccgagccgtaggttcaggtcggctaggtcgggtcgtgggaacaggtcgttcacgttcaccaccatcagcacgcctgctagtctagtaacgttnttttcgacttagtttattacgtgtacagtctaagttaatatcgtacttcggtcccttcccgtcggaccgtaaacgggcaacggtacgtaggaacgtaaacgttaaacgacgttggacgtcgtaacgtaccacgtacttcgtacgtccttactacccg

SEQ ID NO: 413096 - DNA, 572 bp, Homo sapiens
  misc_feature: GZ8MTXP02FM3JQ.44.65.F10.1.454.CMB.2.raw
  modified_base (197)..(197): a, c, t, g, unknown or other
  modified_base (264)..(264): a, c, t, g, unknown or other
  modified_base (286)..(286): a, c, t, g, unknown or other
  modified_base (295)..(295): a, c, t, g, unknown or other
  modified_base (414)..(414): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangccaccctctcctgcagggccagtcagagtgttagcagcaacttagcctcgtaccagcaagaatcgnggccaggcctccgagcctcctnatctagtgncactccacgaggccacgtcggtacctcccgagccgaggttcaggtcggcgtaggtcgggtcgtggggactaggtcgttacacttcaccaccatcagcagcctgctagtctagtaagttnttttgacttagtttactacgtgtacagacgtaatataagtcgtacgttccggtaccccttccgtaccggaaccgtaagggacctaacggtacgtagggaaactaaacgttaaacgacgtagtcggactaacgaccaacctgtcctctccttacgtacc

SEQ ID NO: 413097 - DNA, 547 bp, Homo sapiens
  misc_feature: GZ8MTXP02HYAJ3.44.65.F10.1.454.CMB.2.raw
  modified_base (262)..(262): a, c, t, g, unknown or other
  modified_base (364)..(364): a, c, t, g, unknown or other
  modified_base (378)..(378): a, c, t, g, unknown or other
  modified_base (401)..(401): a, c, t, g, unknown or other
  modified_base (441)..(441): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccacctctcctgcagggccagtcagagtgttagcagcaacttagcctcgtaccagcagaaatcnggccaggctcccagctcctcatctatggtgcactccaccgacgggcccacgtggtactcccgagccgtaggttcaggtcggcaggtgggtctggggacaggngttcatcctcaccntcagcagcctgcagtctagagtntttgctagtttatacgtgtcagtcagttataatcgtacgnggtaccctccgtttccgggaccgaaacgggggaacaccggagtacgggaacgtaaacgttaaaacgacgttggtacggctggacaccgtactcttcgtcttactac

SEQ ID NO: 413098 - DNA, 606 bp, Homo sapiens
  misc_feature: GZ8MTXP02FSABU.44.65.F10.1.454.CMB.2.raw
  modified_base (197)..(197): a, c, t, g, unknown or other
  modified_base (389)..(389): a, c, t, g, unknown or other
  modified_base (435)..(435): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccatggagaaatagtgatgacgcagtctccagccaccctgtctgtgtctccgagggggaaancgcccaccctctcctgccagggccagtcagagtgttaccagcaacttagcctggtaccacagaacctggcacgctcccaggctcctcatctatcggaacactccgaccgaggcccacgtggtactccccaacccgtaggttccaggtcggcaggtcggggtaccccggacagtacgttccactcgtcaccgntccgaggccgcctgcgacgtccgtagtattttgctagtttattacngttcaagtcaaagtacttaaatacgtggtccttctactacgggtttaccgggcgggggaacctagggtggtacgaacgttacgaaaacgtaacgtggtcgactacgacctaacctgttcctgttccttaacgtaccttcccgttcccccgtaactcttaccgttagtaaac

SEQ ID NO: 413099 - DNA, 555 bp, Homo sapiens
  misc_feature: GZ8MTXP02FWS8I.44.65.F10.1.454.CMB.2.raw
  modified_base (197)..(197): a, c, t, g, unknown or other
  modified_base (296)..(296): a, c, t, g, unknown or other
  modified_base (377)..(377): a, c, t, g, unknown or other
  modified_base (384)..(384): a, c, t, g, unknown or other
  modified_base (397)..(397): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangcccaccctctcctgcagggccagtcagagtgttagcagcaacttgccctcgtaccagcagaatctggccaggctcccaggcctcctcatctatggtcncactcccacgagggccactggtactcccagccaggttcagtcggctagtgggtctgggacaggtcttcactctcacatcancagcctnctagtcagtattntttgcttagtttacttactgtcagtctagttaatagtcgtactcgggtccctttacccggtcggaccgtaaaggggccaacggtacgtacggaacgtaaacgttaaacgacgttaggcggtactaacgaccactacgttcgtcgtacctttactcccg

SEQ ID NO: 413100 - DNA, 625 bp, Homo sapiens
  misc_feature: GZ8MTXP02IL91Z.44.65.F10.1.454.CMB.2.raw
  modified_base (196)..(196): a, c, t, g, unknown or other
  modified_base (403)..(403): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaanagccaccctctcctgcagggccagtcagagtgttagcagcaacttagcctcgtaccagcagaaatctggccaggcctcccaggcctcctcatctatggtgccactcccaaccgcggggaccctacgttgggtacctccccgaggccctaggttccaggtcggcgtaggtgggtctggggacaggtacgttcactctaccaccatcancacgcctgctagtctagaagttctttgacttagttttatacgtgtcagtactaagttaataagtcgaccgttcggtacccttcccggttacgacccgaaaaggggacctaacggtacgttaggggaaacgttaaaacgtttaaaaccgacgttaggtaccgggttaccaacggtaccaaaacccttcggttccgtttacgtttacccgtttactaacccccg

SEQ ID NO: 413101 - DNA, 506 bp, Homo sapiens
  misc_feature: GZ8MTXP02IVM3H.44.65.F10.1.454.CMB.2.raw
  modified_base (195)..(195): a, c, t, g, unknown or other
  modified_base (361)..(361): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaangccaccctctcctgcagggccagtcagagtgtaccagcaacttgcctggtaccaccagaaacctgggcaggctccaggctcctcatctatggaacatccaccaggccactggtactccccacccaggttcagtgacaggtcgggtcccggacagagttcactctcncatcagcgcctgcagtctgaggtatttgctagtttatactgtcagcagtataatactgcctctctacgttcgggcgggggacaggtggagatacgaaacgactgtaggctgacacctatctgtcttcacttcctccgctatctag

SEQ ID NO: 413102 - DNA, 761 bp, Homo sapiens
  misc_feature: GZ8MTXP02JBM8R.44.65.F10.1.454.CMB.2.raw
  modified_base (195)..(195): a, c, t, g, unknown or other
  modified_base (226)..(226): a, c, t, g, unknown or other
  modified_base (242)..(242): a, c, t, g, unknown or other
  modified_base (389)..(389): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccacctgtctgtgtctcgaggggaaancgccacctctcctgcagggccagtcagagtntacagacaactagtcncgtacaccaagaactggcacgctccgagctcctacatactatacggaacactcgaacccgaggaccactcggtactaccccaacccgtaggttacgacgtggacgtacgggtcggggtacccccggggacagtagttccacttaccnctaccactcgacggccggtcctagccagttaccgtggtaaggtttaagtttgtaccgttaaagtttttaaactttcggttacgtaaccgaagtaccggtaaaacttttaaattaaaaaccgttttaaaccggccggggttccccctttaagtttaaaccccgggtaaccgggggtttttacggggggggaaacccggggggggaacccgtaaaagggttacgggggaaataaacgtaaaccgaaaaacccgggttaacggttggtacggggtcccttaaacggccttaaaccgtaaaccttttggtaaccggttttcccgttaactaacccggtttcccgttaccccacccggttaactaccgttttaaagg

SEQ ID NO: 413103 - DNA, 600 bp, Homo sapiens
  misc_feature: GZ8MTXP02G3K8Q.44.65.F10.1.454.CMB.2.raw
  modified_base (197)..(197): a, c, t, g, unknown or other
  modified_base (294)..(294): a, c, t, g, unknown or other
  modified_base (470)..(470): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangccaccctctcctgcagggccagtcagagttgtagcagctaacttgcctcgtaccagcaagaatctggccaggcctccgagctcctcatctatggtncactcccaccgagggccacgtggtacctccccgagccgtaggttccaggtccggacgtaggtcggggtcgtggggaacaggtagttccacgttcctaccaacctatcgacgcacgcctgccagttctaggtaagtttctttacggactttagtttaacttacgttgtacgtacgtntaaggttaactaagtcgtacgtccggtacccttcccgttacgggacgaacgggtaccaggtacgtagggaactaaacggttaaacgacgtggttcgctaacggacctactacgtctacgtttctacgtcc

SEQ ID NO: 413104 - DNA, 500 bp, Homo sapiens
  misc_feature: GZ8MTXP02JBJ99.44.65.F10.1.454.CMB.2.raw
  modified_base (195)..(195): a, c, t, g, unknown or other
  modified_base (251)..(251): a, c, t, g, unknown or other
  modified_base (282)..(282): a, c, t, g, unknown or other
  modified_base (352)..(352): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccacctgtctgtgtctccaggggaaanagccaccctctcctgcagggccagtcagagtgttagcagcaacttgcctcgtaccngcagaaatctggccaggctcccaggctcctnatctatgtgcatccacagggccactggtactcccagccaggttcagtcggcagtcgggtctggggacagngttcactctcaccatccagcagcctgcagtctagagtattttgctagtttattactgtacagcagtataatgactcggcctcctcggaccaaggacacgactaggacgtaattaaacgactgtgactgacacagtctacgtctactac

SEQ ID NO: 413105 - DNA, 546 bp, Homo sapiens
  misc_feature: GZ8MTXP02FSJYN.44.65.F10.1.454.CMB.2.raw
  modified_base (198)..(198): a, c, t, g, unknown or other
  modified_base (286)..(286): a, c, t, g, unknown or other
  modified_base (297)..(297): a, c, t, g, unknown or other
  modified_base (361)..(361): a, c, t, g, unknown or other
  modified_base (367)..(367): a, c, t, g, unknown or other
  modified_base (371)..(371): a, c, t, g, unknown or other
  modified_base (402)..(402): a, c, t, g, unknown or other
  modified_base (442)..(442): a, c, t, g, unknown or other
  modified_base (522)..(522): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaagngccaccctctcctgcagggccagtcagagtgttagcagcaacttagactcgtaccagcaagaatctggccaggctcccaggcctcctnatctagtggtncatcccaccgagggccagtgtactccccgagccaggttcaggtcggctaggtgggtctgggacngtgtcnctcncacatcagcagcctgactgtctaggaagttntttcgattacgtttatacgtgtacagtactagtaataagngtactcgggacccttccgtacggacgtaaacgggccaacggtagacggtaataaacgttaaacggacgttggtccggtancgacacgtatcgttcgtctctacg

SEQ ID NO: 413106 - DNA, 572 bp, Homo sapiens
  misc_feature: GZ8MTXP02GLTX0.44.65.F10.1.454.CMB.2.raw
  modified_base (144)..(144): a, c, t, g, unknown or other
  modified_base (196)..(196): a, c, t, g, unknown or other
  modified_base (283)..(283): a, c, t, g, unknown or other
  modified_base (295)..(295): a, c, t, g, unknown or other
  modified_base (364)..(364): a, c, t, g, unknown or other
  modified_base (379)..(379): a, c, t, g, unknown or other
  modified_base (384)..(384): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactgganaaatagtgatgacgcggtctccagccaccctgtctgtgtctccaggggaaanagcccaccctctcctgcagggccagtcagagtgttagcagcaacttgcctcgtaccagcaagaatctggccaggctcccaggctccncatctagtggtnctatcccacaggggccacgtggtactcccgagcctaggttccagtcggccaggtggtctggggacaggngttcactctacgacntcacncagcctgcagtcagattatttgacgttagtttatacgtgtacacgtatagtaatagtcgtaccgtccggtcccttcccgttacggaccgtaaacgggacctacggacgtagggaacgttaaacgttaaaccgaagtcggttacggacctggaccctaactacgtccttacggtacctttactaccccg

SEQ ID NO: 413107 - DNA, 575 bp, Homo sapiens
  misc_feature: GZ8MTXP02HH4XS.44.65.F10.1.454.CMB.2.raw
  modified_base (197)..(197): a, c, t, g, unknown or other
  modified_base (208)..(208): a, c, t, g, unknown or other
  modified_base (403)..(403): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangcccaccctcncctgcagggccagtcagagtgtagcagcaacttagcctcgaccagcaagaatcgtggccaggcctcccgaggcctcctacatctagtggtgcactcccaacgacgggccacgtggtactccccgaggcccgtaggttcgaggtccggcgtagggtggggtccgtggggacaggtacgttccaacgtcctacaccntacgagcacgccctagcctagtctagtaagttatttgacttagtttatacgtgtacagtctagtatagtcgacgtcgtccctccgtacggaccgaaaggctaacgacgtaggaaactaaacgttaaacggacgtgggtacgactcgactacgacttcgtcttcttactaccg

SEQ ID NO: 413108 - DNA, 647 bp, Homo sapiens
  misc_feature: GZ8MTXP02H7S1J.44.65.F10.1.454.CMB.2.raw
  modified_base (197)..(197): a, c, t, g, unknown or other
  modified_base (227)..(227): a, c, t, g, unknown or other
  modified_base (452)..(452): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaancgccaccctctcctgcgagggccagtcagngtgtagcagcaacttagcctacgtaccagcaagaactctggccaggcctcccgaggcctcctcatctagtcggtcgcactcccgaaccgcgggcccacgttcgggtaacctccccgaggtccccgtaaggttcgaggtcggcgtagggtcgggtcgtgggaacaggtcgtttcactccgtaccaccacgtcaacgccacgccgtgctaggtcgttagtaaagttnttttacgactttagtttacgtaacttggttaacagttagaagttaagtaattcgtaccgtcggttacccccttccggttaccgggaaccgtaacgggggaacctaacgggacgttagggaaaacttaacgttaaaaccggacgtttcgggacgtaccgcgtaccaacgtcttaccgttcttacctttcgtacccg

SEQ ID NO: 413109 - DNA, 672 bp, Homo sapiens
  misc_feature: GZ8MTXP02GXEL7.44.65.F10.1.454.CMB.2.raw
  modified_base (198)..(198): a, c, t, g, unknown or other
  modified_base (228)..(228): a, c, t, g, unknown or other
  modified_base (263)..(263): a, c, t, g, unknown or other
  modified_base (282)..(282): a, c, t, g, unknown or other
  modified_base (292)..(292): a, c, t, g, unknown or other
  modified_base (321)..(321): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggcctcccagataccactggagaaatagtgatgacgcggtctccagccaccctgtctgtgtctccgaggggaaancgcccaccctctcctgcagggccagtcagngtgttagcagcaacttgcctcgaccagcagaatcnggccaggcctccgagctcncatctgtgtncactacccacgacggcctacgtggtaccnccgacgtccgtacggttacacggtcggtaccgtagggttcgggtccgtaggggacttacggtacgtttaccaccttaccgtaccaacctacgaccgacgaccgtacgtccctagacgtacgttaaccgtaggtaagtttaacgttttcgtacgtttaaagtttaacttaacggttcgtacgtaacgttcgtaccggtttccgtttacccaccggtaccggccgtacccgtttacgttccggggtttaccgggggaccgggggtaaacctagggggtacgtaaggtacgtacgaacggtaaacgtacgtcggttaggtcgtcggaacctactacttcgtacgtttcttaccg

SEQ ID NO: 413110 - DNA, 615 bp, Homo sapiens
  misc_feature: GZ8MTXP02FS5F8.44.65.F10.1.454.CMB.2.raw
  modified_base (272)..(272): a, c, t, g, unknown or other
  modified_base (306)..(306): a, c, t, g, unknown or other
  modified_base (342)..(342): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagcccaccctgtctgtgtcctccgaaggggaaagagcccaccctctcctgcagggccagtcagagtgttagcagcaacttacgcctcgtaccagacaagaaatcgnggccaggcctcccgagcctcctcatctagtggtncactcccaccgacgggccacgtcgtacctcccgacnccgtaggttcgaggtggcgtaggtgggtcgagggacaggtcgtccaacgtcctaccacctataccacgccaacgtccctgacgagttcgtagaacggtttatttcgagttaaagtttattaccgttggacaggtactaagttaagtaatcgtacgtccgtccctttaccggacggaacgaacggtaccgacgtagaggggtaaactaaacggttaaacgtacgttaggggctaccggtaacgacctacgtacgtcttacgttacttacctacc

SEQ ID NO: 413111 - DNA, 676 bp, Homo sapiens
  misc_feature: GZ8MTXP02G0FLF.44.65.F10.1.454.CMB.2.raw
  modified_base (196)..(196): a, c, t, g, unknown or other
  modified_base (365)..(365): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccagtcagagtgtaccagcaacttagcctggtaccaccagaaacctgggcaggcctcccaggcctcctcatctatcggaacatcccaccgagggcccaacgtggtactccccaccctaggttcacggtgcgaggtcggggtccccggganagtacgttcacgtctacacctatcaacggccggcctagcgaacgtcttggaagggtttactttggccgttaagttttacttacgtcgtaccagactaaggttaaattaaactaaacgttcggaccttcttaccgtaccttttcggggacggttacgggggaacctaaaggggttcgggaaagtaacgtaaccgtaaaaacgtaccgttagggtccggtacgttacggacccgtaaccctaagtttccgttaacggtttaccctttaccgtaaacgtttacccccgtttcccccgtaccttaaatttcccgg

SEQ ID NO: 413112 - DNA, 588 bp, Homo sapiens
  misc_feature: GZ8MTXP02HG8WB.44.65.F10.1.454.CMB.2.raw
  modified_base (196)..(196): a, c, t, g, unknown or other
  modified_base (205)..(205): a, c, t, g, unknown or other
  modified_base (231)..(231): a, c, t, g, unknown or other
  modified_base (283)..(283): a, c, t, g, unknown or other
  modified_base (296)..(296): a, c, t, g, unknown or other
  modified_base (302)..(302): a, c, t, g, unknown or other
  modified_base (315)..(315): a, c, t, g, unknown or other
  modified_base (381)..(381): a, c, t, g, unknown or other
  modified_base (383)..(383): a, c, t, g, unknown or other
tcagacagtatatacacgaccggtgctcgatttagctacgctctaagggggaggaactgctcagttaggacccagacggaaccatggaagccccagcgcagcttctcttcctcctgctactctggctcccagataccatggagaaatagtgatgacgcggtctccagccaccctgtctgtgtctccgaggggaaangccaccctntcctgcagggccagtcagagtgttancagcaacttagcctcgtaccagcaagaaatctggcaggctcccaggctcctnatctatgtgctanccacgnggccaatggtacncccagcctaggttcgagtcgggacaggtcgggtgtaggggactagtcggttacactctacacctancncacgacgcgtcgcgtacgtacgtagtagttagtttagtagttagtttacgttacgtacgtacgtacgtacgtacgtccgttccgtccgccggtccgtccgtacgtaccggttaccggggtacggggtacggtacgggtacggacggtacgtacgtacgacgtacgtacggtacggtcgtcgacgtacgtacgtcgtcgttactcg

SEQ ID NO: 413113 - DNA, 512 bp, Homo sapiens
  misc_feature: GZ8MTXP01BFYZ0.11.6.A06.1.454.CMB.2.raw
tcagcgagagataccacgaccggtgctcgatttagatctactgacagggggagaggagccccagccttgggattcccaagtgttttcattcagtgatcaggactgaacacagagggctcaccatggagtttgggctgagctggattttccttgctgctatttaaaggtgtccagtgtgaggtgcatctggtggagtcgtggggagcttgggtaaagccggggggtccttagactctcctgtgcagcctctggcatcactttcagtgacgcctggatgagcgtgggtccgccaggctccgaggggaagggctgggagtgggttggccgtattaaaagcgaggctgcgtggtcgggacaacagactacgctgcacccgtgaagggcagatcacatctcagagatgattcaaggagcacagtgtttacaacaaatgaacagcctgactggcccggggactacgtgccgtgtaattacttgtgccagcagcagcacgtgccacttatctttcttcg

SEQ ID NO: 413114 - DNA, 558 bp, Homo sapiens
  misc_feature: GZ8MTXP01EVP38.11.6.A06.1.454.CMB.2.raw
  modified_base (392)..(392): a, c, t, g, unknown or other
  modified_base (409)..(409): a, c, t, g, unknown or other
  modified_base (438)..(438): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctatttaaaggtgtccagtgtgaggtgcatctggtggagtcgtgggggaggcttgggtaaaggccggggggtccttagactctcctgtgcagcctctggcatcactttcagtgacgcctggatgagctgggtccgccaggctccgaggggaggctggagtgggtgcgtataaagcgagctgctggtcggacaacgagactacgctgcacccgtgaacgggcagacttcaccatcncagagatgatcgaaggngcacagttgtttacaacgaaattgaaacncgtcctagacgtcgggacccggggactacgtcggccgttggtaactttaccgttgcggacccagcgaagcaacggccaaccgttggacccctatttattaaccttttttcgtttaaccgg

SEQ ID NO: 413115 - DNA, 580 bp, Homo sapiens
  misc_feature: GZ8MTXP01AN6UR.11.6.A06.1.454.CMB.2.raw
  modified_base (423)..(423): a, c, t, g, unknown or other
  modified_base (442)..(442): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttgggtaaaggccggggggtccttagactctcctgtgcagcctctggcatcactttcagtgacgcctggatgagcgtcgggtcccgccgaggcctccgagggggaaggggcgtggggaggtggggttggaccgtaagttaaaaggcggaggctggcgtgggtcggacaacgagactacgctcgccaccgtgaagggcagactcaccatcncagagatgattacgaaggngacactagttacgtttacaacaaatgaacagcctgaccgtcggacccggggactacgtcgtccgttgtaacttcgttggtcgccgagcaggcacggccaccgtcggaccctacgttactttaacttttcgtttaacgg

SEQ ID NO: 413116 - DNA, 528 bp, Homo sapiens
  misc_feature: GZ8MTXP01B3VTB.11.6.A06.1.454.CMB.2.raw
  modified_base (294)..(294): a, c, t, g, unknown or other
  modified_base (361)..(361): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctatttaaaaggtgtccagtgtgaggtgcatctggtggagtcgtgggggaggcttgggtaaaggccggggggtccttagactctcctgtgcagcctctggcatcactttcagtgacgcctggatgagctggggtccnccaggctccgaggggaaggggctgggagtgggtggccgtattaaaagcgaggctgctggtggacaanagactacgctgcacccgtgaagggcagattcacatctccagagatgattcaaggagcacagtgtttacaacaaattgaaacagccctgactgaccggggcacgtgccgtgtaattacttgtgccgagccagcacgccacgtcgcctacttattaactttctttaacg

SEQ ID NO: 413117 - DNA, 524 bp, Homo sapiens
  misc_feature: GZ8MTXP01AHA8V.11.6.A06.1.454.CMB.2.raw
  modified_base (490)..(490): a, c, t, g, unknown or other
tcagcgagagataccacgaccggtgctcgatttagatctactgacagggggagaggagccccagccttgggattcccaagtgttttcattcagtgatcaggactgaacacagagggctcaccatggagtttgggctgagctggattttccttactgctatttaaaggtgtccagtgtgaggtgcatctggtggagtctgggggaggcttggtaaagccggggggtccttagactctcctgtgcagcctctggcatcactttcagtgacgcctggatgagctgggtccgccaggctccgagggaggggctgggagtgggtggccgtattaaagcgaggctgctggtgggacaacagactacgctgcaacccgtgaagggcagattcaccatctcagagatgattcaaggacgcacagtgtttactaacaaagtgaaacagaccctgacctggccggggacacgtgccgtgtattaactgttgccagcagcngccaacctggcctagtattatttcgttgtaaccg

SEQ ID NO: 413118 - DNA, 556 bp, Homo sapiens
  misc_feature: GZ8MTXP01BOTRB.11.6.A06.1.454.CMB.2.raw
  modified_base (293)..(293): a, c, t, g, unknown or other
  modified_base (337)..(337): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgcttattttaaaaggtgtccagtgtgaggtgcatctggtggagtcgtgggggagcttgggtaaaggccggggggtccttagactctcctgtgcagcctctggcatcactttcagtgacgctggatgagctgggccnccaggctccgaggggagggctggagtgggtggccgtattaaagngaggctgcgtggtcggacaacgagacctacgctgcacccgtgaaacgggcaagacttcaccatctccagagatgaattacgaaggacgacaactagttagtttactaacaaagtagaaacagcctgacgtacggcccggggtaactcgtcgtccgttgtaacttacgttcgtcgccgagcacgcgacgtccacgtcgacctacttacttcgtttcgttg

SEQ ID NO: 413119 - DNA, 538 bp, Homo sapiens
  misc_feature: GZ8MTXP01ASXUF.11.6.A06.1.454.CMB.2.raw
  modified_base (283)..(283): a, c, t, g, unknown or other
  modified_base (420)..(420): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggtattttccttgctgcttaattttaaaaggtgtccagtgtgaggtgcatctggtggagtcgtgggggaggcgttgggtaaaggccggggggtccttagactctcctgtgcagcctctggcatcactttcagtgacgccnggatgagcgtgggtccgccaggctccgaggggagggctggagtgggtggcgtattaaagcgagctgcgtggtcggacaacgagactacgctgcacccgtgaagggcagactcaccatctcagagatgatcgaagganacactagttgtttacaacgaaatgaacagcctgactcggaccggggactacgtcgccgtgtaacttcttgtcgcgagcagcacgccacgtcgcctattacttaacgtttcgtttaacg

SEQ ID NO: 413120 - DNA, 619 bp, Homo sapiens
  misc_feature: GZ8MTXP01A1PT0.11.6.A06.1.454.CMB.2.raw
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttgggtaaaggccggggggtccttagactctcctgtgcagcctctggcatctactttcagtgacgctggatgagcgtgggtccgccaggcctccgagggggaaggggcgtggggaggttgggggttggaccgtaagtttaaaaggcggaggctggcgtgggtacgggacaacgagactacgctgcgacccgtgaacgggcagacttccacactctccagagatagaattacgaaggacgacgacgtaagttgtttaactaactaaaagtacgaaacacggcctaggaccgtacgggacccggggaactacgtcggtcccgttggttaactttaccgttggtcgcccgaaggcaacgcacggccctaccgtcggaccctaatttactttaacgttttcgttttaacg

SEQ ID NO: 413121 - DNA, 623 bp, Homo sapiens
  misc_feature: GZ8MTXP01BA3L2.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaggtgtccagtgtgaggtgcatctggtggagtcgtgggggaggcgttgggtaaaggccgggggtccttagactctcctgtgcagcctctggcatcactttcagtgacgctggatggagcgtgggtcccgccgaggcctccgagggggaaggggcgtgggaggttggggttggaccgtaagttaaaacggcggaggcgtggcgtgggtcggacaacgagactacgctgccgacccggtggaacgggcagattcacatctaccaagagagtgaattacgaaaggacgacaacgtagttacgtttaacaaacgtaaagtcggaaaccacgacccgttaggaccgtgggaccccgggggactacggttcgcccggttgttaactttacgttggtaccgaccgagccgacgccacgaaccctaccgtcggtacccactttatttaacgttttcgttaaccgg

SEQ ID NO: 413122 - DNA, 647 bp, Homo sapiens
  misc_feature: GZ8MTXP01AEI9A.11.6.A06.1.454.CMB.2.raw
  modified_base (282)..(282): a, c, t, g, unknown or other
  modified_base (299)..(299): a, c, t, g, unknown or other
  modified_base (451)..(451): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggtcgttgggtaaaggccggggggtcccttaggactctcctgtgcagcctctggcatcactttcagtgacgcnggatgagcgtgggtccnccaggctccgaggggagggctgggagtggggttgaccgtaataaaagcgaggctgcgtgggtacggacaacgagactacgctcgcacccgtggaagggcagtactcaccatcctcgagatatgtaacttacgaagggacacaacgtaggttnttttacaaacggtaaaatcggaaactacgtcccgtagaccgtacggacccgggggtaaactccgttacggcccgttggttaaacgtttacgttcggttcggcctaaacgggccaaacgggttcccaacggtaacccacccggttaacgggacccccttaagtttaacgttttaacgttttttcccttttaacgggg

SEQ ID NO: 413123 - DNA, 545 bp, Homo sapiens
  misc_feature: GZ8MTXP01A3X2L.11.6.A06.1.454.CMB.2.raw
  modified_base (295)..(295): a, c, t, g, unknown or other
  modified_base (360)..(360): a, c, t, g, unknown or other
  modified_base (396)..(396): a, c, t, g, unknown or other
  modified_base (412)..(412): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccggggggtcccttagactctcctgtgcagcctctggcatcactttcagtgacgcctggatgagctgggtccnccaggctccgaggggagggctggagtgggtggccgtataaaggcgaggctgctgggtcggacaangactacgctgcacccgtgaaagggcagatcacatcncagagatgatcaaagngaccatagtgtttactaaagaatagaacacgcctgacgtcggaccgggactacgtcgtccgttgtaacttcgttcggtcgccgagcacgccacgccaccgtcggaccctacgttactttaacgttttcgttcg

SEQ ID NO: 413124 - DNA, 529 bp, Homo sapiens
  misc_feature: GZ8MTXP01DU45U.11.6.A06.1.454.CMB.2.raw
  modified_base (357)..(357): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttgggtaaaggccggggggtcccttagactctcctgtgcagcctctggcatcactttcagtgacgcctggatgagctgggtccgccaggctccgaggggagggctggagtgggtgccgtattaaagcgagctgctggtggacaanagactacgctgcacccgtgaagggcagattcaccatctcagagatgattcgaaggagacactagttagtttactaacaaattgaaacagcctgactcggaccggggacacgtgccgtgtaacttcgttgtcgccagcagcagcaccgtcgcctacttattaactttctttcg

SEQ ID NO: 413125 - DNA, 774 bp, Homo sapiens
  misc_feature: GZ8MTXP01BWY3X.11.6.A06.1.454.CMB.2.raw
  modified_base (286)..(286): a, c, t, g, unknown or other
  modified_base (305)..(305): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggtattttccttgctgcttaattttaaaaggtgtccagtgtgaggtgcatctggtggagtcgtgggggaggcgttagggtaaacggccggggggtccttagactctcctgtgcagcctctggcatctactttcagtgacgccnggatgagcgtcgggtcccnccgaggccgtaccggaagggggaacggggcgtgggggtaggttgggggttacgggtaccggttaaagtttaaaaaggtcggaagggtcgtaggcgttggggtaccggggaaaccaaacgacggtaaccctacggccgttacggcccgtaacccgggtagggaaacgggcctaaggtacttacccgaaccctacttaccctaccgaaggaagtaagttagtaaacgttaccgaaaagggtacaaccgtaacgtaaggtttacgttttaacccgaaaacgtaaaagttacggaaaccacggtacccttacggaccgttcggggaccccgggggtaactaccggtcggtcccggttagttaacgtttaccgttgggtacgacccgaggtccgaacggccgaaccggtaaccctacccggttccggtaaccccttaacgttttattttaaccgttttttccgtttaacccggg

SEQ ID NO: 413126 - DNA, 590 bp, Homo sapiens
  misc_feature: GZ8MTXP01DWMZB.11.6.A06.1.454.CMB.2.raw
  modified_base (255)..(255): a, c, t, g, unknown or other
  modified_base (399)..(399): a, c, t, g, unknown or other
  modified_base (406)..(406): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagcgtggtattttccttgctgctatttaaaggtgtccagtgtgaggtgcatctggtggagtcgtgggggagcttgggtaaaggccggggggtcccttagactctcctgtgcagcctntggcatcactttcagtgacgcctggatgagcgtgggtccgcgaggctccgaggggagggctggagtgggtgcgtagttaaagcgagctgcgtggtagggacaaacgagactacgcgtgccgaccgtgaagggcagattcaccanctcaganatgattcaaggagacaacgaggttatttacctaacgtaaataggaaacctagacccttgacgtcggacccggggtacacgtcggtcccgtagtaacttcgttggtacgcccgagcgaaacggccaaacggccctaacccgtcgggtacccctacgttaattttaacttttccgttttaaccggg

SEQ ID NO: 413127 - DNA, 595 bp, Homo sapiens
  misc_feature: GZ8MTXP01D92XR.11.6.A06.1.454.CMB.2.raw
  modified_base (406)..(406): a, c, t, g, unknown or other
  modified_base (411)..(411): a, c, t, g, unknown or other
  modified_base (449)..(449): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgcttaattttaaaaggtgtccagtgtgaggtgcatctggtggagtcgtgggggaggcttagggtaaaggccggggggtcccttagactctcctgtgcagcctctggcatcactttcagtgacgctggatgagctgggtccgccaggctccgaggggagggctgggagtgggtggccgtattaaaggcgagctgctggtcggacaacgagactacgctcgccacccggtgaagggcagtactcaccatcncaganatgaattcgaaagagacacgtagttacgtttaccaaanaaattacggaaacacggaccttaggaaccggttcgggaacccgggggactacgttcgtacccgttggtaactttacgttgtacgacgacgccgaaggccacggcccaaccgtcggacctacttaatttctttttcgttttaaccgg

SEQ ID NO: 413128 - DNA, 613 bp, Homo sapiens
  misc_feature: GZ8MTXP01AXYPB.11.6.A06.1.454.CMB.2.raw
  modified_base (256)..(256): a, c, t, g, unknown or other
  modified_base (310)..(310): a, c, t, g, unknown or other
  modified_base (518)..(518): a, c, t, g, unknown or other
  modified_base (568)..(568): a, c, t, g, unknown or other
  modified_base (579)..(579): a, c, t, g, unknown or other
  modified_base (587)..(587): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgcttaagttttaaaaggtgtccagtgtgaggtgcatcgtggtggagtcggtgggggagtcgttagggtaaacggccgggggttcctagactctctgtgcncgcctcgtggcatctactttcgagtcgaccgtcgtggatgagcgtcgggtcccncgaggcctaccggagggggacggtcgtgggtaggttggggttcggaccgttaaagttaaaacggcggaggtctggcgttaggggacggaacaaacgagaccgtacgtcgcgccgacccggtagggaacgggcagtactacactatcacgagagtatgtaactacgaaggcgaccaagtaggtttctttaacaaactaaagtagaaacncgtactacgacgtcgggaccgggatacgtcgtacgtgtaacttcgttgcncgagccgagcncggaaccncgtcgactattattctttcgttaacg

SEQ ID NO: 413129 - DNA, 624 bp, Homo sapiens
  misc_feature: GZ8MTXP01CCJV1.11.6.A06.1.454.CMB.2.raw
  modified_base (354)..(354): a, c, t, g, unknown or other
  modified_base (417)..(417): a, c, t, g, unknown or other
tcagcgagagataccacgaccggtgctcgatttagatctactgacagggggagaggagcccagccttgggattcccaagtgttttcattcagtgatcaggactgaacacagagggctcaccatggagtttgggctgagctggattttccttgctgctattttaaaggtgtccagtgtgaggtgcatctggtggagtcgtgggggaggcttgggtaaaggccggggggtcccttaggactctcctgtgcagcctctggcatcactttcagtgacgcctggatgagctgggtccgccaggctccgaggggagggctggagtgggtggccgtataaagcgagctgctggtcggacanagactacgctgcacccgtgaacgggcagacttcactactctaccagagatgaattcgaagggngacacgtagttagtttacctaacaaattcggaaacctaggcccctagaccgtcgggaccccgggggactaaccggttcgaccccggttaggttaacgtttaccgttcgggtcgaccccgtaaagggccgaacgggccaacggccccgtaacccgttcggggacccccttaaccgtttaattttaaccgtttttccgttttaaccggg

SEQ ID NO: 413130 - DNA, 617 bp, Homo sapiens
  misc_feature: GZ8MTXP01ADM96.11.6.A06.1.454.CMB.2.raw
  modified_base (191)..(191): a, c, t, g, unknown or other
  modified_base (271)..(271): a, c, t, g, unknown or other
  modified_base (281)..(281): a, c, t, g, unknown or other
  modified_base (320)..(320): a, c, t, g, unknown or other
  modified_base (356)..(356): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagcgtgtagtttcctaggctgactagtttaaagtgtcagtgtgaggtgcatntggtggagtcgtgggggagcttggtaaaggccggggggtccttagactctcctgtgcagcctctggcatcaacctttttnagtgacgcgnggatgcgcgtcggtccgcgacgcgacggaggggacgggngtggtaggtgggtacggtacgtaagtaaagacgagngtgcgtggtacggacgacgacgactacgacgtcgcgacgacgacggacgagtactacactactactacgagagatagtagtacgaagaacgacgtacgtaacgttacgttaactaaacgtaaacgtaacgaacgaacgtaccgtacgtacggtacggaccgggaccgtacgtacgtacgttagttaacgttacgttcgtcgacgacgacgacgcgacgaaccgaccgtaacgtactacttactttaacgtttcgtttaacg

SEQ ID NO: 413131 - DNA, 599 bp, Homo sapiens
  misc_feature: GZ8MTXP01BU5OL.11.6.A06.1.454.CMB.2.raw
  modified_base (280)..(280): a, c, t, g, unknown or other
  modified_base (296)..(296): a, c, t, g, unknown or other
  modified_base (361)..(361): a, c, t, g, unknown or other
  modified_base (446)..(446): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggtattttccttgctgcttattttaaaaggtgtccagtgtgaggtgcatctggtggagtcgtgggggagcgttgggtaaaggccggggggtccttagactctcctgtgcagcctctggcatcactttcagtgacgcnggatgagctgggtccnccgaggctccgaggggaaggctgggagtgggtgcgtaattaaagcgaggctgcgtggcggacaanagactacgctgcacccgtgaagggcagtacttcaccctagttcaccgagagtatagtaaattcgaaagggacaccgaataggttnttttacaaacgtaaatgaaaccaggtcctggaccgtcgggacccggggactacgtggcccgttgtaaacttcgttggtaccgcctaaacgcgttacgccgaacgcccgtacccgcgggacccctaatttacttaacgttttttccttaaccgg

SEQ ID NO: 413132 - DNA, 632 bp, Homo sapiens
  misc_feature: GZ8MTXP01CYNWW.11.6.A06.1.454.CMB.2.raw
  modified_base (347)..(347): a, c, t, g, unknown or other
  modified_base (488)..(488): a, c, t, g, unknown or other
  modified_base (503)..(503): a, c, t, g, unknown or other
  modified_base (585)..(585): a, c, t, g, unknown or other
  modified_base (588)..(588): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggtattttccttgctgtcttaattttaaaaggtgtccagtgtgaggtgcatcgtggtggaggtcggtggggggaggtcgtttaggggtaaaacgggtcccggggggggttccctttaaggaccttccgtccgtggtcgcacgtcccttcgtggactattcctaactttcgaagtcgaccgccgtggatggagtcgtcgggtccnccgagccgtaccggagggggacggggcgtggggaggttggggtaggaccgttaaagttaaaggcggaggctggcgttgggacgggacacgagacctacgcgtcgccgacccggtaggaacgggcagactcaccatcacagnatagatacgaagganacgtatagttacttacaaagtaagtacgactacgacgtcgacgtcggacccgggactcgtcgtcgttagttctcgttcgtcncgngcgacgcgcgaacacgtcgtactacttactttaacgtttcgtcg

SEQ ID NO: 413133 - DNA, 594 bp, Homo sapiens
  misc_feature: GZ8MTXP01C4IIG.11.6.A06.1.454.CMB.2.raw
  modified_base (293)..(293): a, c, t, g, unknown or other
  modified_base (352)..(352): a, c, t, g, unknown or other
  modified_base (370)..(370): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggaaagccggggggtcccttagactctcctgtgcagccctctggcatcactttcagtgacgctggatgagctgggtccnccgaggctccgaggggaggctggagtgggtgcgtaataaagcgagctgctggcggacanagactacgctgcacccgngaagggcagactcaccatcaccagagatagattacgaaggacgaccaactaggttacgtttaacctaaacgtaaaacttacggaaaactacgccccgttaggaacccgtggggaaccccgggggaactacgtcggtacccgttaggttaacttacgttgggtcacccgagcaacgccaaggcccaacccgtggaccctactttaattaacgttttctttaacgg

SEQ ID NO: 413134 - DNA, 671 bp, Homo sapiens
  misc_feature: GZ8MTXP01AFRL8.11.6.A06.1.454.CMB.2.raw
  modified_base (281)..(281): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggtattttccttgctgctattttaaaaggtgtccagtgtgaggtgcatctggtggagtcgtgggggaggcgttgggtaaaggccggggggtccttagactctcctgtgcagcctctggcatcactttcagtgacgccnggatgagcgtcgggtccgccgaggctccggagggggaacggggcgtgggaggttgggggttcggaccggttaagttaaaaggcggaggctggcgtgggtcggacaacgagactacgctgcacgacggtaggaacgggcaggtacttacccgaacctacgtcctaccgaagagtatagtactacgaaggaacgactaacgtagtttacgtttaactaaactaaagtacgaaaccgtacgacccgtacggtaccgtaccggggacccgggtacgtaaccggtccggtcccggtttaagttaacgtttacggtcgttaccgaccgaacgccgacggaccgaacgcccgtaacccgaccggtaccccttaatttaacttttaacgtttttccgg

SEQ ID NO: 413135 - DNA, 631 bp, Homo sapiens
  misc_feature: GZ8MTXP01E1N33.11.6.A06.1.454.CMB.2.raw
  modified_base (257)..(257): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttgggtaaaggccggggggtccttagactctcctgtgcagcctntggcatcactttcagtcgacgcctggatgagcgtcgggtcccgccgaggcgtccgagggggaagggcgtgggaggtggggttggaccgtaagttaaaaggcggaggctggcgtgggtacgggaacaacgaggactacgctcgccgacccgtggaaagggcagacttcaaccatcctacagagatagtatacgaaaggcgacactagttacgtttactaaacgaaagttacgaaaccgacgccttacggaccgttcggggaacccggggactaccgttcggtacccggttgttaattaccgttggtcgacccgagaccgacgccgaacgcccgtaccgtcggtaccctattactttaactttttcgtttaaccgg

SEQ ID NO: 413136 - DNA, 641 bp, Homo sapiens
  misc_feature: GZ8MTXP01A1J44.11.6.A06.1.454.CMB.2.raw
  modified_base (255)..(255): a, c, t, g, unknown or other
  modified_base (452)..(452): a, c, t, g, unknown or other
  modified_base (458)..(458): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgcttaattttaaaaggtgtccagtgtgaggtgcatctggtggagtcgtgggggaggcgttgggtaaaggccggggggtcccttagactctcctgtgcngcctctggcatcactttcagtgacgcctggatgacgcgtcgggtccgccgaggccgtaccggagggggaacggggcgtggggacggttgggggttacggaccggtaaagttaaaggcggaggtctggcgtggggtacgggaacaacgacgactacgctacgccgtacccggtaggaagggcaagtactccaccatcncaaganatgaacttacgaaaggcgacctaagtagttacgtttaacaaacgtaaagtcgaaacctcgtaccgtgaacccgtcgggacccggggactacgtcggtacccgttagtaacgttacgttcgtcgccgaaagcgaacgcaacgccctaaccggtcgaccctaattctttaacgttttccgttcgg

SEQ ID NO: 413137 - DNA, 724 bp, Homo sapiens
  misc_feature: GZ8MTXP01BK3WR.11.6.A06.1.454.CMB.2.raw
  modified_base (255)..(255): a, c, t, g, unknown or other
  modified_base (282)..(282): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggtattttccttgctgcttaattttaaaaggtgtccagtgtgaggtgcatctggtggagtcgtgggggaggcgttgggtaaaggccggggggtcccttagactctcctgtgcngcctctggcatcactttcagtgacgcnggatgagcgtgggtcccgccgaggcctccggagggggaacggggcgtggggaggttgggggttggaccgttaagttaaaaggcggaggctggcgtggggtacgggaacaaacgacgtacctacgccttacggcccgaccccggtagggaaacggggcaaggtacttcccgaaccacgtcctaccgaagagtatacgtaagttacgaaaggacgactaacgtaaggtttacgtttaacctaaacgtaaaagttacggaaaacctacggaccgttacggaacccgttcgggaaccccgggggactaacccggttcggtacccgtttaggttaactttaacggttcggttaccgaccggtaaacgcccgacgggcccaccggaacccgtaaccccgtcggtaccccctaagtttacttttaaccgtttttccgttttaacccggg

SEQ ID NO: 413138 - DNA, 689 bp, Homo sapiens
  misc_feature: GZ8MTXP01A202D.11.6.A06.1.454.CMB.2.raw
  modified_base (293)..(293): a, c, t, g, unknown or other
tcagcgagagataccacgaccggtgctcgatttagatctactgacgagggggggagaggagccccagccttgggattcccaagtgttttcattcagtgatcaggactgaacacagagggctcaccatggagtttgggctgagctggtattttccttgctgcttaattttaaaaggtgtccagtgtgaggtgcatcgtggtggagtcgtgggggagtcgttagggtaaacgggcccggggggtccttagaccttctccgtgtgcacgcctctggcatctactttcagtgacgcnggatgagcgtgggtcccgccgaggccgtccggagggggaacggggcgtaggggtaggttgggggttacggaccggtaagttaaaacggcggaggcgtaggcgtgggtacggaacaagacgactacgctcgccacccgggtaggaaacgggcaagtacttccacctactctaccgagagatgtaattacgaagacgactaactaggtttacttaaccgaaataaacgttacggaaacctacgggtaccctaggacccggttacgggaccccggggtaaactccggttcggtacccggtttaggttaaaccgtttcgttcggtcgaccgacggcgaacggccaaccgcccgttaccgcggtacccttagttaacttttccgttttcgtttaacccggg

SEQ ID NO: 413139 - DNA, 629 bp, Homo sapiens
  misc_feature: GZ8MTXP01DL6LQ.11.6.A06.1.454.CMB.2.raw
  modified_base (171)..(171): a, c, t, g, unknown or other
  modified_base (257)..(257): a, c, t, g, unknown or other
  modified_base (440)..(440): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgctatttaaaggtntccagtgtgaggtgcatctggtggagtcgtgggggagcgttagggtaaaggccggggggtcccttagactctcctgtgcagcctcnggcatcactttcagtgacgctggatgagcgtgggtccgccgaggcctaccggaggggagggcgtgggaggttgggtcggaccggtaagttaaaggcgaggctggcgtgggtacggacaaagcgactacgctagcacccggtgagggcagactacacatctcgagagagtagattacgaagganacaactagttactttaccaaagaaacgttcgaaacgtacgacctacggtaccgtcggggaacccggggtactaccgtcggtacccgttggttaaactttccgttgggtacacccgaggccgaacggccgacgtaaccctaccgtaacggtacccttaacgtttagtttaacctttttcgtttaaccggg

SEQ ID NO: 413140 - DNA, 656 bp, Homo sapiens
  misc_feature: GZ8MTXP01B0RC1.11.6.A06.1.454.CMB.2.raw
  modified_base (314)..(314): a, c, t, g, unknown or other
  modified_base (406)..(406): a, c, t, g, unknown or other
tcagcgagagataccacgaccggtgctcgatttagatctactgacagggggggagaggagccccagccttgggattcccaagtgttttcattcagtgatcaggactgaacacagaggctcaccatggagtttgggctgagctggtattttccttgctgtcttaattttaaaaggtgtccagtgtgaggtgcatcgtggtggagtcggtgggggaggtcgttagggtaaacgggcccggggggttccttagactctcctgtgcacgcctcgtggctatcctactttcagtgacgcgtggatgagcgtcgggtccnccgaggcctaccggaagggggacggggcgtgggagggttggggttaggaccgtaaagttaaaggcggaggcgtgcgtgggtacggacaacgngactacgctcgccgacccgtaggaacggcaagtactaccactactctacagagatagaacttacgaagggacacgaacgtagttacgtttacaaacgtaaacgtacgaaaccagtaccctaggaccgtacgggaccccggggtaactccggtacgtcccggttagttaacgttacgttcgccgacgacgcgaacgcgaacgccctacccggtcgtacccttaacttactttaacgttttcgtttaaccgg

SEQ ID NO: 413141 - DNA, 560 bp, Homo sapiens
  misc_feature: GZ8MTXP01DBNE4.11.6.A06.1.454.CMB.2.raw
  modified_base (265)..(265): a, c, t, g, unknown or other
  modified_base (287)..(287): a, c, t, g, unknown or other
  modified_base (502)..(502): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggtatttttccttgctgtcttaattttaaaaggtgtccagtgtgaggtgcatctggtggagtcgtgggggaggcgttagggtaaaggcccggggggtccttagactctcctgtgcagccctntggcatcactttcagtgacgcnggatgagctgggtccgccaggctccgaggggaagggctggagtgggtgcgtattaaaagcgagctgctggtacggacaacgagactacgctgccaccgtgaagggcagatcacatctcagagatgattacgaagacgacacagttagttactaacgaaatgaaacacgacctagaccgtcggacccgggactacgtcggccgtgttaacttacgngtcgccgaagcgaacgcaagccaaccgtcgaccctacttacttaactttcgtttaacg

SEQ ID NO: 413142 - DNA, 643 bp, Homo sapiens
  misc_feature: GZ8MTXP01ES7SF.11.6.A06.1.454.CMB.2.raw
  modified_base (254)..(254): a, c, t, g, unknown or other
  modified_base (356)..(356): a, c, t, g, unknown or other
tcagcgagagataccacgaccggtgctcgatttagatctactgacagggggggagaggagccccagccttgggattcccaagtgttttcattcagtgatcaggactgaacacagagggctcaccacggagtttgggctgagctggattttccttgctgctatttaaaaggtgtccagtgtgaggtgcatctggtggagtcgtgggggagcgtggtaaaggccggggggtcccttagactctcctgtgcagcctntggcatctacttcagtgacgcctggatgagcgtggtccgccaggctccggagggagggctggagtggtgacgtataaagcgaggctgcgtggtggaaccaanagactacgctagaccgtcccgtgaagggccaagtcttacaccatctccagagatagagttacgaaggacgacaacgtagttacgtttaactaacgtaaaatcggtaaacctaacgtcccgttacgaaccggttccggggaccccgggggaactaaccggttcggacccggtttagggtaacttaacgttcggttacggaccccgaagacccggaacgaccgttacgaccctaacccggtccggtaacccttaactttacgtttacgtttttccgtttcggtaaccgg

SEQ ID NO: 413143 - DNA, 618 bp, Homo sapiens
  misc_feature: GZ8MTXP01AJ292.11.6.A06.1.454.CMB.2.raw
tcagcgagagataccacgaccggtgctcgatttagatctactgacagggggggagaggagccccagccttgggattcccaagtgttttcattcagtgatcaggactgaacacagagggctcaccatggagtttgggctgagctggtatttttccttgctgacttaattttaaaaggtgtccagtgtgaggtgcatctggtggagtcgtgggggaggcgttagggtaaacggccggggggtccttagactctcctgtgcagcctctggcatcactttcagtgacgctggatgagcgtcgggtccgccgagggcctccggaggggaaggggcgtgggaggttgggggttcggaccgtaagttaaaacggcggaggcgtggcgtgggtcggaacaacgagactacgctcgccgaccggtgaacgggcaagtacttaccaccactctaccgagagatgtaattcgaaaggacgactaacgtagttacgtttactaaacgaaagtacgaaacgacgtacccgtaggaccgtcgggacccggggactacgtcgtccgttgtaacttacgttgtcgcgacgcagcacgccacgtcggacctacttacttaacgtttcgtttaacg

SEQ ID NO: 413144 - DNA, 647 bp, Homo sapiens
  misc_feature: GZ8MTXP01AMGL6.11.6.A06.1.454.CMB.2.raw
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggagcgttagggtaaaggccggggggatcccgttagactctcctgtgcagcctcgtggcatctactttcgagtcgacgcctggatggagcgtgggtcccgcgaggcgtccgaggggaacggggctaggggagtggggttggaccgttaagttaaaaggcgaggctggcgtgggtacggacaacgcgtacctaacgctcggaccaacccgggtaggaacggggcaacggtacttaccaacccaatcccgtaccgaagacgatacgaagttacgaaagacgacgacgtagtttacgtttacaaactaaatcggaaacacgtccgtagaccgtacggaccggggactacgttcgcccggttaatacgttacgtcgacggacccctaagcgaacggccaacggcctaaccgtcggaccccttagttaactttaacgtttttcccg

SEQ ID NO: 413145 - DNA, 562 bp, Homo sapiens
  misc_feature: GZ8MTXP01DP1W4.11.6.A06.1.454.CMB.2.raw
  modified_base (299)..(299): a, c, t, g, unknown or other
  modified_base (373)..(373): a, c, t, g, unknown or other
  modified_base (412)..(412): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgctatttaaaggtgtccagtgtgaggtgcatctggtggagtcgtgggggaggcttgggtaaaggccggggggtcccttagactctcctgtgcagcctctggcatcactttcagtgacgcctggatgagcgtgggtccgccgnggcctaccggaggggaaggggctggggaggttgggtggccgtaagttaaagcggaggctgcgtggtggacaagngactacgctcgccgaccggtgaagggcagattcacatcnccaagagatagattacgaaggacgacacgagttattacctaagtaaagtgaaacacgcctgacgtggaccgggactcgtcgccgttataatcgttgtcgcgagcaagccacgcctaccgtcggacccttattagtttaactttcgtttcg

SEQ ID NO: 413146 - DNA, 622 bp, Homo sapiens
  misc_feature: GZ8MTXP01BY9TJ.11.6.A06.1.454.CMB.2.raw
tcagcgagagataccacgaccggtgctcgatttagatctactgacagggggggagaggagccccaaccttgggattcccaagtgttttcattcagtgatcaggactgaacacagagggctcaccatggagtttgggctgagctggattttccttgctgctattttaaaggtgtccagtgtgaggtgcatctggtggagtcgtggggagcgttggtaaaggccggggggtccttagactctcctgtgcagcctctgcatctactttcagtgacgctggatgagcgtgggtcccgcaggctccgaggggacgggctgggagtgggttaggaccgtaagttaaaacggcgaggctgcgtgggtaggaccaacgagacctacgctacgccgaacccggtggaaacgggcaaggtacttaccaacctatcctaccgagagatagtaattaccgaaggagcaacgtagttacgttactaacgtaacgtacgaaacacgtccgttagaccgtcgggccgggactacgtcggtaccgttagttaacgttaacgtgttcgccgttacgcgacgccgacgccgtaacccgtcggaacccttacttaactttcgttttcgtttcgtaacccgg

SEQ ID NO: 413147 - DNA, 778 bp, Homo sapiens
  misc_feature: GZ8MTXP01E0EKQ.11.6.A06.1.454.CMB.2.raw
  modified_base (256)..(256): a, c, t, g, unknown or other
  modified_base (284)..(284): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggtattttccttgctgcttattttaaaaggtgtccagtgtgaggtgcatctggtggagtcgtgggggaggcgttagggtaaacggccggggggtccttagactctcctgtgcngcctctgcatctactttcagtcgacgcnggatgagcgtcgggtccgccgaggccgtccggagggggaaggggcgtggggaggttgggggttggaccgttaaagttaaaggcggaggctggcgtggggtacggaacaacgagactacgctcgccgacccggtggaaacggggcaagtacttccaacccgtatacctacgaggtaagtacgttagtaaacgtttacgaaacgggtacgaccgtaaccgtaaaggttttaccgttttaaacctaaaccggttaaaaagtttaccgggaaaaccgtaccggtaccccgttaacgggacccggttaccgggggaaccccgggggtaacccttaacccgggttcgggttcccggtttaacgggttaaaccttttaacccgttgggtaccggaccccgtaaagggtccgaacgggccaccgggaaccccgtaacccggtttccgggtaaaccccttaattttaaccgtttttaaccgtttttccggtttttaacccggg

SEQ ID NO: 413148 - DNA, 641 bp, Homo sapiens
  misc_feature: GZ8MTXP01AT5HV.11.6.A06.1.454.CMB.2.raw
  modified_base (276)..(276): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctatttaaagtgtccagtgtgaggtgcatctggtggagtcgtggggaggcgttgggtaaaggccggggggtccttaggactctcctgtgcagcctctggcatcactttcagtgacgtcnggatgagctgggccgccgaggcgtccgagggggaggcgtgggacggtgggttcggaccgtaagttaaaggcgtaggcgtgcgtgggtcggaacaagacgtactacgactcgcacccggtagaaacgggtcaaggtacttcgacccatccgtaccagacgtatggattacgaaggacgacctaacgtagttacgtttaaccaaactaaagttcgaaaccgacgtacccgttaggaccgtacggggaccccggggactaccggttggcccgttagttaactttacgttgttacggttcaacggtcgacgcgaccgtccgaaccgttcgggccccttaagtttaacctttcttttccgttttaaccgg

SEQ ID NO: 413149 - DNA, 510 bp, Homo sapiens
  misc_feature: GZ8MTXP02GZT0I.11.6.A06.1.454.CMB.2.raw
tcagcgagagataccacgaccggtgctcgatttagatctactgacagggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccggggggtcccttagactctcctgtgcagcctctggcatcactttcagtgacgcctggatgagctgggtccgccaggctccgaggggaagggctggagtgggttggccgtattaaaagcgaggctgctggtcggacaacagactacgctgcacccgtgaagggcagatcaccatctccagagatgatcaaggagcacagtgttactaacaaatgaacagcctgactggccggggacacgtgccgtgtatactgtcgccagcagcagcactcgccatatactttcttcg

SEQ ID NO: 413150 - DNA, 506 bp, Homo sapiens
  misc_feature: GZ8MTXP02I9S6J.11.6.A06.1.454.CMB.2.raw
  modified_base (470)..(470): a, c, t, g, unknown or other
tcagcgagagataccacgaccggtgctcgatttagatctactgacaggggagaggagccccagccttgggattcccaagtgttttcattcagtgatcaggactgaacacagagggctcaccatggagtttgggctgagctggattttccttgctgctatttaaaggtgtccagtgtgaggtgcatctggtggagtctggggaggcttgggtaaagccggggggtcccttagactctcctgtgcagcctctggcatcactttcagtgacgcctggatgagctgggtccgccaggctccgaggggaaggggctggagtgggtggccgtataaagcgaggctgctggtgggacaacagactacgctgcacccgtgaagggcagattcaccatctccagagatgattcaaggagcacagtgtttactacaaatgaacagcctgactggccggggacacgtgccgtgtacttacngtcgccagcagcagcacgtgccactatacttcttcg

SEQ ID NO: 413151 - DNA, 546 bp, Homo sapiens
  misc_feature: GZ8MTXP02F6PTE.11.6.A06.1.454.CMB.2.raw
  modified_base (419)..(419): a, c, t, g, unknown or other
  modified_base (437)..(437): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccggggggatcccttagactctcctgtgcagcctctggcatcactttcagtgacgcctggatgagcgtgggtcccgccaggcctccgaggggaaggggcgtgggaggtggggttggaccgtaaagttaaaaggcgaggctggcgtgggtgggacaacgagactacgctgccacccggtgaagggcagatcaccatcncagagatgattcgaaggngacacagttgtttacaacaaatgaaacagcctagacgtcggaccggggacacgtgccgtgtacttactcgtcgccagcagcaagcaccgtcgcctactacttactttcg

SEQ ID NO: 413152 - DNA, 539 bp, Homo sapiens
  misc_feature: GZ8MTXP02JVSCL.11.6.A06.1.454.CMB.2.raw
  modified_base (429)..(429): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccgggggggtcccttaggactctcctgtgcagcctctggcatcactttcagtgacgcctggatgagctgggtccgcaggctccgaggggaagggctggagtgggtggcgtataaaagcgagctgctggtgggacaacagactacgctgcaccgtgaagggcagatcaccatctcagagatgattcaaggagcacagtgttactaaanaatagaacacgactagacgtacggaccgggacacgtcgtcgtagtacttacgtgtcgacgagacgacgcacgaaccgtaccgtacgacctactacttactttactttacg

SEQ ID NO: 413153 - DNA, 562 bp, Homo sapiens
  misc_feature: GZ8MTXP02FVA7U.11.6.A06.1.454.CMB.2.raw
  modified_base (385)..(385): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttgggtaaaggccggggggtccttagactctcctgtgcagcctctggcatcactttcagtgacgcctggatggagcgtgggtccgccgaggcctccgaggggaaggggcgtgggaggtggggttggaccgttaagttaaaaggcggaagggctggcgtagggtagggaaaacngactacgctgcacccgtgaacgggcaagattcaccatcctaccagagatgattacgaaggagcacagtgttactaaacaatgaacagcctgactcggaccgggacacgtgccgtagtacttacgtgtcgccagcagcacgcaaccgtcggacctacgttatactttcgtttagtccg

SEQ ID NO: 413154 - DNA, 558 bp, Homo sapiens
  misc_feature: GZ8MTXP02FVPG7.11.6.A06.1.454.CMB.2.raw
  modified_base (452)..(452): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttgggtaaaggccggggggtcccttaggactctcctgtgcagcctctggcatcactttcagtgacgcctggatgagcgtgggtccgccgaggcctccgaggggagggcgtggaggtgggttggccgtaagttaaaaggcggaggctgcgtgggtcggacaacgagactacgctgccaccgtgaagggcagatcacatctacagagatgatcgaaaggagcaactgttagtttacctaaanaaaattgaaacacgcctagacgtgggacccggggacacgtcgtccgttagtacttacgtggtcgaccagccaagcagccacgtcgacctatacttatttctttacg

SEQ ID NO: 413155 - DNA, 574 bp, Homo sapiens
  misc_feature: GZ8MTXP02HNNQI.11.6.A06.1.454.CMB.2.raw
  modified_base (255)..(255): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccggggggtccttagactctcctgtgcagcctntggcatcactttcagtgacgcctggatgagcgtgggtcccgccaggcctccgaggggagggctgggaggtgggtggccgtaagttaaaaggcgaggctggctgggtgggacaacgagactacgctgccgacccgtgaagggcagactcaccatctcagagatgattacgaaggagcacgtagttacgtttactaaacaaaattgaaacacgccgtgaccgtggacccggggcacgtcggcgttagttacttacgtggtcgaccgagaccgacgaccacgccgaaccgtcggaccctaattacttactttttcgtttacg

SEQ ID NO: 413156 - DNA, 650 bp, Homo sapiens
  misc_feature: GZ8MTXP02HFJO6.11.6.A06.1.454.CMB.2.raw
  modified_base (400)..(400): a, c, t, g, unknown or other
  modified_base (418)..(418): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccggggggtccttaggactctcctgtgcagccctctggcatcactttcagtgacgcctggatgagcgtcgggtcccgccgaggcctccgaggggaaggggcgtgggaggtggggttggaccgttaagttaaaacggcgaggctgcgtgggtcggacaacgagactacgctgccaccgngaagggcagatcacatcncagagatgattacgaaaggcgacactagttacgtttactaaacaaaagttcgaaacctacgtacccgtagaaccggtcgggacccgggggacaaccggttcggtaccccggttaggtttaaacttacccgttgggttccgaccccgaaacggccgaaacggcccgaacggcccgaaccccgttcgggaccccctaaacgtttacttttaaccgtttttccgttttaaccggg

SEQ ID NO: 413157 - DNA, 556 bp, Homo sapiens
  misc_feature: GZ8MTXP02HP3K6.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccggggggtccttagactctcctgtgcagcctctggcatcactttcagtgacgcctggatgagctgggtcccgcaggctccgaggggagggctgggagtgggtggcgttataaaggcgaggctgctggtcggacaacagactacgctgccacccggtgaagggcagtactacacccatctccagagatgattcgaaggagacactagttgtttactaactaaatagaactacgcctaggactcggaccggggacacgtcgtcgtgtacttacgtgtcgaccagcgacgcacgaacccgacgtacggacccaactttacttacttttctttacgg

SEQ ID NO: 413158 - DNA, 510 bp, Homo sapiens
  misc_feature: GZ8MTXP02FTFKX.11.6.A06.1.454.CMB.2.raw
  modified_base (399)..(399): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttgggtaaagccggggggtcccttagactctcctgtgcagcctctggcatcactttcagtgacgcctggatgagctgggtccgccaggctccgaggggaaggggctggagtgggttggccgtattaaaagcgagctgcgtggtggacaagagactacgctgcaccgtgaaggcagatcacatctcaganatgatcaagagcacagtgttacaacaaatgaacagcctgacgtggccggggacacgtgtccgtgttacttactggtcgccagcagcacgcactcgcactactatttctttg

SEQ ID NO: 413159 - DNA, 529 bp, Homo sapiens
  misc_feature: GZ8MTXP02JFKOZ.11.6.A06.1.454.CMB.2.raw
  modified_base (358)..(358): a, c, t, g, unknown or other
  modified_base (410)..(410): a, c, t, g, unknown or other
  modified_base (454)..(454): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctggggaggcttggtaaagccggggggtccttagactctcctgtgcagcctctggcatcactttcagtgacgcctggatgagctgggtccgccaggctccgaggggaaggggctggagtgggttggccgtattaaaagcgaggctgctggtggacaacngactacgctgcaccgtgaagggcagatcacatctccagagatgattcaaggngcacgagtgtttactacaaatgaacagcctgactggccgggacncgtcgcgtagtacttacgtgtcgacacgcacgcacgccgtaccgtacggacctacttactttactttacgtttcg

SEQ ID NO: 413160 - DNA, 666 bp, Homo sapiens
  misc_feature: GZ8MTXP02JJDL8.11.6.A06.1.454.CMB.2.raw
  modified_base (401)..(401): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttagggtaaaggccggggggtcccttagactctcctgtgcagcctctggtatcactttcagtgacgcctggatgagcgtcgggtcccgccgaggcctccggaggggaacggggcgtgggaggtggggttggaccgtaagttaaaaggcggaggctggcgtgggtaggaccaacgagactacgctcgccncccggtgaacgggcagtactcacctatcctaccagagatgtaacgttacgaaggacgactaacgtagtttacgtttaactaaactaaaagttacgaaaccgacggtacccgttacggaaccgtcgggacccgggggtaactaccggtcggtacccgtttagtaacgtttacgttcggccgaccgacgaccgacggaccacggacccgtaaccgtcggtaaccccttaatttactttaacgttttccgtttacggtttaaccccgg

SEQ ID NO: 413161 - DNA, 519 bp, Homo sapiens
  misc_feature: GZ8MTXP02IJU52.11.6.A06.1.454.CMB.2.raw
  modified_base (249)..(249): a, c, t, g, unknown or other
  modified_base (304)..(304): a, c, t, g, unknown or other
  modified_base (328)..(328): a, c, t, g, unknown or other
  modified_base (334)..(334): a, c, t, g, unknown or other
  modified_base (376)..(376): a, c, t, g, unknown or other
  modified_base (381)..(381): a, c, t, g, unknown or other
  modified_base (397)..(397): a, c, t, g, unknown or other
  modified_base (423)..(423): a, c, t, g, unknown or other
  modified_base (454)..(454): a, c, t, g, unknown or other
tcagcgagagataccacgaccggtgctcgatttagatctactgacaggggggagaggagcccagccttgggattcccaagtgttttcattcagtgatcaggactgaacacagaggctcaccatggagtttgggctgagctggattttccttgctgctattttaaaaggtgtccagtgtgaggtgcatctggtggagtcgtgggggaggcttggaaagccgggggtccttagactctcctgtgcagcctntggcatcactttcagtgacgctggatgagctggtccgcaggctcgaggggaggcnggagtggtgcgtataaagcgagcngctggngacacagactacgctgcaccgtgaagggcagattcaccatcnccagngatgattacgaaggancacgagttgtttacaacaaatgaacngacctgactggaccgggacattggaccgttntacttgtgtcgcagcgacgctacgccgtaccgtcgtacctacgtttactttacgtttcgtttacg

SEQ ID NO: 413162 - DNA, 528 bp, Homo sapiens
  misc_feature: GZ8MTXP02IJ5LH.11.6.A06.1.454.CMB.2.raw
tcagcgagagataccacgaccggtgctcgatttagatctactgacagggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtggggaggcttggtaaaggccgggggtccttagactctcctgtgcagcctctggcatcactttcagtgacgcctggatgagctgggtccgccaggctccgaggggaagggctggagtgggtggccgtataaagcgaggctgctgggtcgggacaacgagactacgctgcacccgtgaagggcagattcaccatctccagagacaacgaccaagaattcactgttctagacaaatgaacagcctagagagacgaggatacggactatttactattgtgcgcgatcgaacagaaaagcggtagaccgtagtcggggttggtttgagttgg

SEQ ID NO: 413163 - DNA, 567 bp, Homo sapiens
  misc_feature: GZ8MTXP02HC0A8.11.6.A06.1.454.CMB.2.raw
  modified_base (297)..(297): a, c, t, g, unknown or other
  modified_base (344)..(344): a, c, t, g, unknown or other
  modified_base (453)..(453): a, c, t, g, unknown or other
  modified_base (492)..(492): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttgggtaaaggccggggggtcccttaggactctcctgtgcagcctctggcatctactttcagtgacgcctggatgagcgtggccnccgaggctccgaggggagggctggaggtgggttgaccgtagtaaagngaggctgcgtggtcggacaacagactacgctgccgaccgtggaaacggcagtactccaccatcctaccagagatgtattcgaaggagaccatagttagtttacctaaanaaatacgaacagaccctagaccgtagggacccgggaacncgtcgaccgtgttacttacgtgtcggacagcacgacacgccaccgtacggacctacttattactttacgtttcgg

SEQ ID NO: 413164 - DNA, 519 bp, Homo sapiens
  misc_feature: GZ8MTXP02F6UPL.11.6.A06.1.454.CMB.2.raw
  modified_base (395)..(395): a, c, t, g, unknown or other
tcagcgagagataccacgaccggtgctcgatttagatctactgacaggggggagaggagccccagccatgggattcccaagtgttttcattcagtgatcaggactgaacacagagggctcaccatggagtttgggctgagctggattttccttgctgctattttaaaggtgtccagtgtgaggtgcatctggtggagtctgggggaggcttgggtaaagccggggggtcccttagactcgtcctgtgcagcatctggcatcactttcagtgacgcctggatgagctgggtccgccaggctccgaggggaaggggctggagtgggttgccgtattaaagcgaggctgcctggtggacaacagactacgctgcaccgtgaagggcagatcaccatcncagagatgattacaaggagacacagttgtttactaacaaatagaaacacgcctgacgtcggccggggacacgtcgccgtgttattacgtgtcgccacgcagcagcactcggaccactactttac

SEQ ID NO: 413165 - DNA, 521 bp, Homo sapiens
  misc_feature: GZ8MTXP02HG7GQ.11.6.A06.1.454.CMB.2.raw
  modified_base (393)..(393): a, c, t, g, unknown or other
  modified_base (401)..(401): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctatttaaaggtgtccagtgtgaggtgcatctggtggagtcgtgggggaggcttgggtaaaggccggggggtcccttagactctcctgtgcagcctctggcatcactttcagtgacgcctggatgagctgggtccgccaggctccgaggggaagggctggagtgggttggccgtataaagcgaggctgcgtggtcgggacaacgagactacgctgcaccgtgaagggcagatcacntctcaganatgatcaaggagcacgagtgtttactaacaaatgaacagcctagacgtcggaccggggacacgtcgccgtagttacttacgtgtcgcagcacgcagcactcgaccactatactttcttcg

SEQ ID NO: 413166 - DNA, 552 bp, Homo sapiens
  misc_feature: GZ8MTXP02JWHGU.11.6.A06.1.454.CMB.2.raw
  modified_base (351)..(351): a, c, t, g, unknown or other
  modified_base (437)..(437): a, c, t, g, unknown or other
tcagcgagagataccacgaccggtgctcgatttagatctactgacgaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttggtaaaggccggggggtccttagactctcctgtgcagcctctggcatcactttcagtgacgcctggatgagctggtccgcaggctccgaggggagggctggagtgggtggcgtataaagcgagctgctggtggacangactacgctgcaccgtgaagggcagctcaccatctccagagatgattcgaaaggagacgacagttgtttactaacgaaatgaaacngacctgaacgtggaccggggacacgtggaccgtagttaacgttacgtggtacgaccgaagccaggcaacgccgaacccgttgggacccctagttacttaacctttttactttacg

SEQ ID NO: 413167 - DNA, 602 bp, Homo sapiens
  misc_feature: GZ8MTXP02I1A8J.11.6.A06.1.454.CMB.2.raw
  modified_base (257)..(257): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccggggggtcccttaggactctcctgtgcagcctntggcatcactttcagtgacgcctggatgagcgtgggtccgtcgaggctccgaggggagggctggagtgggtgccgtagtaaaaggcgaggctgcgtggtcggacaacgagactacgctgccgacccgtggaacgggcagtacttccgacctatcctaccagacgatgaattaccgaaagggtacgactacgtagttacgtttaactaaacaagttagaaacgacgaccgtagaccgtacgggacccggggactaccggtcgtcgttacgttacgttacgtggtccgaccgacgacgacgcaacgccgaccgtcggtaccctaacttactttacgtttctttacgg

SEQ ID NO: 413168 - DNA, 518 bp, Homo sapiens
  misc_feature: GZ8MTXP02FQLVT.11.6.A06.1.454.CMB.2.raw
  modified_base (412)..(412): a, c, t, g, unknown or other
tcagcgagagataccacgaccggtgctcgatttagatctactgacagggggagaggagccccagccttgggattcccaagtgttttcattcagtgatcaggactgaacacagagggctcaccatggagtttgggctgagctggattttccttgctgctatttaaaggtgtccagtgtgaggtgcatctggtggagtcgtgggggaggcttgggtaaaggccgggggggtcccttaggactctcctgtgcagcctctggcatcactttcagtgacgcctggatgagctgggtccgccaggctccgaggggaaggggctggagtgggtggccgtataaagcgagctgcgtggtgggacaacagactacgctgcaccgtgaagggcagatcaccatctcagagatgatcaaaggngcacagtgtttacacaaatgaacagctgactggccggggacacgtgccgtgtacttacgtgtcgaccagacagcagcaaccgtcggacctactattactttctttg

SEQ ID NO: 413169 - DNA, 564 bp, Homo sapiens
  misc_feature: GZ8MTXP02JU13T.11.6.A06.1.454.CMB.2.raw
  modified_base (414)..(414): a, c, t, g, unknown or other
  modified_base (420)..(420): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccggggggtcccttagactctcctgtgcagcctctggcatcactttcagtgacgcctggatgagctgggtcccgccgaggcctccgaggggaaggggcgtgggaggttggggttggaccgtaattaaaaggcgaggctgcgtggtcgggacaacagactacgctgccacccgtgaagggcagatcaccatcnccaganatgatacgaaggagacacagttgtttactaacaaatcgaaacacgcctagaccgtcggacccggggacacgtcggccgtggttacttacgtgtcgaccgagccacgcacgccaccgtcggacctactactttactttctttacg

SEQ ID NO: 413170 - DNA, 575 bp, Homo sapiens
  misc_feature: GZ8MTXP02JSD0T.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttgggtaaaggccgggggggtcccttaggactctcctgtgcagcctctggcatcactttcagtgacgcctggatgagctggggtccgccaggctccgaggggaaggggctggaggtgggttggccgttattaaaaggcgaggctggcgtgggtacgggacaacgagactacgctgcgacccgtggaacgggcagattcaccatctccagacgatgattcgaaggagcactgttagtttactaacaaattacgaactacgcctaggacgtcgggcccgggggacacgtcgtcccgtaggttacttacgtgtacgcccgagcacggcaacggccaccgtcggacctactattactttcgtttacg

SEQ ID NO: 413171 - DNA, 572 bp, Homo sapiens
  misc_feature: GZ8MTXP02I60CY.11.6.A06.1.454.CMB.2.raw
  modified_base (365)..(365): a, c, t, g, unknown or other
  modified_base (430)..(430): a, c, t, g, unknown or other
  modified_base (512)..(512): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaggtgtccagtgtgaggtgcatctggtggagtctgggggaggcttggtaaagccggggggtcccttagactctcctgtgcagcctctggcatcactttcagtgacgcctggatgagctgggtccgccaggcctccgaggggaagggctggaggtgggtggccgtaattaaaggcgaggctgacgtggtcgggacaacgngactacgctgccacccgtggaagggcagacttcacctatctaccagacgatagattcgaaagggnacacgtagtttacgttacaaataaagtagaacgacgcctagacgtcgggaccgggactacgtcgtaccgttagttacttcgngtacgaccacgacgacgcacgccgtacgtacgtacctaagttactttacgtttcgttacg

SEQ ID NO: 413172 - DNA, 650 bp, Homo sapiens
  misc_feature: GZ8MTXP02H7L6H.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggtattttccttgctgtctattttaaaaggtgtccagtgtgaggtgcatctggtggagtcgtgggggagcgttagggtaaaggccggggggttccttagactctcctgtgcagcctctggcatctacttcagtgacgcctggatgagcgtggtccgcaggctccgaggggacgggctgggaggtgggtgacgtagtaaaaggcgaggctgcgtggtacggacaacgagactacgcgttagccgaccggtaggaaacgggcaaggtacttaccaaccctaacttccaccgaaggaagacgtgtaaacgttacgaaaggggacaccacgtaaggtttacgttttaacaaaccgtaaaattaggaaaaccctacggtaccgtacggtaaccggtacggggacccggggtaactacggttaccggtaccgtttacgttacgttacgtcggacgaccgagacgacgacgacgaaccgaccgaccgtacctacttactttactttacgtttacg

SEQ ID NO: 413173 - DNA, 545 bp, Homo sapiens
  misc_feature: GZ8MTXP02G53F9.11.6.A06.1.454.CMB.2.raw
  modified_base (296)..(296): a, c, t, g, unknown or other
  modified_base (417)..(417): a, c, t, g, unknown or other
  modified_base (439)..(439): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgcttattttaaaaggtgtccagtgtgaggtgcatctggtggagtcgtgggggaggcttgggtaaaggccggggggtcccttagactctcctgtgcagcctctggcatcactttcagtgacgcctggatgagctgggtccnccaggctccgaggggagggctggagtgggtggcgtataaagcgaggctgctggcgggacacgagactacgctgccaccgtggaaggcagacttcaccatctaccagagatgattcgaaagngacacgtaggttatttaccaanaaattagaaccagaccctaggactcgggccggggactacgtcgacccgttgtacttacgtgtcgaccagccagcacgcacctcggaccattacttatttcctttag

SEQ ID NO: 413174 - DNA, 549 bp, Homo sapiens
  misc_feature: GZ8MTXP02JQ7IH.11.6.A06.1.454.CMB.2.raw
  modified_base (416)..(416): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccggggggtcccttagactctcctgtgcagcctctggcatcactttcagtgacgcctggatgagcgtgggtccgccaggctccgaggggaaggggctgggaggtgggttggccgtaagttaaaagcgaggctgcgtggtgggacaacgagactacgctgccgacccgtggaaacggggcagacttcaccatccnccagagatgattcgaaaggagacactagttagtttacaacaaatgaaacagcctagacgtggaccggggacacgtgccgtgttactacgtgtcgcagcacgcagcaccgtggacctatacttactttctttcg

SEQ ID NO: 413175 - DNA, 585 bp, Homo sapiens
  misc_feature: GZ8MTXP02I3C5Z.11.6.A06.1.454.CMB.2.raw
  modified_base (289)..(289): a, c, t, g, unknown or other
  modified_base (434)..(434): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggtattttccttgctgcttaattttaaaaggtgtccagtgtgaggtgcatctggtggagtcgtgggggaggcgttgggtaaaggccggggggtcccttagactctcctgtgcagcctctggcatctactttcagtgacgcctgatgngcgtggccgccaggctcgaggggagggcgtggaggtgggttggaccgtaagtaaaggcgaggctgcgtggtcggacaacgagactacgctcgccacccgtggaacgggccagacttccaccatcctacagagatgatcgaaaggngtacatgttagtttacaaacaaaatcgaaacagccctagacgtcgggacccggggaaactccgttcgaccgttagttaaacttacgtggtcgaccagccaacgccaacgcccgaaccgtcggtaccctatttatttctttttacgtttcgg

SEQ ID NO: 413176 - DNA, 564 bp, Homo sapiens
  misc_feature: GZ8MTXP02JLV78.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttggtaaaggccggggggtcccttagactctcctgtgcagcctctggcatcactttcagtgacgcctggatgagctgggtccgccaggcctccgaggggaacgggcgtggaggtggggttggaccgtaagttaaaaggcggaggctgcgtggtacggacaacgagactacgctgcaccgtgaaggcagtactcacatctacagagatgatacgaaggagcacgtagttgttactaaacaaattgaaactgaccctgaccgtcggacccggggacacgtcgccgtagttacttacgtcgtacgccaggccaacgccaagcctaaccgcggacctacttattactttcgtttacg

SEQ ID NO: 413177 - DNA, 719 bp, Homo sapiens
  misc_feature: GZ8MTXP02IOQCT.11.6.A06.1.454.CMB.2.raw
  modified_base (295)..(295): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaggtgtccagtgtgaggtgcatctggtggagtcgtgggggagcgttagggtaaaggccggggggtccttaggactctcctgtgcagcctctggcatctactttcagtgacgcctggatgagctgggccnccgaggcctccgaggggagggcgtgggaggtggggtggccgttaagttaaaaggcgaggctggcgtggtacgggacaacgagactacgctcgccaccggtagaacgggcagtacttcaccctatcctaccgagacgatagacttaccgaaaaggacgaccaacgtaggtttacgttttaacctaaacgtaaaaagttcgaaaaccgtacggtaccccgtttaagggacccgttacgggggacccccgggggtaaaccacccggtttacgggacccccggtttaagttaaccgttttaccgtacggggttccgaccccgtaaaaggcccgtaaaacgggcccctaaacgggaacccccgtaaacccgtcggggtaaccccccttaaaagttttcttttaacgtttttttacccgtttaaccgggg

SEQ ID NO: 413178 - DNA, 527 bp, Homo sapiens
  misc_feature: GZ8MTXP02JWFII.11.6.A06.1.454.CMB.2.raw
  modified_base (412)..(412): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttacttgctgctattttaaaaggtgtccagtgtgaggtgcatctggtggagtcgtgggggaggcttgggtaaaggccgggggggtcccttagactctcctgtgcagcctctggcatcactttcagtgacgcctggatgagctgggtcccgccaggctccgaggggaaggggctggagtggggttggccgtattaaaaggcgaggctgcgtggtgggacaacagactacggctgccacccgtgaagggcagattcacatctccagngatgattcgaaggagcacagttgtttactaacaaatgaaacagcctgactggcccggggacacgtgaccgtgtactactgtcgccagcagcagcactgcctactatactttcttg

SEQ ID NO: 413179 - DNA, 618 bp, Homo sapiens
  misc_feature: GZ8MTXP02GYF5O.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttgggtaaaggccggggggtcccttagactctcctgtgcagccctctggcatctactttcagtgacgcctggatgagcgtcgggtcccgccgaggcctccgaggggaggggcgtgggaggtggggttcggaccgtaagttaaaaggcggaggctgcgtgggtacggacaacgagactacggctcgccgacccggtggaacggggcagtactacaccatcctaccgagaacgatgattacgaaaggacgacaacgtagtttacgtttaactaaacaaattacgaaacacgcctaggaacgtcgggaccgggtaccacgtcgcccgttagtacgttaccgtgtaccggccaaggcgaacgccacgtccgaccgtccgacctacgtttatttaccgttttctttaccgg

SEQ ID NO: 413180 - DNA, 544 bp, Homo sapiens
  misc_feature: GZ8MTXP02ISIVW.11.6.A06.1.454.CMB.2.raw
  modified_base (259)..(259): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccgggggggttcccttaggactctcctgtgcagcctntggcatcacttcagtgacgcctggatgagctgggtccgccaggctccgaggggagggctgggagtgggtggccgtaattaaaagcgaggctgcgtggtggacaacagactacgctgcaccgtgaagggcagactcacaatctaccagagatgattcgaaaggagacacagtgtttactaacaaatagaacagcctagactggaccggggacacgtgccgtgttaattacgtgtacgccagccgaagcaacgccaccgtcggaccctattacttacttttctttcg

SEQ ID NO: 413181 - DNA, 577 bp, Homo sapiens
  misc_feature: GZ8MTXP02IYXDS.11.6.A06.1.454.CMB.2.raw
  modified_base (427)..(427): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggattttcctgctgctattttaaaggtgtccagtgtgaggtgcatctggtggagtcgtgggggaggcgttagggtaaaggccgggggggtcccttaggacctctcctgtgcagcctctggcatcactttcagtgacgcctggatgagcgtgggtcccgccgaggctccgaggggaacggggctgggaggtggggttcggaccgtaagttaaaacggcgaggctgcgtgggtcgggacaacgagacctacgctgccaccggtgaacggggcagacttcaccatcncagagatgattcgaaggagcacagttgtttactaacaaatgaaacagacctagtacgtggtaccggggactacgtcgcccgttggttaacttacgtgtcgacacgccagcaggccaaccgtcgacctaacttacttactttactttacgg

SEQ ID NO: 413182 - DNA, 630 bp, Homo sapiens
  misc_feature: GZ8MTXP02GKJ95.11.6.A06.1.454.CMB.2.raw
  modified_base (407)..(407): a, c, t, g, unknown or other
  modified_base (431)..(431): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttgggtaaaggccggggggtccttagactcctcctgtgcagcctctggcatcactttcagtgacgcctggatgagcgtggtccgccaggcctccgaggggagggctgggaggtggggttggaccgtaagtaaaaggcggaggctgcgtggtacgggacaacgagacgtacgctcgccgacccggtaggaacgggnagacttcgacctatcctaccaganagtagtattaccgaaaggacacgactaagttacgttttaacaaactaaaagttagaaaccacgacccgttagaccgtacggggacccgggggaaactaccggtcggtacccggttacgttaaagttccgttggtcgaccgaacgcgacgacgacgaaccgaccgtacggacccctacttatttaacgtttctttaacgg

SEQ ID NO: 413183 - DNA, 621 bp, Homo sapiens
  misc_feature: GZ8MTXP02ICOLY.11.6.A06.1.454.CMB.2.raw
  modified_base (430)..(430): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaggtgtccagtgtgaggtgcatctggtggagtcgtgggggaggtcgttagggtaaaggccggggggtcccttaggactctcctgtgcagcctcgtggcatctactttcagtgacgcctggatgagcgtcgggtccgccaggcctccgaggggaaggggctggggagtggggttggaccgtaagttaaaaggcgaggctggcgtgggtcgggaacaacgagactacgctgccgacccggtgaaacggggcagacttccaccatcnccagagatgatacgaagagcactagttcgtttactaaacaaaattacggaaactaggtcccgtagaccggtcggacccgggggtacacgttcggaccgttagttaacgtttacgcggttacgaccgacggcaacggtcaacggtcccaaccgtccggaccctagtttaacttttaacgttttcctttacgg

SEQ ID NO: 413184 - DNA, 557 bp, Homo sapiens
  misc_feature: GZ8MTXP02G5377.11.6.A06.1.454.CMB.2.raw
  modified_base (359)..(359): a, c, t, g, unknown or other
  modified_base (481)..(481): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgcttaattttaaaaggtgtccagtgtgaggtgcatctggtggagtcgtgggggaggcttgggtaaaggccggggggtcccttagactctcctgtgcagcctctggcatcactttcagtgacgcctggatgagcgtggtccgcaggctcgaggggagggctggagtgggtggacgtagtaaaagcgagctgcgtggcggacaanagactacgctgccacccgtgaacggcagactcacatctcagagatgatcgaaaggacgacacgtagttacgtttacaaacaaatacgaaacacgcccgtagacgtcggaccggggacaccgnggtaccttgtacttacgttgacgcccaagcaacgcacgcctaaccgcggaccctacttattacttttaccgtttcg

SEQ ID NO: 413185 - DNA, 526 bp, Homo sapiens
  misc_feature: GZ8MTXP02JGLU6.11.6.A06.1.454.CMB.2.raw
  modified_base (254)..(254): a, c, t, g, unknown or other
  modified_base (409)..(409): a, c, t, g, unknown or other
  modified_base (419)..(419): a, c, t, g, unknown or other
  modified_base (462)..(462): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctatttaaaggtgtccagtgtgaggtgcatctggtggagtcgtgggggaggcttgggtaaaggccggggggtcccttagactctcctgtgcagcctntggcatcactttcagtgacgcctggatgagcgtgggtccgccaggctccgaggggaggggctgggagtgggttgccgtaattaaaggcgaggctgcgtgggtcgggacacgagactacgctgccaccgtgaagggcagattcacatctccagagntgatcaaggncacagttgttacaacaatgaacagcctgactgggaccgggacncgtagccgtagtacttacgtgtcgccagcagcagccacgtcgacctatacttactttctttacg

SEQ ID NO: 413186 - DNA, 682 bp, Homo sapiens
  misc_feature: GZ8MTXP02JZL3U.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctatttaaaggtgtccagtgtgaggtgcatctggtggagtcgtgggggaggcttgggtaaaggccggggggtccttagactctcctgtgcagcctctggcatcactttcagtgacgcctggatgagcgtgggtcccgccgaggccgtaccgagggggaaggggcgtgggacggtggggttaggtaccggtaagttaaaaggcggaagggcgtaggccgtggggtacggggaaccaaacgaggaacctacgcttcggcccgacccggtaggaaacgggggcaaggactttaccacccagttccctaccaaggacgtatagtaacttacgaaagggacgacaactagttacgtttaccctaaacgaaaattgaaaaccgacgtaccctaggaacccgttcgggaccccgggggacacggttcggacccgttagttacgtttaccgtggtaccgacccaggaccacgaccgaggaaccctaccccgtggaccccttaaaattcgtttaactttttcgttttaacccgg

SEQ ID NO: 413187 - DNA, 630 bp, Homo sapiens
  misc_feature: GZ8MTXP02F6HOF.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgcttattttaaaaggtgtccagtgtgaggtgcatctggtggagtcgtgggggaggcttagggtaaaggccggggggtcccttaggactctcctgtgcagcctctggcatcactttcagtgacgcctggatggagcgtcggggtcccgccgaggcctcccgagggggaacggggcgtggggtaggtggggtttcgggaccggttaaagttaaaaacggcggtaaggtccgtggcgtggggtacggaacaacgagactacgctcgccgacccggtaggaaacgggcagtacttccgaacctactcctaccaagagtatagtaacttacgaaaggacgacaacgtagttacgtttacaaactaaagtacgaacacgtcctagaccgtcggaccgggacacgtcgtccgttagttacttacgtgtcgaccacgcacgcacgccaccgtcggaccctattactttacttttcgtttacg

SEQ ID NO: 413188 - DNA, 532 bp, Homo sapiens
  misc_feature: GZ8MTXP02I78CW.11.6.A06.1.454.CMB.2.raw
  modified_base (419)..(419): a, c, t, g, unknown or other
  modified_base (422)..(422): a, c, t, g, unknown or other
  modified_base (433)..(433): a, c, t, g, unknown or other
  modified_base (443)..(443): a, c, t, g, unknown or other
  modified_base (481)..(481): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccggggggtcccttagactctcctgtgcagcctctggcatcactttcagtgacgcctggatgagcgtgggtccgccgaggcctccgaggggaagggcgtggagtgggtgccgtaattaaaagcgaggctgcgtggtcggacaacgagactacgctgcaccgtgaaggcagatcacatctcagagatgattcaaggancangttgttacaanaaatgaaacngacctgactcggccgggacacgtgccgtgtacttacgngtcgaccagcaacgcaggccaccgcggacctaactacttactttctttacg

SEQ ID NO: 413189 - DNA, 769 bp, Homo sapiens
  misc_feature: GZ8MTXP02HEEJR.11.6.A06.1.454.CMB.2.raw
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttagggtaaagggccggggggtcccttaggacctctcctgtgcagcctctggcatctactttcagtgacgcctggatgagcgtcgggtcccgcgacggcctaccggagggggaacggggcgtaggggaggttggggttcggaccggtttaaagttaaaaacgggcggtaagggccgttagggccggttaggggtaccggggaaaccaaacgacggtaaccgtacgccgttacggcccgtaacccgggtaggaaacggggccaaggtactacccaacctactacctacccgaaagagaattagaagtttacgaaagggacgacgtaaccgtaaggtttacgtttaacctaaaacgtaaaacgttacgaaaacccgtacggtacccgtagggtaacccgtacgggggaccccgggggtaactaaccggttcgggtacccgtttacggtttaacgtttaccggttggttaccggacccgaacggccgaaacgccgaaccggcctaaccccggttcggaaccccttaacgtttactttaaccgtttttcgttttaaccgg

SEQ ID NO: 413190 - DNA, 640 bp, Homo sapiens
  misc_feature: GZ8MTXP02JF186.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttgggtaaaggccggggggtccttaggactctcctgtgcagcctctggcatcactttcagtgacgcctggatgagctgggtccgccgaggcctccgaggggaacggggctgggagtggggttggaccgtaagtaaagcgaggctgcgtggtcggacaacgagactacgctgccgtacccgggtagaaacggggcaaggtactttaccgaacctatcctaccgagacgatgaacttcgaaaagggcacgaaactagggttactttactaaaacaaagttacggaaaacctacgggtacccctgggtaaacctcgggggaacccgggggactaacgtcggtacccgtagttacgtttacgtggtacgaccaaggccacggaccaacggccaaccgttggacccctagtttactttaattttcgtttacgg

SEQ ID NO: 413191 - DNA, 642 bp, Homo sapiens
  misc_feature: GZ8MTXP02HSFYO.11.6.A06.1.454.CMB.2.raw
  modified_base (583)..(583): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggtattttccttgctgcttattttaaaaggtgtccagtgtgaggtgcatctggtggagtcgtgggggaggcgttagggtaaaggccggggggtcccttaggacctctcctgtgcagccctctggcatctactttcagtgacgcctggatgagcgtgggtcccgccgaggcctccggagggggaacggggcgtggggaggttggggttcggaccgttaaagttaaaaggcggaggctggcgtgggacgggaacaacagacctacgctgccgacccgtggaaagggccagctacacccatcctaccagagatgtaattaccgaaaggacgcaacgtaggtttatttacctaaacaaaagttacggaaaccacgtaccccgttagacccgttacggggacccggggtacaacgttcggcccgttagtttacttaccgtggtacnccgacggcacgcaaggccctaccgtacggccctaaatttacttactttttccgtttacg

SEQ ID NO: 413192 - DNA, 624 bp, Homo sapiens
  misc_feature: GZ8MTXP02JDAHW.11.6.A06.1.454.CMB.2.raw
  modified_base (371)..(371): a, c, t, g, unknown or other
  modified_base (384)..(384): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgcttaattttaaaaggtgtccagtgtgaggtgcatctggtggagtcgtgggggaggtcgttgggtaaacggcccgggggggttcccttaggactctcctgtgcagcctctggaatcactttcagtgacgctggatgagcgtggtcccgcaggcctccgagggaggggctggagtgggtggccgtaataaaagcgaggctgctgggtggaccaacngacacgctcgccncccggtgaacgggcagacttcacactctcagacgatgattacgaaggacgacacgtagttgtttaacccaaagtaaaattcggaaacacggtaccttacggaaccgttcggggacccggggtactaaccgtggttacccgtagttaacttaccgtggttacgacccgagaccgaacgccgaacggccctaacccgtcggacccttaaccttatttaacttttccgtttagttaacccggg

SEQ ID NO: 413193 - DNA, 634 bp, Homo sapiens
  misc_feature: GZ8MTXP02JUSD1.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgcttattttaaaaggtgtccagtgtgaggtgcatctggtggagtcgtgggggaggcgttgggtaaaggccggggggtcccttaggactctcctgtgcagcctctggcatctactttcagtgacgcctggatgagcgtgggtcccgcaggcctccgaggggagggctggagtgggtgcgtaataaagcgaggctgcgtggtcgggacaacgagactacgctcgccgacccggtaggaacggggcaagactttccacccactcctaccaggaagatagtaattacgaaagggacgacacgtagttacgtttactaaacaaagtagaaacgacggcctagaccgtacgggacccgggggtactaccggtcgtacccggttagtttaacgttacgttggtccgacccgaggaccgacgccgaaacgcccgtaaacccgtcgggaccccctaatttacgtttaacttttccgttttaaccggg

SEQ ID NO: 413194 - DNA, 607 bp, Homo sapiens
  misc_feature: GZ8MTXP02HZFU4.11.6.A06.1.454.CMB.2.raw
  modified_base (455)..(455): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaagccggggggtcccttagactctcctgtgcagcctctggcatcactttcagtgacgcctggatgagcgtggggtccgccgaggcctccgaagggggaaggggctggggaggtggggttggaccgttaagttaaaaggcgagggctggcgtgggtcgggacaacagactacgctgccgaccgtggaacggggcaagtattcaccctaatcctaccagacgatgtacttacgaaaggngacacgtagtttagtttacctaaacaaaatcgaaacacggcctacggacgtcgggacccgggggaacacgtcggacccggttgttaacgttacgtgtcggccaaggccagcaaggccaccgtcggaccctacgttactttatttccgtttcg

SEQ ID NO: 413195 - DNA, 673 bp, Homo sapiens
  misc_feature: GZ8MTXP02IZPTB.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggtattttccttgctgctattttaaaaggtgtccagtgtgaggtgcatctggtggagtcgtgggggaggcgttgggtaaaggccggggggtcccttaggactctcctgtgcagcctctggcatcactttcagtgacgcctggatgagcgtcgggtccgccaggcctccgaggggaacggggcgtgggacggtggggttggaccgttaagttaaaacggcgaaggctggcgtgggtacgggacaacgagactacgctgccgacccgtggaaacggggtcaagacttcaacctatcctaccagaagagtagattacgaaaggacgactacgtagttgtttaaccaaactaaaagttcgaaaccacgtacccgttacggaccgttacgggacccgggggaactacggttacgtcccggttaagtttaacgtttaccgtggttccggaacccgtagggaccaacggaccaacggttaacccaaacccgttcggaacccttaacgttaacgtttttaactttttccgttttaacgg

SEQ ID NO: 413196 - DNA, 567 bp, Homo sapiens
  misc_feature: GZ8MTXP02HAUF1.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccggggggtcccttagactctcctgtgcagcctctggcatcactttcagtgacgcctggatgagctgggtccgccaggcctccgaggggaaggggctgggagtgggttggccgtaataaagcgaggctgcgtggcgggacaacgagactacgctgccacccggtgaaacgggcagacttcaccctatcctaccgagagatagattacgaaagggcgacacgtagttagtttacctaaacaaaattgaaactagccctaggacgtcgggaccggggtacacgtcgtccgtagttacttacgtgtcgccagcagcacgcaccgtgaccctatacttagtttcttacg

SEQ ID NO: 413197 - DNA, 628 bp, Homo sapiens
  misc_feature: GZ8MTXP02GKGT2.11.6.A06.1.454.CMB.2.raw
  modified_base (319)..(319): a, c, t, g, unknown or other
  modified_base (569)..(569): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagcgtggtagtttccttaggctgacttaagttttaaaaggtgtccagtgtgaggtgcatcgtggtggagtcggtggggggaggtcgttagggtaaacgggcccgggggggttcccttaggactctcctgtgcagcctcgtggcatctactttcagtgacgcctggatgagcgtcgggccnccgaggcctccgagggggaagggcgtgggaggtggggtcggaccgtaagttaaaagcggtaggctgcgtgggtcgggaacaacgagactacgctgccgaccgtaggaagggcagtacttaccacctatcctaccagagatagattacgaaggtacgactaacaggtttctttaaccaaataaattacgaaaaccagtccccgtaagtaccgtggggacccggggactacgtcgtcgttagtactttacgnggtacaccgagccaagcaacgccaaccgtcggacctacttattactttccgtttaacgg

SEQ ID NO: 413198 - DNA, 619 bp, Homo sapiens
  misc_feature: GZ8MTXP02GFET4.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccggggggtcccttagactctcctgtgcagcctctggcatcactttcagtgacgcctggatggagctgggtcccgccaggcctccgaggggaagggctgggaggtggggttggccgtaagttaaaaggcgaggctggcgtgggtcgggacaacgagactacgctgccaccgtgaaagggcagatcaccatctcagagatgatcgaaaggacgacaactagttagtttactaaactaaatacgaaaacaggtaccctaggaaccgtcgggacccgggggtaactaccgtcggtacccggttagttaaacgtttaccgtggtcgaccccgaaggcccaaggcccgaaaggcccctaaccgttcggaccccttaacttactttacttttcgttttaacgg

SEQ ID NO: 413199 - DNA, 647 bp, Homo sapiens
  misc_feature: GZ8MTXP02G4BN3.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccggggggtcccttaggactctcctgtgcagccctcgtggcatctactttcagtcgacgccgtggatgagcgtcgggtcccgccgacggcctccggaagggggaacggggcgtaggggaggttggggttcggtaccggttaaagttaaaaggcggacggtctggcgtgggtcgggaacaacgagacgtacgctcgccgtacccggtaggaaacgggcaagtacttccaacccgtactcctacccgaagacgtaacgttagtaacttaccgaaagggtacgaccgaacgtagttacgtttactaaacgtaaagtacgaaacgacgtaccgtagacgtcgggaccgggactacgtcgacgttagttacttacgtgtccgcacgcgacgcacgccgaccgtcgacctacttatttactttcgtttacg

SEQ ID NO: 413200 - DNA, 691 bp, Homo sapiens
  misc_feature: GZ8MTXP02I8B2O.11.6.A06.1.454.CMB.2.raw
  modified_base (261)..(261): a, c, t, g, unknown or other
  modified_base (415)..(415): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggattttcctgctgctattttaaaggtgtccagtgtgaggtgcatctggtggagtcgtgggggaggtcgttagggtaaacgggccggggggtcccttaggactctcctgtgcagcctntggcatctactttcagtgacgcctggatgagcgtgggccgcaggctccgaggggagggcgtgggaggtgggtggaccgtaagtaaaacggcgaggctggcgtggtcggaacacgagactcgctgccgaccgtggaaacgggcaagtactcaccntcctacgagagtatgatacgaaaggacactaactagtttacgtttaaccaaaactaaaacgttacgaaacgtacggtaccttacggtaacccgtacggggaccccgggggaaactaccggttcgggtaacccgtttaaggtttaaaccgtttacggtacggttaccgaacccgtaaacgggccaaaacggccccgtaaacgggaacccctacccggttaacgggtaacccccttaaagttttaaaacttttcgtttttaccgtttttaaacccggg

SEQ ID NO: 413201 - DNA, 577 bp, Homo sapiens
  misc_feature: GZ8MTXP02JZEUR.11.6.A06.1.454.CMB.2.raw
  modified_base (448)..(448): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttgggtaaacggccggggggggtcccttaggacctctcctgtgcagcctctggcatcactttcagtgacgcctggatgagcgtgggtcccgccaggcctccgaggggaagggctgggaggtggggtggaccgtaagttaaaaggcgaggctgcgtgggtcggacaagagactacgctgccgacccgtggaacgggcagacttccacctatcctaccagagatgattacgaaggancacagttgttactaacaaatagaacacgcctgacgtcggaccggggacaccggtcgaccggtagttacttacgtgtcgccaggcacgcacgccgaccgtcggacctacttactttacttttctttacgg

SEQ ID NO: 413202 - DNA, 626 bp, Homo sapiens
  misc_feature: GZ8MTXP02FTLK2.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttgggtaaaggccggggggtcccttagactctcctgtgcagcctctggcatcactttcagtgacgcctggatgagcgtcgggtccgccgaggctccgaggggagggcgtgggaggtgggtggaccgtaagttaaaagcggaggctggcgtgggtacggaacaacgagactacgctcgccacccggtaggaaacggggcaagtacttaccaacctatcctaccaagaacgagttagaacttacgaaaggacgacaacgtagtttacgtttacaaactaaaagtagaaacctacgaccgtacgaccgtcgggacccggggactaccgtcgtaccgttagtaactttacgtgtcgaccgacgcgaacgctaacggccacccgtcgaccctagtttaactttacgttttctttaccgg

SEQ ID NO: 413203 - DNA, 595 bp, Homo sapiens
  misc_feature: GZ8MTXP02GR20T.11.6.A06.1.454.CMB.2.raw
  modified_base (297)..(297): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttgggtaaaggccggggggtcccttaggactctcctgtgcagcctctggcatctactttcagtgacgcctggatgagctgggccnccaggctccgaggggagggctggaggtgggtggaccgtaattaaaagcgaggctgcgtgggtacggacaacgagactacgctgccacccgtagaacgggcagactcaccatctacagagatgatcgaaaggacgcaactagttacgtttacaaactaaaagttagaaacacgtccctagaccgtacgggacccggggaactacgtcggtcccgttagttacttacgtgtacgacccgagccaacgccaaggccctaacccgtcggtaccctaacgtttactttacttttcgtttacgg

SEQ ID NO: 413204 - DNA, 593 bp, Homo sapiens
  misc_feature: GZ8MTXP02IA0TR.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtgggagtcgtggggggaggtcttgggtaaaggccggggggtcccttaggactctcctgtgcagcctctggcatctactttcagtgacgcctggatgagcgtggccgccaggcctcgaggggagggcgtggaggtgggtggccgtaagtaaagcgaggctgcgtggtcggacaacgagactacgctcgccgacccgtggaacgggcaggacttaccaccattcacccgaagacgtatagtattaccgaaagggagacacgtagttacgttttaccaaactaaaagttcgaaaccacgtccctagaccggtacgggaccggggacacgttcgtccgttagttacttaccgtgtcgaccagcaacgcacgtccaccgtcgacctatactttactttctttacg

SEQ ID NO: 413205 - DNA, 660 bp, Homo sapiens
  misc_feature: GZ8MTXP02G6ZO2.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaggtgtccagtgtgaggtgcatctggtggagtcgtgggggaggcgttagggtaaaggccggggggtcccttagactctcctgtgcagcctctggcatcactttcagtgacgcctggatgagctgggtccgccgaggcctccgagggggaaggggcgtaggggaggtggggttcggaccgtaagttaaaaggcggtaggcgttgcgtgggtacggacaacgagacctacgctcgccgacccgtggaacgggtcagtacttaccacccattccgtacccgaagaacgtatagaactttaccggaaagggtacgacccaagttacgtttacgtttacctaaaacgaaagtttacggaaaactcggccctaaggtacccgtcgggacccggggaactacgttcggacccgtttagtaacgtttaccgtgtcgacccaagtccaacgccaacgccgtaaccgtcggaccctaagtttacttacgtttttcctttaacgg

SEQ ID NO: 413206 - DNA, 609 bp, Homo sapiens
  misc_feature: GZ8MTXP02JWZ30.11.6.A06.1.454.CMB.2.raw
  modified_base (419)..(419): a, c, t, g, unknown or other
tcagcgagagataccacgaccggtgctcgatttagatctactgacagggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaagccggggggtcccttagactctcctgtgcagcctctggcatcactttcagtgacgcctggatgagcgtgggtccgccaggctccaggggaagggctggagtgggttggccgtataaaagcgaggctgcgtggtgggacaacagactacgctgccacccgtgaagggcagacttcaccatctccagagatgattcaaagggancacagttacggtttctaaacaaaatgaaaacacggtaccctaggaaccttacgggaccccgggggaacaccgtacgggtacccgttagttaacgtttaccgtggtacgtacccgaaagcccgaaagcccgaaagcccgaaacccgttcgggacccctaaacgtttaatttaacgtttttccttttacggg

SEQ ID NO: 413207 - DNA, 707 bp, Homo sapiens
  misc_feature: GZ8MTXP02HZRJV.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctgggtggagtcgtgggggaggcttagggtaaagggccggggggtcccttagactctcctgtgcagcctctggcatctactttcagtgacgcctggatgagcgtcgggtcccgccaggccgtccgaagggggagggcgtgggaggtggggttggaccgttaagttaaaaggcggtaggctggcgtgggtacggacaaccgagactacgctcgccgacccggtaggaacgggcagtacttaccaccgtactcctccaaggacgtaagtagtaacttaccggaaaggtacgaccgtactaggtttacgttttaacaaactaaaagttacgaaaacgtcgtacccgttaggaaccggttccggggaccggtaacctcggttaccgtacccgtttaagtttaaccgttacggttacggtaccaccggacgaccgaaccggaccgaaaccggtcccgttaacccgggttccgtaaaccccttaagttttaaacctttttacgttttttccggtttaacccggg

SEQ ID NO: 413208 - DNA, 556 bp, Homo sapiens
  misc_feature: GZ8MTXP02F0NYK.11.6.A06.1.454.CMB.2.raw
  modified_base (474)..(474): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccggggggtcccttagactctcctgtgcagcctctggcatcactttcagtgacgcctggatgagctgggtccgccaggctccgaggggaaggggctgggagtgggttggccgtaagttaaaaggcgaggctgcgtgggtcggacaacagactacgctgccaccgtgaagggcagacttcaccatctcagagatgactcgaaggagcacagtgtttacaacaaatgaacagcctagaccgtggccggggaacncgtggcccgttgtaacttacgtcgtcgcccgagcaacgcgaacgccgtaaccgtcggaccctacttattacttttctttacg

SEQ ID NO: 413209 - DNA, 675 bp, Homo sapiens
  misc_feature: GZ8MTXP02HY9W4.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggtattttcctgctgctattttaaaaggtgtccagtgtgaggtgcatctggtggagtcgtgggggaggcgttagggtaaaggccgggggggtcccttaggacctctcctggtgcacgcctcgtggcatctacttcagtgacgcctggatgagcgtgggccgcaggctccggaggggagggctgggaggtgggtggccgtaagtaaaaggcgaggctggcgtggtcgggacaacgagactacgctcgccacccgggtaggaacggggcaagtacgttaccaaccctactcctaccgaagagaagtgtaagttaccgaaagggacgaccgacgtagttacgtttacctaaactaaaagttacgaaactacggtacccgtaggaccgtacggggacccggggactaccggtacggtacccggttaggtttaacgttacggttacggtccgtaccgacgaccgaacggccgaacggtaacccgtacccggtacgggaccctaaacgtttaacctttacgtttttaccgtttaaccgg

SEQ ID NO: 413210 - DNA, 712 bp, Homo sapiens
  misc_feature: GZ8MTXP02GSPD3.11.6.A06.1.454.CMB.2.raw
  modified_base (573)..(573): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggtatttttccttgctgcttaattttaaaaggtgtccagtgtgaggtgcatcgtggtggagtcggtgggggaggtcgttagggtaaacgggcccggggggtcccttagacctctcctgtgcagcctcgtggcatctactttcgagtcgacgtccgtggatggacgcgtcgggtcccgccgacggcctaccggaagggggaacggggcgtggggtaggttggggttacgggaccgtttaaagttaaaaggcgaaggtctggcggtgggtacgggaacaaacgagactacgctgccgaccgaggaacggcaagactaccacctatcctacagagatagtatacgaaaggacgactacgagtttactttaaccaaaataaaacgtacggaaacacggtaccctacggtaccgacggggacccggggtaaaccnccggttacggtaccgttaagtttaaccgttacgtcggtaccgaccgtaacggaccgaacggaccgaccggtaaccccgtaacccggtaccggtaaccccttaaagttttaccgttttaccgtttttaccggtttaccgg

SEQ ID NO: 413211 - DNA, 721 bp, Homo sapiens
  misc_feature: GZ8MTXP02JG7C0.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttcctgctgcttattttaaaaggtgtccagtgtgaggtgcatctggtggagtcgtgggggaggcgttgggtaaaggccggggggtcccttagactctcctgtgcagcctctggcatctactttcagtgacgcctggatgagctgggtccgcaggctccgagggagggctggagtggtgcgtataaagcgagctgcgtggcggacaacgagacgtacgcgttcgccgtacccggtaggaacggggcaagggtactttaccgaaccctattcccgtcccgaaagggacaagtttagggaaactttaccggaaaagggcgaaccgtaaaccgtaggtttaccgttttaacctaaaacggtaaaacttacgggtaaaacccacgggacccctttaaggggaacccgttccgggggaacccgggggtaacctaacggttcgggtccccgggttatttaaaccggtttaccgtgggttaccggaccccgtaaggtacccgaaacggtcccaaacgggccccgaaacccgttcggggtaccccttaacgtttaacttttaacgttttcccgtttttaacgg

SEQ ID NO: 413212 - DNA, 806 bp, Homo sapiens
  misc_feature: GZ8MTXP02IOOVY.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgcttaattttaaaaggtgtccagtgtgaggtgcatctggtggagtcgtgggggaggcgttgggtaaaggccgggggtcccttagactctcctgtgcagcctctggcatctactttcagtgacgcctggatgagtcgtcgggtccgccaggcctccgagggggaacggggctaggggaggttggggttacgggacccggtttaaagttaaaaacggcggaagggtacctggacgttggggtacggggaaccaaacgacggtaaccttaccggccgttacgcccgtaacccggtagggaaacggggcctaacgggtaacttaccgaaccctaatcccgtacccgtaaggaacgtattaggtaacgtttacccggaaagggtaacgaccgtaaacgtaggttttaccgttttaacctaaaacctaaaagttacgaaaacctcggtaaccccgttacggaaccggttaccggggacccgggggtaaacctccggttaccggacccggtttagtttaaacgtttacccgtttagggtccgaccccgtaaggacccgaaacggtccgtaaaccgggaacccgtaaaccccggttccgggtaaaccccctttaaacgttttacgtttttaaaacccttttttccggttttaaaccgg

SEQ ID NO: 413213 - DNA, 586 bp, Homo sapiens
  misc_feature: GZ8MTXP02G5985.11.6.A06.1.454.CMB.2.raw
  modified_base (255)..(255): a, c, t, g, unknown or other
  modified_base (390)..(390): a, c, t, g, unknown or other
  modified_base (398)..(398): a, c, t, g, unknown or other
  modified_base (404)..(404): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctatttaaaaggtgtccagtgtgaggtgcatctggtggagtcgtgggggaggcttgggtaaaggccggggggtcccttagactctcctgtgcagcctntggcatcactttcagtgacgcctggatgagctgggcccgcaggctccgaggggagggctgggagtggggttggacgtagttaaagcgaggctgcgtggtcgggacaacagactacgctgcgaccgtgaaggcagntcacatcnccaganatgaattcgaaaggagacacgtagttacgtttacaaacgtaaaattcgaaaactacggtaccctaggaaccgtcgggacccgggggaactacgtcggtacccgttagttaacttacgtcgtcgaccacgcgaacggccaaggccaccgtacggaccctacttattaacgttttcctttacgg

SEQ ID NO: 413214 - DNA, 628 bp, Homo sapiens
  misc_feature: GZ8MTXP02GCTGU.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgcttattttaaaaggtgtccagtgtgaggtgcatctggtggagtcgtgggggaggcgttgggtaaaggcccgggggggttcccttaggactctcctgtgcagcctctggcatcactttcagtgacgcctggatgagcgtgggtcccgccgaggctaccgaggggaacggggctgggaggtggggttggaccgttaattaaaacggcggaaggctggcgtgggtcgggacaacgagactacgctgccaccgtggaagggcagtactcacctatctaccagagtatgtatacgaaggagacaacgtagttagttaccaaataaaatcgaaacacgcctagacgtacgggaccggggaactacgtcgtacccgttagttaacgtttacgtgtacgccgaaacgccgaaacgccgaacgaaccgtaaacccgtcggtaaccccttaaacgtttatttaacttttccgttttaacgg

SEQ ID NO: 413215 - DNA, 694 bp, Homo sapiens
  misc_feature: GZ8MTXP02H1Q18.11.6.A06.1.454.CMB.2.raw
  modified_base (255)..(255): a, c, t, g, unknown or other
  modified_base (261)..(261): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttagggtaaacggccggggggtccttaggactctccgtgtgcncgcctntggcatctactttcaggtcgacgcgtggatgacgcgtcggtccgcgacggctaccggaggggacgggcgtgggaggtggggttagaccgttaagtaaaggcggaggcgtggcgtagggtacggaaccaacgacgtacgtacgcgtcgccgaccgggtagaacgggtcaagtactaccacgtactcctacaagagtactagtaagttacgaagggtaacaccgtaagtaacggtttctttaaaccgtaaactaaaacgttacggaaaaccctcgggtaccccgtagggtaacccggttccggggaaccccgggggtaactacccgggtacggttaccgttaagtttactttaaccggttgaccacccgagaccgacgtaccacgaacccgtaacccgtcggaccctttaatttactttacgttttccgtaccgg

SEQ ID NO: 413216 - DNA, 682 bp, Homo sapiens
  misc_feature: GZ8MTXP02IJ3D7.11.6.A06.1.454.CMB.2.raw
  modified_base (463)..(463): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttggtaaacggccgggggtccttagactctcctgtgcagcctctggcatctactttcagtcgacgcctggatgagcgtcgggtcccgccgaggccgtccggaagggggaacggggcgtggggagggttggggtttacgggaccgtttaaagttaaaaacggcggaagggccgtggccgtaggggtacgggaacaaacgacgactacggctcgccgaccggtagaacgggcagactcacccatccaccaganactagagttacaagggaacgactacgtaaggtttacgtttaacctaaactaaaacgtttacgaaacgtacggtacccgttaggaaccggttccggggaaccccgggggaactaccggtcggtacccgttagtttacttaccgttggtccgaccgacgaccgacgacaacggcctaacccgtcggtaccctaactttacgtttactttttaccgtttcgg

SEQ ID NO: 413217 - DNA, 690 bp, Homo sapiens
  misc_feature: GZ8MTXP02JPEYB.11.6.A06.1.454.CMB.2.raw
  modified_base (265)..(265): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtaaggtgcatctggtggagtcgtgggggaggcgttagggtaaacggcccgggggggttcccttaggacctctcctgtgcagcctntggcatcactttcagtgacgcctggatgagcgtcgggtccgccgaggccgtccggaggggaggggcgtgggaggtgggtggaccgtaagttaaaagcgaggctggcgtgggtggaaccaacgagacctacgctcgcacccggtggaaggccagtactcaacctgtacctccgaagagtatgtaattacgaaaggacgtaaccagtacgttacgtttaaacctaaactaaaagtcgaaacgacgaccgttacggaaccgttcgggaaccccgggggacaccggttacggtaccgtttaacgttaacgtttaacgttacggtcgtacccgaaacgggcctaaacggcccgtaaaaccgggcctaaaccccggtcggtaaccccctaatttaccttttaacgtttttcgtttaacggtttaccccggg

SEQ ID NO: 413218 - DNA, 731 bp, Homo sapiens
  misc_feature: GZ8MTXP02GLI2I.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggtattttccttgctgcttaattttaaaaggtgtccagtgtgaggtgcatctggtggagtcggtgggggaggtcgttagggtaaacgggtcccggggggttcccttaggtaccttccgttccgttggtcgccacgtcccttcgtcggctacttcctactttcgagttggaccggtcctggatggacggtcgtcggggtcccgccgacggccgtccggagggggaacggggcggtggggtaggttggggttacggtaccgttaaagttaaaacggcggagggtcgtggcggttgggtacgggaacaacgacggaacctacgctcggcccgaccggtaggaacgggacagtacttaccaccctacttcgtaccgaagacgtatagtacttacggaaaggtcgactaacgtacgttttacgtttaaacctaaaacctaaagttacgaaaccgaccgtaccgttacggaccggtcggggaacccggggtactacggtcggtacccgttagtttaacttacgttcgacgacccagcgtaacgcctaaccggcctaccggcgtaccctaatttacgtttacttttacgtttacgg

SEQ ID NO: 413219 - DNA, 777 bp, Homo sapiens
  misc_feature: GZ8MTXP02I0B2V.11.6.A06.1.454.CMB.2.raw
  modified_base (570)..(570): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggtattttctttgctgcttaattttaaaaggtgtccagtgtgaggtgcatctggtggagtcgtgggggaggtcgttagggtaaagggccggggggtcccttagactctcctgtgcagccctctggcatctactttcagtgaccgcctaggatggagtcgtcggggtacccgccgaggccgtacccggaagggggtaacggggccgtaggggtacgggttgggggtttacgggacccggtttaaaaagtttaaaaacggccggtaaggggtccgttggtccgtggggtaacccggggaacaaaacgtaacggaaccttacggcccttagggacccgtaaccccggtagggaaacgggggacctaaggtaactttccaaaccctacttcctaacccgaagaacgtaagtagtaatttacgaaacgggtanaccgtaacgtaggtttacgtttaactaaacaaaagttacgaaactacgacctacggaacgtcggggacccggggaactacgtcggtaccgttagtttaaacgtccgttggtacggacccgtaaacgccgaacggacaacccggaaccgaaccccgttacggtaccccctaaagtttactttttaacctttttacgtttttaacccgg

SEQ ID NO: 413220 - DNA, 564 bp, Homo sapiens
  misc_feature: GZ8MTXP02IMVNG.11.6.A06.1.454.CMB.2.raw
  modified_base (445)..(445): a, c, t, g, unknown or other
  modified_base (468)..(468): a, c, t, g, unknown or other
  modified_base (514)..(514): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccggggggtcccttaggactctcctgtgcagcctctggcatcactttcagtgacgcctggatgagctggggtccgccaggcctccgaggggaaggggctgggaggtggggttggccgtaataaaaggcgaggctggctgggtgggacaacgagactacgctcgccacccggtgaaacggggcaagactcaacccatctccagagatgattcgaaaggcgcacngttgttactaaacaaatgaaacnggaccctagaccgtggcccggggacacgtgcccgtgtaacttacgngtacgccagcacggcagcacccgtggccctaatacttactttcgtttacg

SEQ ID NO: 413221 - DNA, 514 bp, Homo sapiens
  misc_feature: GZ8MTXP02FPKUE.11.6.A06.1.454.CMB.2.raw
tcagcgagagataccacgaccggtgctcgatttagatctactgacagggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttggtaaaggccggggggtcccttagactctcctgtgcagcctctggcatcactttcagtgacgcctggatgagctgggtccgccaggctccaggggaagggctggagtgggtggccgtataaagcgaggctgctggtggacacagactacgctgcaccgtgaagggcagattcaccatctccagagatgattcaaaggagcacagttgtttacaacaaatgaaacagcctagactggaccgggggacacgtagccgtagtacttactgtcgcagcagcagcacctgccactatactttctttcg

SEQ ID NO: 413222 - DNA, 524 bp, Homo sapiens
  misc_feature: GZ8MTXP02FO5LB.11.6.A06.1.454.CMB.2.raw
  modified_base (342)..(342): a, c, t, g, unknown or other
  modified_base (349)..(349): a, c, t, g, unknown or other
  modified_base (401)..(401): a, c, t, g, unknown or other
  modified_base (416)..(416): a, c, t, g, unknown or other
  modified_base (465)..(465): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagcgtggagtttcctgctgctatttaaaggtgtccagtgtgaggtgcatctggtggagtcgtgggggaggcttgggtaaaggccgggggggtcccttaggactctcctgtgcagcctctggcatcactttcagtgacgctggatgagctggtccgccaggctcgagggaggctggagtggtggcgtataaagcgagctgctggnggacaanagactacgctgcaccgtgaaggcagatcacatctacagagatgatacaggancacagttgttacaanaaatgaacacgctgaactggccgggacacgtcgaccgtgtactttacgngtcgacacgcacgcgtacgaaccgtacgtacgacctattacgtttactttacgtttacg

SEQ ID NO: 413223 - DNA, 744 bp, Homo sapiens
  misc_feature: GZ8MTXP02JJLDK.11.6.A06.1.454.CMB.2.raw
  modified_base (304)..(304): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgcttaagttttaaaggtgtccagtgtgaggtgctatcgtggtggagtcggtgggggaggtcgttagggtaaacgggtcccggggggttaccttaggactcctcctgtgcacgtcctcgtggcatctacttcgagtcgaccgcgtaggntggacgtcggtcgggtcccgcgacggccgtaccgggaaggggacggggcgtaggggtaggttggggtcgggtaaccgttaaaagtaaaacggcggtacggtcgtggcggttggggaccgggaaccaaacgacgtaaccgtaccgcgttaccggcccgtaacccgggtaggggaaacgggaccgtaagtacctttacccaacctaacgtccctaaccgaaggaagtagttaggtaacttacggaaagggtacgaaccgtacgtagtttacggtttaaacctaaaacgtaaacgttaacgaacgtaccggtaccgttacggaaccggtccggggaacccggggactaccgtcgtaccgttagttacttacgtggtaccgacgacgcgaacgcgaacgcccgtaccgtacggtacccttaagttactttacgtttcgttaccg

SEQ ID NO: 413224 - DNA, 658 bp, Homo sapiens
  misc_feature: GZ8MTXP02JDC6D.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggagcttggtaaaggccgggggtcccttagactctcctgtgcagcctctggcatctactttcagtgacgccgtggatgagcgtgggtcccgccgaggcctccgaggggaaggggctgggaggttgggtggccgttaagttaaaaggcgaggctgcgtggtacggacaacgagactacgctcgcgaccgtgaacgggcagacttaccactaactcctaccgagacgaagttcggaactttaccggaaaggtacgaccgtacctaaggtttacgtttaaccttaaagaaaacgttacgaaacgtacgtaccttacggaccgttaccgggaccggggactacgtcggtacccgttaggtaactttacgtaggttcgacccgtaagcccgaacggaccacggtaacccaaccggtacggtaccctaaccgtttatttacctttttcgttttaaccgg

SEQ ID NO: 413225 - DNA, 571 bp, Homo sapiens
  misc_feature: GZ8MTXP02GQQSV.11.6.A06.1.454.CMB.2.raw
  modified_base (430)..(430): a, c, t, g, unknown or other
  modified_base (445)..(445): a, c, t, g, unknown or other
  modified_base (453)..(453): a, c, t, g, unknown or other
  modified_base (474)..(474): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccggggggtccttaggactctcctgtgcagcctctggcatctactttcagtgacgcctggatgagcgtgggtcccgccgaggctccggaaggggaaggggcgtgggaggtggggttggaccgtaagttaaaacggcgaggctggcgtgggtacgggacaacagactacgctggccaccggtggaacgggcagattccactatctaccngagatgatcgaaggncacagttntttacaacaaatgaacagccngactcggaccgggacacgtcgccgtgtaacttacgtgtcgaccagccaagcacgccgaaccgtcggcctaacgtttactttacgttttactttacgg

SEQ ID NO: 413226 - DNA, 519 bp, Homo sapiens
  misc_feature: GZ8MTXP02I84J7.11.6.A06.1.454.CMB.2.raw
  modified_base (336)..(336): a, c, t, g, unknown or other
  modified_base (340)..(340): a, c, t, g, unknown or other
  modified_base (421)..(421): a, c, t, g, unknown or other
  modified_base (501)..(501): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgctatttaaaaggtgtccagtgtgaggtgcatctggtggagtcgtggggaggcttgggtaaagccggggggtccttagactctcctgtgcagcctctggcatcactttcagtgacgcctggatgagctgggtccgccaggctccgaggggaagggctggagtgggtgcgtaataaaagngagntgctggtggacaacagactacgctgccacccgtgaaacgggcaagtatcaaccatcgtacagagatgattcgaagagcaangtattactaacaaatgaacagctagactggccggggacacgttgccgtagtatacgtgtcgaccagcagtccagccacgngacctatactatttcttg

SEQ ID NO: 413227 - DNA, 602 bp, Homo sapiens
  misc_feature: GZ8MTXP02JINCY.11.6.A06.1.454.CMB.2.raw
  modified_base (402)..(402): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttgggtaaaggccggggggtcccttagactctcctgtgcagcctctggcatcactttcagtgacgcctggatgagctgggtccgcaggctcgaggggagggctggagtggttggctgtattaaagcgagctgcgtggtggacaacagactacgctcgccaccggtgaacggcagactcaccatctacagantagattcgaaggcgacaacgtagttcgtttacctaataaagttcgaaacgagcccgtaggaccgtcgggacccggggtacaccgtcgtacccgttagttactttaccgtcgtcggaccctagaccgacggtaccgaacgaccccgtaaacccgttcgggaccccttaaaaccggttttacgtttaactttttttacccgg

SEQ ID NO: 413228 - DNA, 662 bp, Homo sapiens
  misc_feature: GZ8MTXP02FSN8O.11.6.A06.1.454.CMB.2.raw
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaggtgtccagtgtgaggtgcatctggtggagtcgtgggggaggcgttagggtaaaggccggggggtccttagactctcctgtgcagcctctggcatcactttcagtgacgcctggatgagcgtgggtccgcaggcctccgaggggaggggctgggaggtggggttcggaccgttaagttaaaagcggaaggctaggcgtgggtcggggaacaacgagtacctacggacttcggccgacccggtaggaaacggggccaagtactttaccaccctactcgtacccgaagaaggatgacttacgaaagggacgacaacgtaggtttacgttttaaccgaaactaaaagtaggaaaaccacggtaccccttaggaaaccgtcggggaccccgggggtaactaaccgtcggtcccggttaggtttaactttaccggtggtccgacccaggccaggcaacgcctaaccgtcggacctaactttattaacttttctttacgg

SEQ ID NO: 413229 - DNA, 561 bp, Homo sapiens
  misc_feature: GZ8MTXP02JVP8E.11.6.A06.1.454.CMB.2.raw
  modified_base (445)..(445): a, c, t, g, unknown or other
  modified_base (513)..(513): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtggggggaggcgttgggtaaaggcccgggggggtcccttaggactctcctgtgcagcctctggcatcactttcagtgacgctggatgagctgggtcccgcgaggctccgaggggaaggggctgggaggtggggttggaccgttaagttaaaacggcgaggctggcgtgggacgggacaagagacctacgctgccacccgtggaacggcagacttcacatcctacagagatgattacgaaggancacgagttgttacaaacaagtcgaacagcctagacgtcggccggggacacgtgtccgtgtaacttcgngtacgccagccagcgagtccacgtcgacctatacttactttctttacg

SEQ ID NO: 413230 - DNA, 819 bp, Homo sapiens
  misc_feature: GZ8MTXP02H1C1L.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttcctgctgctattttaaaaggtgtccagtgtgaggtgcatctggtggagtcgtgggggaggcttgggtaaaggccggggggtccttagactctcctgtgcagcctctggcatcactttcagtgacgcctggatggagcgtgggtcccgcgaggcctccgagggggaagggcgtaggggaggttggggtttaggggaccgtttaagtttaaaaacgggcggtaacgggccttaggccggttaggggtaccggggaaccaaaaccgtacggaaccgttacggaccgttacgggcccgtaacccccgggttaggggaaaccgggggcctaagggtaacctttacccgaaaccccgtacgtttaccccacccggaaaggtaacggtaaacgtggtaaacgtttaccgaaaggggtacgaccgtaaccgtaaggtttacgttttaacgtaaaacctaaaagttacggaaaactacggacccgttacggaccggttaacgggccccgggggtaactaacccgttcgggtaaaccccggtttagtttaaaccgtttaaccgtttgggtaccgacccggtaacggacccgaaacgtcccgaaaaccgggtcccaacccggttaccggggtaacccctaacgttttaaacccgtttatttttttaaccccgtttacgggg

SEQ ID NO: 413231 - DNA, 603 bp, Homo sapiens
  misc_feature: GZ8MTXP02I0JJW.11.6.A06.1.454.CMB.2.raw
  modified_base (361)..(361): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtctgggggaggcttgggtaaagccggggggtcccttagactctcctgtgcagcctctggcatcactttcagtgacgcctggatgagctgggtccgccaggctccaggggaaggggctggagtgggttggccgtattaaaagcgaggctgctggtgggacaaanagactacgctacgccgacccggtaggaaacgggcaagtaacttaccaacctaactcctaccaagaagatagaacttacgaaaggaagacaacgtagttagtttacttaaactaaaataagtaaacaacgacctacgacgtacggaccggggacgacgtcgtacgtacgttacttacgtagtcgacgacgacgacgacgacgaaccgaccgtacgtaccacttaactttacttttactttacg

SEQ ID NO: 413232 - DNA, 611 bp, Homo sapiens
  misc_feature: GZ8MTXP02H40FO.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggtattttccttgctgctaattttaaaaggtgtccagtgtgaggtgcatcgtggtggaggtcgtgggggaggcgttagggtaaaaggccggggggtcccttaggacctctccgtggtgcagtcctcgtggcatctactttcagtcgacgcctggatgagcgtgggtccgcgaggctccgaggggacgggcgtgggaggtgggttaggaccgtaagtaaaaggcgaggctggcgtgggtcggacaacgagactacgctcgcgaccgtgaacgggcagctacacctatcctcagagactgattacgaaaggacgacacgtaagttcgtttaactaacgtaaaattcgaaaacgacgtaccgtagaccgtcgggacccgggactacgtcgtacccgttagttacttacgtgtcgaccgacgacgacgaccacgccgaccgtcggaccctagtttactttacgttttcttcgg

SEQ ID NO: 413233 - DNA, 635 bp, Homo sapiens
  misc_feature: GZ8MTXP02F1YOI.11.6.A06.1.454.CMB.2.raw
  modified_base (372)..(372): a, c, t, g, unknown or other
  modified_base (387)..(387): a, c, t, g, unknown or other
  modified_base (390)..(390): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcttggtaaaggccgggggggtccttagactctcctgtgcagcctctggcatctactttcagtgacgctggatgagctggccgccaggctcgaggggagggctggagtgggtggccgtaataaagcgagctgctggtggacaacagactacgctgcaccggngaagggcagatcacntcncagagatagattcgaaaggacgactacgagtttagtttacctaaataaaacgtacgaaaaccacggtacccttagaaccggttgggaccccgggggtaactaaccgtcgggtaacccgttacggtaacttttaaccggtggttacggaacccctacggggacccaaacggaccaaacgggcccttaaaccccggcggtacccctaaaaccgttttaacgtttaactttttcggtttttaacccgg

SEQ ID NO: 413234 - DNA, 621 bp, Homo sapiens
  misc_feature: GZ8MTXP02F38IO.11.6.A06.1.454.CMB.2.raw
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatctggtggagtcgtgggggaggcgttgggtaaaggccgggggggtcccttagactctcctgtgcagcctctggcatcactttcagtgacgctggatgagctgggccgccaggctccgaggggacgggctgggagtgggtgaccgtagtaaaaggcgaggctgcgtggtcgggacaacgagactacgctcgccacccggtagaacggggcaggacttccaaccattcccgtaccaaggaagtatagtaaacttcgaaagggacgacgaacgtaggttacgttttacaaacgtaaaagttgaaaaccaggtaccctaggaccgtcggggacccgggggtacaaccggtcgaccggttagttaacgttaccgtggtacgccgagccgaacgccagcccaccgtacgacctaacttacgtttactttacgtttacg

SEQ ID NO: 413235 - DNA, 680 bp, Homo sapiens
  misc_feature: GZ8MTXP02JQKGK.11.6.A06.1.454.CMB.2.raw
tcagcgagagataccacgaccggtgctcgatttagatctactgacagggggggagaggagccccagccttgggattcccaagtgttttcattcagtgatcaggactgaacacagagggctcaccatggagtttgggctgagctggtattttccttgctgcttaattttaaaaggtgtccagtgtgaggtgcatctggtggagtcggtgggggaggtcgttagggtaaacggccggggggtcccttagacctctcctgtgcagcctcgtggcatctactttcagtcgacgccgtggatgacgcgtcgggtcccgccgaggccgtaccgaggggaacggggtcgtgggaggttggggttcggaccgtaaagttaaaacggcgagggtctggcgtggggtacggaacaacgagaccgtacgctacggccgacccggtaggaaacggggcaagtacttaccgaacctactacctaccgaagagtaagttagtaacgttaccgaaaaggacgacctaacgttaggtttacgtttaacaaacgtaaagtacgaaaacacggtaccgtacgaccgtacggggacccgggactaccggtcgtaccgttagttacttacgtcgtccgaccaggaccaacggcctacgcccgtaaccgtcgaccctagtttactttactttcgtttacgg

SEQ ID NO: 413236 - DNA, 649 bp, Homo sapiens
  misc_feature: GZ8MTXP02HP79T.11.6.A06.1.454.CMB.2.raw
  modified_base (260)..(260): a, c, t, g, unknown or other
  modified_base (457)..(457): a, c, t, g, unknown or other
  modified_base (473)..(473): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggtattttccttgctgtcttaattttaaaaggtgtccagtgtgaggtgcatgtggtggagtcgtgggggagcgttagggaaaggccggggggtcctagactctcctgtgcagcctcnggcatctactttcaagtcacgccgtgatgagcgtgggccaccgaggcctccggaaaggggaacgggcgtggggaggttggggtacgggtaccggttaaaagttaaaaacggcggtaaggctaggcggtaggtacgggaacaaacgagactacgcacgcacccgtagaaggcaagtactacaccatccgacaagaagntagtactagaaagganacaactagttacgtttacaaactaaaagtgaaacacgtaccagaacgtcgggacccggggtaactacgtcggtaccgttaagttacgtttacgtcgacggaccaggactaacgggccaacggccccttaacacccgggtactaaaaccgttattttaacgtttttaccgtttacgg

SEQ ID NO: 413237 - DNA, 727 bp, Homo sapiens
  misc_feature: GZ8MTXP02FXJN6.11.6.A06.1.454.CMB.2.raw
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgcttaattttaaaaggtgtccagtgtgaggtgcatctggtggagtcgtgggggagcgttagggtaaaggccggggggtccttagactctcctgtgcagcctctggcatcactttcagtgacgctggatgagcgtcgggtccccgaccgaggccgtacccggaagggggaaacggggcgtaggggtagggttcgggggtttacgggtacccggtttaaaaggttaaaaacggccgggtaagggtccgtggaccggttggggtaccggggaaaccaaacgaacggtaaccgtacggccgtacggcccgaacccgggtagggaaacggggccaaggtacttaccaacctactacctaccgaagagtatagtaacttacggaaagggaacgactaaacgtagtttacgttttaaccaaaacgtaaaagttaggaaaacctacggtacccgttacggaaccggttcggggaccccgggggtaacaccggttcggtaccgttagttacttacgtgtacgaccagcaacgcgaacgccgtaaccgtcggaccctaattactttacgtttctttacgg

SEQ ID NO: 413238 - DNA, 674 bp, Homo sapiens
  misc_feature: GZ8MTXP02GPKY2.11.6.A06.1.454.CMB.2.raw
  modified_base (306)..(306): a, c, t, g, unknown or other
  modified_base (632)..(632): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgcttaattttaaaaggtgtccagtgtgaggtgcatctggtggagtcgtgggggaggtcgttagggtaaacgggccggggggttccttagactctcctgtgcagcctctggctatcactttcagtgacgcgtggatgagcgtcgggtcccnccgacggctaccggaagggggaacggggcgtaggggaggttggggttacggaccggttaaagttaaaacggcggaaggtccgtggacggtgggtaccgggaacaacgacgtaaccgtacgcctcgcccgaccggtaggaaacgggcaacgtacttaccacctactcctaccgaagagtatacgtatacgaaaggtacacactaggttactttaacaaacaaagttacgaactacgtaccaggtaaccgttcggggacccgggaaactccgtcggtacccgttattaacgttaccgtggccgaccgagccgaaacgcaaccggtccnccgtaacggacctaacgtttactttacgttttccgtttacgg

SEQ ID NO: 413239 - DNA, 753 bp, Homo sapiens
  misc_feature: GZ8MTXP02F8I2S.11.6.A06.1.454.CMB.2.raw
  modified_base (281)..(281): a, c, t, g, unknown or other
  modified_base (303)..(303): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaaggtgtccagtgtgaggtgcatcgtggtggagtcgtgggggaggcgttgggtaaaggcccggggggttcccttagactctcctgtgcagcctctggcatcactttcagtgacnccgtggatgagcgtgggtcccncgaggctaccgaagggggaacgggtcgtagggacggttggggttacggaccggttaaagttaaaacggcggaagggtcgtggacgttggggtacgggtaaacaacgacggaccgtaacgcgttcgacccgtaacccggtagggaaacggggcctaagggtaacttcccaaaccgtaactcccgttaccgaaggtaacgtaacgttagtaaacgttacgaaaacggggaagtaccgtaaaccgtagggtttaactttttaaacctaaaaccgtaaaagttacgaaaaccgtaacggtacccgttaacgtaaccggttccggggaacccggggtaactaccggttcgtacccgtttggttaactttaacggtgtaccgcgacggaccgaaggccaacggcccgtaaccgtccgggtaccctaaacgtttactttacttttaccgtttaacgg

SEQ ID NO: 413240 - DNA, 611 bp, Homo sapiens
  misc_feature: GZ8MTXP02HZZJH.11.6.A06.1.454.CMB.2.raw
  modified_base (304)..(304): a, c, t, g, unknown or other
  modified_base (460)..(460): a, c, t, g, unknown or other
tcagcgagagataccacgaccggtgctcgatttagatctactgacgaggggggagaggagccccagccttgggattcccaagtgttttcattcagtgatcaggactgaacacagagggctcaccatggagtttgggctgagctggtattttccttgctgtctaattttaaaaggtgtccagtgtgaggtgcatctggtggagtcgtgggggagtcgttagggtaaaggccgggggtccttagactctcgtgtgcagcctcgtggcatctacttcagtcgacgccgtgatgacgcgtcgggcccncgaggcgtaccgaggggacgggcgtgggaggttgggttacggacgtaagttaaaacggcgaggtacgtgcgtggacggaacaacgagactacgctcgcctaccggtaggaacggtacatacgtacaccatccacaagacatcgtatacgaaggacnctacgtaagttgtttaaaccaaataaacgttagaaacccaggtacctaggaacccggcgggacccgggactaacgtcgtaccgtattagttaccgtgacgaccagccagccagccgtaaccgtcgccctaatttacttacttttcgtaacg

SEQ ID NO: 413241 - DNA, 766 bp, Homo sapiens
  misc_feature: GZ8MTXP02FNXCW.11.6.A06.1.454.CMB.2.raw
tcagcgagagataccacgaccggtgctcgatttagatctactgacaggggggagaggagccccagccttgggattcccaagtgttttcattcagtgatcaggactgaacacagaggctcaccatggagtttgggctgagctggtattttccttgctgcttaatttaaaaggtgtccagtgtgaggtgcatcgtggtggagtcgtgggggaggcgttagggtaaacgggccggggggttcccttagacttctccgtgtgcacgccctctggcatctactttcagtcgacgtcctggatggacgtcgtcgggtccccgccgaggccgtaccggaaggggaacggggcgtaggggaaggggttgggggttacggaccggttaaaagttaaaacggccggtaaaggtcgtaggtcggtaggggtacgggaacctaaaccgaacggtacctacgccgttacgtccccggaaaccccggtagggaaacgggaccaaggttaaccttacccaaaccctaacgttccctaacccgaagggtaataagtacgtaagtaaccggaaagggtaacgtaccgtaagttacggtttacgtttaacccaaataaaacgtagaaaaccgtcgacctacggtaccggtcggggaaccccgggtactaaccggttcgtaccgtttaagtaccgtttacgtcggttcgaccgacggaccgaacgtccgaaccggcctacccgtacggaccctttaacgtttatttaccgttttgtttacccggg

SEQ ID NO: 413242 - DNA, 632 bp, Homo sapiens
  misc_feature: GZ8MTXP02I0A8C.11.6.A06.1.454.CMB.2.raw
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgcttaattttaaaaggtgtccagtgtgaggtgcatcgtgggtggaggtcgtgggggaggcgttagggtaaacggcccgggggggtcccttagacctctccgtgtgcacgcctctggcatctacttcagtcgacgctggatgacgcgtcggtccgcgaggctaccggaggggacgggcgtgggaggtggggttcggaaccgtttaagtaaaaggcggcggacgtggcgttggggaccgggaaccaagacgaccgtacgcgtcgccgaccggtggaaacgggcagtactccactacgtctaccgagagatagtaaacgtcgaaaggacgactaacgtagtttacgttactaaacaagtaacgacaggtcctacgaccggtacgggaccgggactacgtccgtacgtagttagttaccgtggtcgccgacgcacgcgacgtccaacgtcgaccttaacgttctacgtttacgtttcgg

SEQ ID NO: 413243 - DNA, 717 bp, Homo sapiens
  misc_feature: GZ8MTXP02HHBMW.11.6.A06.1.454.CMB.2.raw
tcagcgagagataccacgaccggtgctcgatttagatctactgacagggggggagaggagccccagccttgggattcccaagtgttttcattcagtgatcaggactgaacacagagggctcaccatggagtttgggctgagctggattttcctgctgcttaattttaaaaggtgtccagtgtgaggtgcatctggtggagtcgtgggggagtcgttagggtaaacgggccggggggttacccttaggacctctccgtgtcgcacgtcctcgtggcattcctactttcagtgaccgcgtggatgagcgtcgggtccgccgacggcgtccggagggggaacgggtcgtggggtaggttggggttacgggaccgtttaaaaggttaaaacggcggtaacgggcgttcggtcggttagggtaccggggaaaccaaacgacggtacgttaacgccgttacgacccgtaccccgggtaggaaaacggggtcctaacggtacctttaacccgaccctaaacgtcccgtaacccggaaagtacggattacgattaccgaaaggcgtacacgttatttagttacaaactaagtacgaactacgtaccgtacgaccggtcggacccgggactaccggtgtaccgtagtactacgtgaccgacgacgcgacgtcgacggaaccctacgtaccgtacccgtaactttacgttcgttttaacccgttcgg

SEQ ID NO: 413244 - DNA, 694 bp, Homo sapiens
  misc_feature: GZ8MTXP02F9BND.11.6.A06.1.454.CMB.2.raw
  modified_base (259)..(259): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggattttcctgctgctattttaaaggtgtccagtgtgaggtgcatctggtggagtcgtgggggaggcgttagggtaaaggccgggggggtcccttaggactctcctgtgcagcctntggcatcactttcagtgacgcctggatggagcgtcgggtccgccaggcctaccggaggggaaggggcgtgggaggtggggttggaccgttaagtaaaaggcggtaaggctggcgtgggtcggaacacgagactacgctcgccgacccggtaggaaagggccaagtacttaccgaactactcctaccgagaagatagattacgaaaggacgacgtaacgtaggttacgtttaccaaagtaaaacttacgaaaacgtacggtacctacggtaaccgttcggggacccgggggtaaactccggtacggtacccgggttagtttaaaacgtttcgttaggtcccggaaccgacggtaccgaacgggaccaccggaaccgtaacccggtacgggtaacccctaacgtttaacgttttaaccttttcgtttttaacccggg

SEQ ID NO: 413245 - DNA, 816 bp, Homo sapiens
  misc_feature: GZ8MTXP02JYHCZ.11.6.A06.1.454.CMB.2.raw
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgcttattttaaaaggtgtccagtgtgaggtgcatcgtggtggagtcgtgggggagtcgttgggtaaaggccgggggtcccttagacctctcctgtgcagcctctggcatctactttcagtcgacgcctggatgagtcgtcgggtcccgccgacggccgtccgagggggaaggggcgtggggaggttggggttacgggacccggttaaagttaaaacgggccggtaacgggcgtggcggttaggggacgggaaccaaacgaggaacctacggccgttggccccgacccggtggaaacgggggcaagtacgtttaccaaacccgacttacccgtacccgaagtaacgtaaagtacggtaaatttaccggaaacgggtaacgtaccgtaaacgttacggtttaaccgttttaacctaaaacgtaaaacgttacgaaaaccgtacgggtacccgttaacggaacccgggttacgggggacccccgggggtaactaccggttaccgggtaccccggtttaaggtttaacgttttacccgtgggttacccggtaaccgtaaacggccgtaaaccggacccgaacgggaacccccgttaacccggttccggtaaacccctttaaccgtttaaaaccgtttttctttttacccggtttttaacccggg

SEQ ID NO: 413246 - DNA, 651 bp, Homo sapiens
  misc_feature: GZ8MTXP02IRBC7.11.6.A06.1.454.CMB.2.raw
  modified_base (262)..(262): a, c, t, g, unknown or other
  modified_base (434)..(434): a, c, t, g, unknown or other
  modified_base (475)..(475): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggattttccttgctgctattttaaaggtgtccagtgtgaggtgcatctgggtggagtcggtgggggaggcgttgggtaaagggccggggggttcccttagactctcctgtgcagccctntggcatcactttcagtgacgccgtggatgagcgtgggtccgccaggcctccggaggggaacgggcgtgggagtggggtggccgttaagttaaagcgaggctggcgtgggtggacaacagactacgctgccgtaccggtgaacggacacgtattcgacctatccaccagacgngtacgtatcgaaaggtcacacgaggttttatttaacccaanaaaagttcgaaaccagggtaccccaggtacccgtcgggaccggggaaactccggttacggtcccgggttattttaaacgttccggtggtaccgaaccctagggaccacgaccgaacggttaacccccgtaccggttaccgtaccttaacgttttactttacgtttttcgtttacgg

SEQ ID NO: 413247 - DNA, 761 bp, Homo sapiens
  misc_feature: GZ8MTXP02FVLCI.11.6.A06.1.454.CMB.2.raw
  modified_base (524)..(524): a, c, t, g, unknown or other
tcagcgagagataccacgaccggtgctcgatttagatctactgacagggggggagaggagccccagccttgggattcccaagtgttttcattcagtgatcaggactgaacacagagggctcaccatggagtttgggctgagctggattttcctgctgctattttaaaggtgtccagtgtgaggtgcatctggtggagtcgtgggggaggcttagggtaaaggcccggggggtccttaggactctcctgtgcagcctctggcatcactttcagtgaccgcctggatggagcgtcgggtccccgcgaggcctaccggaagggggtaacggggcgttaggggacggttggggtttacgggaacccggtttaaaagttaaaaacgggcggtaacgggtccgtaggccggtttaggggaccggggaaccctaaacgaaggtacccgttaacggcccttagggccccgtaacccgggtagggaaacggggccaaggtacttacccaaccgtactaccgtaccgaaggaanagttaagtataccgaaagggcactaaacgttgttacgtttacaaacgtaaacgtacgaaactacgggtacctaggtaaccgtaccgggggacccggggtaactacggtccggttacccggttagttaaaaccgtttacgttccggaccgaccgtaacgaccgtacggacctaaccggaaccctacccgttaccggaaacccttagttttaaactttacgtttttccgtttaaccggg

SEQ ID NO: 413248 - DNA, 662 bp, Homo sapiens
  misc_feature: GZ8MTXP02FGUNO.11.6.A06.1.454.CMB.2.raw
  modified_base (261)..(261): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttccttgctgcttattttaaaaggtgtccagtgtgaggtgcatctggtgggagtcgtgggggaggcgttgggtaaaggccggggggtcccttaggactctcctgtgcagcctcnggcatctaactttcagtgacgccgtggatgacgcgtgggtcccgccgaggtcctaccggagggggaacggggcgtggggagggttggggttacgggaccgttaaagttaaaaaggccgggtaggtcgtggcgtgggtacgggacaacgaagactacgcgtacgccacccggtaggaaaggggcaagacttacaaactactacgtaccgaagtacgagttgtaaactaggaaaggacgctaaacgtagttacgtttacgtaaactaaaagtacgaaacgtacggaccgtacgacggttcggacccgggggtacaccgtgtaccgttagttacttacgtggtacgcccagccgaacgcgtacgcccgtacgtcgaacctacgttacttaacgtttcgtttacg

SEQ ID NO: 413249 - DNA, 874 bp, Homo sapiens
  misc_feature: GZ8MTXP02FGPRC.11.6.A06.1.454.CMB.2.raw
tcagcgagagataccacgaccggtgctcgatttagatctactgacagggggggagaggagccccagccttgggattcccaagtgttttcattcagtgatcaggactgaacacagagggctcaccatggagtttgggctgagctggtattttccttgctgcttaattttaaaaggtgtccagtgtgaggtgcatcgtggtggagtcgtgggggaggtcgttagggtaaacgggcccgggggggttcccttaggacttcctcccgtggtcgcacgccctcgtcggcacttcctaacttttcgagtcgaccgtccgtaggatggagcgtcggggtccccgccgaggccgtccggaagggggaacggggcgtggggtaggtggggttacggaccgttaaaagtaaaacggcggtaggtccgtgggttagggtaggaacccaacgacgaaccgtacgtcgtcgaccgtacccggtaggaaacgggtcaacgtacttacccgaaaccctacgttacccgtaacccgtaaaggaacgttaaagtacggtaaacgtttaaccggaaaaggggtactaacccgtaacggttaacggtttaccgtttttaaaccgaaaaccctaaaaaggttaccgtaaaacccgtaaaccggttacccccggttaaggtaaaccccgggttacccgggggaacccccgggggtaaaaccttaacccggttccgggtaccccggttttagtttaaaaccgtttaaccggttcggtaaccgtacccgtaacggacgtaaccggaccgtaacgggacccccgtaaaccggttcggaacccccttaaaggtttaacgttttaaacctttttcccggtttacgtttaaaccccggggg

SEQ ID NO: 413250 - DNA, 669 bp, Homo sapiens
  misc_feature: GZ8MTXP02JZS3F.11.6.A06.1.454.CMB.2.raw
  modified_base (307)..(307): a, c, t, g, unknown or other
  modified_base (468)..(468): a, c, t, g, unknown or other
  modified_base (502)..(502): a, c, t, g, unknown or other
tcagcgagagataccacgaccggtgctcgatttagatctactgacaggggggagaggagccccagccttgggattcccaagtgttttcattcagtgatcaggactgaacacagagggctcaccatggagtttgggctgagctggattttcctgctgctattttaaaggtgtccagtgtgaggtgcatcgtggtggagtcgtgggggaggcgttagggtaaacggcccgggggggtcccttagacctctccgtggtgcacgcctctggcatctacgtttcagtgacgtcctggatgagcgtgggcccncgaggctaccgaggggagggcgtggaggtgggtgaccgtaagtaaagcggaggtctggcgtggggtacgggacaacgagaacctacgcgtcgccgtacccgggtaggaaacgggcaagattacccactacgtctaccgagagtactgacttacgaaggacnccgaacgtagttacgttaactaaacgaaaacgtnaaacgtacgtcccgtagaccgtacggggacccgggactaaccggtcggtaacccggttgttaaccgtttacgtcggtaccggtaccctacggacccgaaacgggacccaccgggaacctaccggtaccgtacccgttaacctttagttttacgtttcgttttaccgg

SEQ ID NO: 413251 - DNA, 511 bp, Homo sapiens
  misc_feature: GZ8MTXP01DEL45.15.49.E05.1.454.CMB.2.raw
  modified_base (201)..(201): a, c, t, g, unknown or other
  modified_base (365)..(365): a, c, t, g, unknown or other
  modified_base (373)..(375): a, c, t, g, unknown or other
  modified_base (377)..(377): a, c, t, g, unknown or other
  modified_base (383)..(383): a, c, t, g, unknown or other
  modified_base (394)..(394): a, c, t, g, unknown or other
  modified_base (408)..(408): a, c, t, g, unknown or other
tcagtctacgtagccacgaccggtgctcgatttagagcgactagcaacacacaaaggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcagaaacctggccagactccagactcgtcatctttgctacatctgccagggccactggcatcccagccacgttccagtggcagtggggtctgggcagagttcattcncacatcannncngcagtntgagtattgtntattattacgtgtntagacagtaataatagactcgtccgtccgtacgtcggtcgaacggacgaaacggaggtaaagtaacgaaacgaacgttagtggtcgtcgcacactcgttcgtc

SEQ ID NO: 413252 - DNA, 506 bp, Homo sapiens
  misc_feature: GZ8MTXP01BH0U9.15.49.E05.1.454.CMB.2.raw
  modified_base (202)..(202): a, c, t, g, unknown or other
  modified_base (303)..(303): a, c, t, g, unknown or other
  modified_base (359)..(359): a, c, t, g, unknown or other
  modified_base (397)..(397): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctcctgcagggccagtcagagtattgacagcaagttagcctggtaccagcagaaacctggccagacctcccagactcgtcatctttgctacntctgccagggccactggcatcccagccacgttcagtggcaggtgggtctgggaacngagttcattctcaccatcagcagcctgcagtctgagtntttgctagtttattactgtcagctagtataatgactggcctcgacgttcggaacaagggaccaaggttagaaatcaaacgacttgtggactgaccacactcgttcgttc

SEQ ID NO: 413253 - DNA, 496 bp, Homo sapiens
  misc_feature: GZ8MTXP01AJIB6.15.49.E05.1.454.CMB.2.raw
  modified_base (203)..(203): a, c, t, g, unknown or other
  modified_base (364)..(364): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaagngccaccctctcctgcagggccagtcagagtattgacagcaagttagcctggtaccagcagaaacctggccagactcccagactcgtcatctttgctacatctgccagggccatggcatcccagccacgttccagtgcagtggtctgggcagagttcattcncaccatcagcagcctgcagtctgaagtatttgctagtttatacgtgtcagcagtatatgactgcctcgcgttcggccaagggaccaaggttggaaactcgaaacgacgttgtggctgcaccatcgttgttcc

SEQ ID NO: 413254 - DNA, 559 bp, Homo sapiens
  misc_feature: GZ8MTXP01B9QZF.15.49.E05.1.454.CMB.2.raw
  modified_base (202)..(202): a, c, t, g, unknown or other
  modified_base (212)..(212): a, c, t, g, unknown or other
  modified_base (390)..(390): a, c, t, g, unknown or other
  modified_base (399)..(399): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccacctgtctgtgtctcgaaggggaaanagccaccctntcctgcagggccagtcagagtatgacagcaagttagcctggaccagcagaaacctggccagacctccagactcgcattctttgctacatctgccagggccagtggcatcccagccacgttcaggtggcaggtggtctgggaacaggagttcattcacacatcagctagcctgcagtcngaaagtttnttgattagtttatacgtgtacagtataagtataagtcgtacgtcggtcccgtacggtaccggtccggaacggaaacgggttaacgtaaagggttacggtaaactaacgaaacggttacgttggtcggcgtaacgaccctaccgttacgttccgttgttcc

SEQ ID NO: 413255 - DNA, 540 bp, Homo sapiens
  misc_feature: GZ8MTXP01CPQP1.15.49.E05.1.454.CMB.2.raw
  modified_base (203)..(203): a, c, t, g, unknown or other
tcagtctacgtagccacgaccggtgctcgatttagagcgactagcaatacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtatgacagcaagttagcctggtaccagcaagaaacctggccagactcccagactcgtcattctttgctacatctgccagggccatggcatcccagccacgttcaggtggcaggtggtactgggaacagtagttcattcctcacctatccagcagcctgcaggttctagtaagtatttgctagtttattacgtgttcagtctaagtataatgacgtgtccctcgacggttcggaacctaaaggggaccgtaaaggttcggaaaactcgaaaacgttacgttggtggcctgaccaccttatcgttcgttc

SEQ ID NO: 413256 - DNA, 497 bp, Homo sapiens
  misc_feature: GZ8MTXP01DW4SD.15.49.E05.1.454.CMB.2.raw
  modified_base (204)..(204): a, c, t, g, unknown or other
  modified_base (365)..(365): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagagtattgacagcaagttagcctggtaccagcagaaacctggccagactccagactcgtcatctttgctacatctgccagggccactggcatcccagccagttccagtggcagtggtctgggcagagttcattcncaccatcagcagcctgcagtctgaagtatttgctagtttattactgtcagtcagtataatgactggcctcgacgttcggaacaagggcctaaggttgaaatcaaaacgacttgtggctgcacatcgttgttc

SEQ ID NO: 413257 - DNA, 506 bp, Homo sapiens
  misc_feature: GZ8MTXP01DB3I0.15.49.E05.1.454.CMB.2.raw
  modified_base (204)..(204): a, c, t, g, unknown or other
  modified_base (349)..(349): a, c, t, g, unknown or other
  modified_base (365)..(365): a, c, t, g, unknown or other
  modified_base (479)..(479): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagngccaccctctcctgcagggccagtcagagtattgacagcaagttagcctggtaccagcagaaacctggccagactcccagactcgtcatctttgctacatctgccagggccactggcatcccagccacgttcagtgcagtggtcngggcagagttcattcncacatcagcagcctgcagtctagaagtatttgctagtttatacgtgtcagtctagtataatgactggcctcgacgttcggaaccaagggaccgaaggttggaaatcgaaaacgngttgtggctggcaccttatcttgttcc

SEQ ID NO: 413258 - DNA, 513 bp, Homo sapiens
  misc_feature: GZ8MTXP01DTL2R.15.49.E05.1.454.CMB.2.raw
  modified_base (372)..(372): a, c, t, g, unknown or other
  modified_base (396)..(396): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaagagccaccctctcctgcagggccagtcagagtattgacagcaagttagcctggaccagcagaaacctggccagactcccagactcgtcattctttgctacatctgccagggccactggcatcccagccacgttcagtgcagtgggtctgggcagtagttcattcacacntcagcagcctgcagtctagaagtntttgctagtttattacgtgtcagtcagtatatgactggtcctcgacggttcggaacgaagggacctaaagggttcggaaatcgaaacgttacttggtggctgacaccatcttgttcc

SEQ ID NO: 413259 - DNA, 492 bp, Homo sapiens
  misc_feature: GZ8MTXP01DZJ2H.15.49.E05.1.454.CMB.2.raw
  modified_base (202)..(202): a, c, t, g, unknown or other
  modified_base (365)..(365): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttgcctggtaccagcagaaacctggccagactccagactcgtcatctttgctacatctgccagggccattggcatcccagccacgttccagtggcagtgggtctgggcagagttcatttcncacatcagcagcctgcagtctgaagtatttgctagttttatactgtcagcagtataatgactggccctcgacgttcggccaagggaccaaaggttgaaatcaaacgattgtggctgcacatcttgtc

SEQ ID NO: 413260 - DNA, 565 bp, Homo sapiens
  misc_feature: GZ8MTXP01DTZQJ.15.49.E05.1.454.CMB.2.raw
  modified_base (203)..(203): a, c, t, g, unknown or other
  modified_base (399)..(399): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccgaggggaaangcccaccctctcctgcagggccagtcagagtatgacagcaagttagcctggaccagcagaaacctggccagacctccagactcgtcatctttgctacatctgccagggccactggcatcccagccacgttcagtggcaggtgggtctggggcagtagttcatttccacaccatcagcagcctgcagtctagaagtntttgcttagtttattacgtgtcagctaagttataagtgtaacgtggccctacggtaccggttcggaacccgtaaaggggttacccaaaggggttacggaaaacttcgaaaacggttacgttgggtgggacctaagggaccctaccttacgttccgttcggtttccc

SEQ ID NO: 413261 - DNA, 520 bp, Homo sapiens
  misc_feature: GZ8MTXP01DHX7I.15.49.E05.1.454.CMB.2.raw
  modified_base (205)..(205): a, c, t, g, unknown or other
  modified_base (306)..(306): a, c, t, g, unknown or other
  modified_base (373)..(373): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgagggggaaangccaccctctcctgcagggccagtcagagtatgacagcaagttagcctggtaccagcagaaacctggccagactcccagactcgtcatctttgctacatcngccagggccactggcatcccagccacgttccagtggcaggtgggtctgggaacagtagttcatttcncaccatcagcagcctgcagtctagaagtatttgctagtttatactgtcagtctagtaataatgactggtccctccggcgttcggaaccgaaggggaccaaagggttggaaaatcgaaaacgcgttgtggctgccacatccgttgtcc

SEQ ID NO: 413262 - DNA, 552 bp, Homo sapiens
  misc_feature: GZ8MTXP01D88MB.15.49.E05.1.454.CMB.2.raw
  modified_base (203)..(203): a, c, t, g, unknown or other
  modified_base (370)..(370): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccacctgtctgtgtctccgaggggaaangccaccctctcctgcagggccagtcagagtattgacagcaagttagcctggtaccagcaagaaacctggaccagactccagactcgtcattctttgctacatctgccagggccagtggcatcccagccacgttcaggtgcaggtgggtctgggcaggtgttcattcncactatcagcagcctgctagtctagagtatttgctagtttatactgttacagtacagttaataatgaacgtcgggtccctaccggtacgttccgggaacccaaagggggttacccaaaggggttacggaaaactcgaaaacggttcgttaggtcgggactgaccaccttattccttgttccc

SEQ ID NO: 413263 - DNA, 551 bp, Homo sapiens
  misc_feature: GZ8MTXP01CZDKV.15.49.E05.1.454.CMB.2.raw
  modified_base (370)..(370): a, c, t, g, unknown or other
  modified_base (400)..(400): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaagagccaccctctcctgcagggccagtcagagtattgacagcaagttagcctggtaccagcagaaacctggccagactcccagactcgtcatctttgctacatctgccagggccactggcatcccagccacgttccaggtggctaggtgggtctgggcagtagttcattcncaccatcagcagcctgcagtctagaagttntttgattagtttattacgtgtctagactaagtatagtgacgtcggtccctaccggtaccggttcggaaccgaaagggaccgtaaagggttagaaacgtacgaaacggttacgttaggtcgggctcggacctaccgttagttccgttcgttc

SEQ ID NO: 413264 - DNA, 517 bp, Homo sapiens
  misc_feature: GZ8MTXP01D9VDQ.15.49.E05.1.454.CMB.2.raw
  modified_base (203)..(203): a, c, t, g, unknown or other
  modified_base (404)..(404): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccacctctcctgcagggccagtcagagtattgacagcaagttagcctggtaccagcagaaacctggccagactccagactcgtcatctttgctacatctgccagggccactggcatcccagccacgttccaggtgcagtgggtactggggaacaggtagtttcatttcctacaccatcagcagcctgctagtctgaagtntttgctagtttatactgtcagtcagtataatgacttggccctcggacgttcggaaccaagggacctaagggttagaaactcaaacgacttggtggctggccacatcttgttcc

SEQ ID NO: 413265 - DNA, 505 bp, Homo sapiens
  misc_feature: GZ8MTXP01DFIHQ.15.49.E05.1.454.CMB.2.raw
  modified_base (204)..(204): a, c, t, g, unknown or other
  modified_base (365)..(365): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagagtattgacagcaagttagcctggaccagcagaaacctggccagactcccagactcgtcatctttgctacatctgccagggccatggcatcccagcacgttccagtgcaggtggtctgggcagtagttcattcncacatcagcagcctgcagtctagaagtatttgctagtttattactgtcaagtcagtataagtgaactggtccttcgacgttcggaaccaagggactaagggagaaatcgaaaacgcttgtggactgcaccatcttcgttc

SEQ ID NO: 413266 - DNA, 632 bp, Homo sapiens
  misc_feature: GZ8MTXP01ECLHM.15.49.E05.1.454.CMB.2.raw
  modified_base (204)..(204): a, c, t, g, unknown or other
  modified_base (389)..(389): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagagtattgacagcaagttagcctggaccagcagaaacctggccagactcccagactcgtcattctttgctacatctgccgagggccacgtggccactccccagccctacgttccaggtggctagggtcgggtacgtggggaacaggtagttcatttccncactatcagcacgcctgctagtctagaagttatttgacttaagtttacttacggtgtactagtactaagttaactaagtcgtaaccgtcgggtccccttacggtaaccgggttccgggaacccggtaaacggggaaccgtaaaggggttaacggtaaaacgtaaccggttaaaaacggttaacggttcgggtaacggggtcctaacggtacccgtaaccgttactttccgttcggtttaaccc

SEQ ID NO: 413267 - DNA, 582 bp, Homo sapiens
  misc_feature: GZ8MTXP01D060M.15.49.E05.1.454.CMB.2.raw
  modified_base (204)..(204): a, c, t, g, unknown or other
tcagtctacgtagccacgaccggtgctcgatttagagcgactagcaacacacaaaggggggaactgctcagctaggacccagacggaaccatggaagccccagcgcagcttctcttcctcctgctactctggctcccagataccactggagaaatagtaatgacgcagtctccagccaccctgtctgtgtctccggaagggaancgccacctctcctgcgagggccagtcaagagtattgacagactaaagttacgcctggtaccagcaagaaacctggaccagacctacccagactcgtcattctttgctacatctgccgaggcccagtcggcactcccagcctacgttcaggtgctaggtcgggtctgggactaggtacgttcacttcacaacctatcgagcagcctgactagtctagaagttatttgacttagttttattacgtgtacagtactaagtataagtcgtacgtcgggtccctaccggacggtttccggaacgttaaaggggaaccttaaagggttaaacggaaacttacgaaaacgttacgtggtacggtctggaccacgtaagttcttcg

SEQ ID NO: 413268 - DNA, 514 bp, Homo sapiens
  misc_feature: GZ8MTXP01DD8HC.15.49.E05.1.454.CMB.2.raw
  modified_base (204)..(204): a, c, t, g, unknown or other
  modified_base (434)..(434): a, c, t, g, unknown or other
  modified_base (492)..(492): a, c, t, g, unknown or other
  modified_base (500)..(500): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaanagccaccctctcctgcagggccagtcagagtatgacagcaagttagcctggaccagcaagaaaccctggccagacctcccagactcgtcatctttgctacatctgccagggccactggccagtccccagccagttccaggtggcagtgggtctgggaacagtagttcattcacaccatcagcagcctgcagtctagaatatttgacttagtttatacgtgtcagcagtanaatgtactggtcctcgacgttcgaacgtaagggcctaaaggttggaaatcgaaaacgnttgtaagntgcacatcttgtcc

SEQ ID NO: 413269 - DNA, 510 bp, Homo sapiens
  misc_feature: GZ8MTXP01BZI7Z.15.49.E05.1.454.CMB.2.raw
  modified_base (202)..(202): a, c, t, g, unknown or other
  modified_base (301)..(301): a, c, t, g, unknown or other
  modified_base (355)..(355): a, c, t, g, unknown or other
  modified_base (366)..(366): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcagaaacctggccagactcccagactcgtcatctttgctacntctgccagggccactggcatcccagccacgttccagtggcagtgggtctgggcngagttcattcncacatcagcagcctgcagtctgaagtattttgctagtttattacgtgttacagactagtataatgactgtcctcgacgtcggaacgaaggaccgaaggttggaaatcgaaacgacgttgtaaggctgccacttatcgttcgtcc

SEQ ID NO: 413270 - DNA, 562 bp, Homo sapiens
  misc_feature: GZ8MTXP01DTUSV.15.49.E05.1.454.CMB.2.raw
  modified_base (205)..(205): a, c, t, g, unknown or other
tcagtctacgtagccacgaccggtgctcgatttagagcgactagcaacacacaaaggggggaactgctcagttaggacccagacggaaccatggaagccccagcgcagctttctcttcctcctgctactctggctcccagataccactggagaaatagtaatgacgcagtctccagccaccctgtctgtgtctccgaggggaaanagcccaccctctcctgcagggccagtcagagtattgacagcaagttagcctggtaccagcagaaacctggccagactccagactcgtcatctttgctacatctgccagggccactggcatcccagcccacgttccaggtggctaggtgggtctggggaactaggtagtttcatttccacaccatcagcagcctgcagtctagaagtatttgacttagtttatacgtgtacagtctaagttataagtgtaactcgggtcccttaccggaccgtttcgggaaccgaaaggggaccaaagggttacggaaaacttacgaaaacgttacttggtggctgccaccttattccgttgttaacc

SEQ ID NO: 413271 - DNA, 512 bp, Homo sapiens
  misc_feature: GZ8MTXP01CTZG9.15.49.E05.1.454.CMB.2.raw
  modified_base (204)..(204): a, c, t, g, unknown or other
  modified_base (374)..(374): a, c, t, g, unknown or other
  modified_base (475)..(475): a, c, t, g, unknown or other
  modified_base (497)..(497): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagagtatgacagcaagttagcctggtaccagcagaaacctggccagactcccagactcgtcattctttgctacatctgccagggccacgtggcatcccagccacgttccaggtggcaggtgggtctgggcagtacgttcattccncaccatcagcagcctgcagtctagtaagtatttgacttagtttattacgtgtcagtcagttataatgactgtcctcgacgtcggaacgtaaggactaaggngaaatcgaaacgcttgaacggntcgcacatcgttgtc

SEQ ID NO: 413272 - DNA, 549 bp, Homo sapiens
  misc_feature: GZ8MTXP01BN2UC.15.49.E05.1.454.CMB.2.raw
  modified_base (204)..(204): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangccacctctcctgcagggccagtcagagtatgacagcaagttagcctggtaccagcagaacctggccagactcccagactcgtcatctttgctacatctgccagggccactggcatcccagccacgttccagtggcaggtgggtactggggaacagtagttcatttccacaccatcagcagcctgcagtctagaagtatttgctagtttattacgtgtcagtctagtaataagttgaccgtggtcccttccggaccgtttcgggaaccgtaaacggggacccgtaaagggttacggtaaaactcgaaacgacgttggtgggctaacggcacgactcgttcgttcc

SEQ ID NO: 413273 - DNA, 580 bp, Homo sapiens
  misc_feature: GZ8MTXP01CM5U3.15.49.E05.1.454.CMB.2.raw
  modified_base (203)..(203): a, c, t, g, unknown or other
  modified_base (302)..(302): a, c, t, g, unknown or other
  modified_base (378)..(378): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtatgacagcaagttgcctggtaccagcagaaacctggccagacctcccagactcgtcattctttgctacntctgccagggccagtggcatcccagcctacgttccaggtgctaggtgggtactggggaacaggtagttctacttcnctaccatcagtcagcctgacagtctagaagttatttgacttagtttactacgtgtacagtctagtataagtcgacgtcggtccctacggtacggttccgggaaccgtaaacggggaaccgtaaagggttaacggtaaaacgttaccgaaaacggttcgttcgggtaaggcctaaggacctaccgttattcgttaacgtttcc

SEQ ID NO: 413274 - DNA, 548 bp, Homo sapiens
  misc_feature: GZ8MTXP01AB6E4.15.49.E05.1.454.CMB.2.raw
  modified_base (203)..(203): a, c, t, g, unknown or other
  modified_base (303)..(303): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcagaacctggccagacctcccagactcgtcattctttgctacntctgccagggccatggcactcccagccctacgttccaggtggcgtaggtgggtactggggaacaggtacgtttcatttccacaccatcagcacgcctgcagtctagtagtatttgacttagtttatacgtgtacagtactagttataagtgacgtcggtccctccggtacgttcggaaccgtaaagggacctaagggttagaaactacgaaacgcgttggtaaggctggactacatcgttgttcc

SEQ ID NO: 413275 - DNA, 612 bp, Homo sapiens
  misc_feature: GZ8MTXP01DROOP.15.49.E05.1.454.CMB.2.raw
  modified_base (205)..(205): a, c, t, g, unknown or other
  modified_base (306)..(306): a, c, t, g, unknown or other
  modified_base (430)..(430): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaagngccaccctctcctgcagggccagtcagagtattgacagcaagttagcctggtaccagcaagaaacctggccagacctcccagactcgtcatctttgctacntctgccagggccacgtggcactcccagccctacgttccaggtcggctagggtggggtcctaggggaacaggtacgtttccatttcctacaacctatcacgcacgcctgcctagtctagtaagtntttgcttaagtttacttacgtgtacagtctaagtataagtcggtactcggtccccttaccggtacggttccgggaaccgaaacggggaacccgtaaagggttaacgggaaaacttccgaaaaacgggttaccttagggttcgggaccttggaccctaaccgttacttccgttcgtttaaccc

SEQ ID NO: 413276 - DNA, 668 bp, Homo sapiens
  misc_feature: GZ8MTXP01CA7VW.15.49.E05.1.454.CMB.2.raw
  modified_base (324)..(324): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagcccaccctgtctgtgtctccgaaggggaagacgcccaccctctcctgcgacgggccagtcagagttattgacagactaagttacgccgtaggtaccagacaacgaaaccgtcggaccacgacctcccagactcgtcattctttgctacntctcgccgacgggccacgtggccactcccacgcccgtacgttccagggtcggacgtagggttcggggtacgtaggggaacgtagtacgttactacttcctaccaacctataccagccgacgtcccgtgacgtaacgttcgtaaggtaagtttcttttcgactttaaagttttacttacggttgtacgtacgtacgttaagttaactagtacgtaccggttcgtaccccgttaccggtacggttccggaaccggtaaggggaacctaaagggttacgaaaactcgaaaacggttcttgggtaacggtctaacggaccctaccgttagtttccgttcgtttaaccc

SEQ ID NO: 413277 - DNA, 567 bp, Homo sapiens
  misc_feature: GZ8MTXP01CSDQX.15.49.E05.1.454.CMB.2.raw
  modified_base (204)..(204): a, c, t, g, unknown or other
  modified_base (416)..(416): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccagggggaaancgccaccctctcctgcagggccagtcagagtatgacagcaagttgcctggtaccagcaagaacctggaccagacctcccagactcgtcattctttgctacatctgccagggccagtcggacactcccagtcctacgttccaggttggctaggttcgggtactgggaacagtacgttcattcacacatcagcagcctgctagtctagaagttntttgacttagtttacttacgtgtacagtactaagttataagtgtaacgtcggtcccttaccggacgttccgggaaccgtaaagggacctaaaggttacggtaaactcgaaaacgttcttgggcgactcgacctacacttcgttcgttaacc

SEQ ID NO: 413278 - DNA, 554 bp, Homo sapiens
  misc_feature: GZ8MTXP01D5201.15.49.E05.1.454.CMB.2.raw
  modified_base (201)..(201): a, c, t, g, unknown or other
  modified_base (298)..(298): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctccagataccactggagaaatagtaatgacgcagtctccagccacctgtctgtgtctccgaggggaangccacctctcctgcagggccagtcagagtattgacagcaagttgcctggtaccagcagaaacctggccagactcccagactcgtcatctttgctacntctgccaggccagtggcatcccagccagttccaggtggcaggtgggactggggaacagtagtttcattctacacctatcagcagcctgctagtctaggaatatttgactagtttattacgtgtcagtctagtatactggactcggtcctaccggtacgtcgggaacctaaaggggacccgtaaagggttcggtaaaacgtcgaaaacggttacgttaggtcggactcggacctaaccgttagttccttcgttaacc

SEQ ID NO: 413279 - DNA, 570 bp, Homo sapiens
  misc_feature: GZ8MTXP01EWQTY.15.49.E05.1.454.CMB.2.raw
  modified_base (208)..(208): a, c, t, g, unknown or other
  modified_base (306)..(306): a, c, t, g, unknown or other
  modified_base (310)..(310): a, c, t, g, unknown or other
  modified_base (409)..(409): a, c, t, g, unknown or other
tcagtctacgtagccacgaccggtgctcgatttagagcgactagcaacacacaaagggggggaactgctcagttaggacccagacggaaccatggaagccccagcgcagcttctcttcctcctgctactctggctcccagataccactggagaaatagtaatgacgcagtctccagcccaccctgtctgtgtctccgaagggggaaangcccaccctctcctgcagggccagtcagagtattgacagcaagttagcctggaccagcagaaacctggccagactccagactcgtcattctttgctanatcngccagggccagtgcatcccagccacgttcaggtggctaggtcgggtactgggaactagtagttcattcacaccatcagcagcctgctagtctagaagtntttgcttaagtttattacgtgttacagtacaagttaataagtcgtacgtcggtcccttaccggacggttacggaaccgtaaacgggaccgaaaggttaacggaaaattacgaaaacggttacgttggtggcttaacggacctacgattcgttcgtttaacc

SEQ ID NO: 413280 - DNA, 511 bp, Homo sapiens
  misc_feature: GZ8MTXP01EAYIX.15.49.E05.1.454.CMB.2.raw
  modified_base (202)..(202): a, c, t, g, unknown or other
  modified_base (365)..(365): a, c, t, g, unknown or other
  modified_base (418)..(418): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaangcccacctctcctgcagggccagtcagagtattgacagcaagttagcctggtaccagcagaaacctggccagactccagactcgtcatctttgctacatctgccagggccactggcatccagccagttccagtgcagtgggtctgggcagagttcagtttctnaccatcagcagcctgcagtctagagtatttgctagtttattacgtgtctaganagtataatagactcgccgtccgcgttcggccgaacggaccgaacggttaggaaagtaacaaacgaacttagtaaggctgcacactcgttgttc

SEQ ID NO: 413281 - DNA, 590 bp, Homo sapiens
  misc_feature: GZ8MTXP01CR2NO.15.49.E05.1.454.CMB.2.raw
  modified_base (204)..(204): a, c, t, g, unknown or other
  modified_base (373)..(373): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangccacctctcctgcagggccagtcagagtatgacagcaagttagcctggtaccagcagaaacctggaccagactccagactcgtcattctttgctacatctcgccagggccacgtgcatcccagccacgttccaggtgctaggtgggtactgggaactgagttcattcncacatcagcagctgctagtctgaagtatttgacttagtttattacgttgtactagtctaagttataaagttgaaccgttcggtccccttaccggtaccgggttcccgggaaccgtaaacggggacccgttaaagggttaggtaaaacgttccgaaaaacgttaccgttgggtaacggtaccgtcggacgtaccttaacgttccgttaaggttttccc

SEQ ID NO: 413282 - DNA, 581 bp, Homo sapiens
  misc_feature: GZ8MTXP01AF57E.15.49.E05.1.454.CMB.2.raw
  modified_base (204)..(204): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagagtatgacagcaagttgcctggtaccagcaagaacctggaccagacctcccagacctcgtctattctttgctacatctgccgagggccacgtggccactccccagcctacgttccaggtggctaggtggtacgtgggcaggtacgttcatttccacacctatccagcacgcctggcctaggtctagaagttatttgacttagttttatacgtgtacagtactaagttataagtggacctcggtccctaccggtacgttccgggaaccgtaaacggggaccgtaaagggttagaaaactcgaaaacgttacgttggtcggacttcggacctaccgttattccgttgttccc

SEQ ID NO: 413283 - DNA, 601 bp, Homo sapiens
  misc_feature: GZ8MTXP01AI4C7.15.49.E05.1.454.CMB.2.raw
  modified_base (204)..(204): a, c, t, g, unknown or other
  modified_base (414)..(414): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagagtatgacagcaagttagcctggtaccagcagaaacctggccagactcccagactcgtcattctttgctacatctgccagggccactggcatccccgagcctacgttccaggtggcaggttgggtctggggaacaggtacgttcatttctcaccatcagcagcctgctagtctagaacgtttntttcgattagtttacttacggtgtacagtactagttaataacgttcggtaccgtcggtccccgttaccgggtaccggttccgggaaccgtaaacggggaaaccgtaaaggggttaacggtaaaacgtaacgaaaccggttacgttcgggtaacggacctcggacctaccgttagttccgttcgttcc

SEQ ID NO: 413284 - DNA, 625 bp, Homo sapiens
  misc_feature: GZ8MTXP01B2G30.15.49.E05.1.454.CMB.2.raw
  modified_base (205)..(205): a, c, t, g, unknown or other
  modified_base (306)..(306): a, c, t, g, unknown or other
  modified_base (436)..(436): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaaggggaaangcccaccctctcctgcagggccagtcagagtatgacagcaagttgcctggaccagcaagaaacctggaccagacctcccagactcgtcattctttgctacntctcgccgagggccagtggcactccccagccctacgttccaggtggcgtaggtcggggtacgtaggggaactaggtacgtttcatttccacacctatccagcacgccttggctagttctagtaacgtttntttcgactttaagttttacttacggtgttacagtacgtaagttaataagtcggtaccgtcggtaccccgttaccggtaccgggttccgggaaaccggaaacggggttaaccgtaaagggttaacgtaaaacgtaacgaaaacggttcgttggtaacggcctaacggacctacgttacttccgttcgtcc

SEQ ID NO: 413285 - DNA, 601 bp, Homo sapiens
  misc_feature: GZ8MTXP01CPVDN.15.49.E05.1.454.CMB.2.raw
  modified_base (204)..(204): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaancgccaccctctcctgcagggccagtcagagtatgacagcaagttagcctggaccagcagaaacctggccagacctcccagactcgtcattctttgctacatctcgccagggccacgtggcactcccagcctacgttccgaggtggctagggtcggggtactaggggaactaggtacgtttcacttccacaaccattcagcacggcctgaccgtagttctagtaacgttatttcgacttaagttttacttacggtgtacagtacgtaagttaatagtcgtacgttcgggtcccttaccgggtacggttccgggaacgtaaacggggaccgtaaagggttacgtaaactcgaaaacgttacgttcgggtggctcgcctacgttacttccgttcgtttcc

SEQ ID NO: 413286 - DNA, 533 bp, Homo sapiens
  misc_feature: GZ8MTXP01BTHVW.15.49.E05.1.454.CMB.2.raw
  modified_base (405)..(405): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaagagccaccctctcctgcagggccagtcagagtattgacagcaagttagcctggtaccagcagaacctggccagactcccagactcgtcattctttgctacatctgccagggccacgtggccatcccagcccacgttcaggtggcaggtgggtctggggcaggtgttcatttctcacatcagcagcctgcagtctagtaagtntttgcttagtttatacgtgtcagactagtataatgtactcggtccctcgtacgttcggaacgaagggacctaagggttaggaaactacgaaacgttacttggtggctcggccacttatccgttgttcc

SEQ ID NO: 413287 - DNA, 582 bp, Homo sapiens
  misc_feature: GZ8MTXP01DAA5S.15.49.E05.1.454.CMB.2.raw
  modified_base (204)..(204): a, c, t, g, unknown or other
  modified_base (410)..(410): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagagtatgacagcaagttagcctggtaccagcagaaactggccagactcccagacctcgtcattctttgctacatctgccagggccagtggcatcccagccacgttccaggtggcaggtgggtcctaggggaacaggtagtttcagtttccacacatcagcagcctgcagtctagaagttntttgcttaagtttattacgtgtacagactagttaatagtgaccgtcggtcccttaccggaccggtttcgggaacccgtaaacggggaacccgtaaagggttacggtaaaactacgaaaaccggttcgttaggtcggacgttcggacctaccgttattccgttcgtttaaccc

SEQ ID NO: 413288 - DNA, 572 bp, Homo sapiens
  misc_feature: GZ8MTXP01DW3W4.15.49.E05.1.454.CMB.2.raw
  modified_base (205)..(205): a, c, t, g, unknown or other
  modified_base (413)..(413): a, c, t, g, unknown or other
tcagtctacgtagccacgaccggtgctcgatttagagcgactagcaacacacaaagggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangcccaccctctcctgcagggccagtcagagtatgacagcaagttagcctggaccagcaagaaacctggccagactcccagactcgtcattctttgctacatctgccagggcccacgtggcactccccagcccacgttccaggtgctaggtgggtctagggaacaggtacttcattccacaccatcagcagcctgcagtctagaagttntttagacttaagtttacttacggtgttacaagtctaagtaataagtcgactcggtcccttacggaccgttcgggaaccgaaacgggaaccgaaagggttaaggaaactacaaaacggattcggaacggtctcggcctaaccgttattcgttcgttaacc

SEQ ID NO: 413289 - DNA, 572 bp, Homo sapiens
  misc_feature: GZ8MTXP01CB7VI.15.49.E05.1.454.CMB.2.raw
  modified_base (206)..(206): a, c, t, g, unknown or other
  modified_base (404)..(404): a, c, t, g, unknown or other
  modified_base (425)..(425): a, c, t, g, unknown or other
  modified_base (430)..(430): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggaagaaatagtaatgacgcagtctccagccaccctgtctgtgtctccgaaggggaaangcccaccctctcctgcagggccagtcagagtatgacagctaagttgcctggaccagcaagaaacctggaccagactcccaagacctcgtcattctttgcctacatcgtcgaccacggggcccacgtggccactcccaaggcctacgttcccaggtggctaggtgggtctagggcaggtagttcattctacacatcgancagcctgacagtctagtagtntttanctagtttattacgtgtacagactagtataagtgtactcggccttccggaccggttccggaacggtaaagggaccggtaaagggaggtaaaacacttaaaccggattcggtaaggctcgactacgttacttcgttcgttaacc

SEQ ID NO: 413290 - DNA, 490 bp, Homo sapiens
  misc_feature: GZ8MTXP01D0MRW.15.49.E05.1.454.CMB.2.raw
  modified_base (202)..(202): a, c, t, g, unknown or other
  modified_base (365)..(365): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcagaaacctggccagactcccagactcgtcatctttgctacatctgccagggccactggcatcccagccacgttccagtggcagtggtctgggcagagttcattcncacatcagcagcctgcagtctgaagtatttgctagtttattacgtgtcagctagtataatgactggcctcgacgttcggcaagggacaaggttgaaatcaaacgcttgtggctgcacatcttgtc

SEQ ID NO: 413291 - DNA, 516 bp, Homo sapiens
  misc_feature: GZ8MTXP01DGUJ1.15.49.E05.1.454.CMB.2.raw
  modified_base (206)..(206): a, c, t, g, unknown or other
  modified_base (309)..(309): a, c, t, g, unknown or other
  modified_base (415)..(415): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggcctcccagataccactggagaaatagtaatgacgcagtctccagccaccctgtctgtgtctccgaggggaaagngcccaccctctcctgcagggccagtcagagtattgacagcaagttagccctggtaccagcagaaacctggaccagactcccagactcgtcattctttgctacntctgccagggccactggcatcccagccacggttccaggtggctaggtgggtcctggggcaggtagttccattcctacacctatccagcagcctgcagtctagagtntttgcttagtttattacgtgtcagctagtatagtgactggcctcgcgttcggaacaagggcaaaggttgaaatcaaagcttgtggatgcacatcttgttcc

SEQ ID NO: 413292 - DNA, 598 bp, Homo sapiens
  misc_feature: GZ8MTXP01DAZHE.15.49.E05.1.454.CMB.2.raw
  modified_base (203)..(203): a, c, t, g, unknown or other
  modified_base (290)..(290): a, c, t, g, unknown or other
  modified_base (412)..(412): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcaagaaacctggccagactcccagactcgnatctttgctacatctgccagggccagtggccatccccagcccacgttcagtggctaggtggtctgggaacagtagttcattcacaccatccagcacgcctgactagttcgtagtaaagtttntttcgactttaagtttatttacgtgtacgtagtactaagttaagtaacgtcgtacgtccggtacctaccgtaacgtcggttaaccggaaccggttaaacgggaacgttaaagggtaaacgtaaacgttaaccgttaaacggttacgttggtacggtccgtacgaccttacgttaacgttccgttcg

SEQ ID NO: 413293 - DNA, 566 bp, Homo sapiens
  misc_feature: GZ8MTXP01DQ5QR.15.49.E05.1.454.CMB.2.raw
  modified_base (204)..(204): a, c, t, g, unknown or other
  modified_base (400)..(400): a, c, t, g, unknown or other
  modified_base (527)..(527): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagngccaccctctcctgcagggccagtcagagtattgacagcaagttagcctggtaccagcagaacctggccagactccagactcgtcatcttgctacatctgccagggccagtggcatcccagcctacgttccaggtggcaggtgggtctgggaacagtgttcattcctcaccatcagcagcctgcagtctagtaatntttgactaagtttattactggtcagtactagttaataagtgtactcggtccctaccggtacggttccggaaccgaaaggggacctaaaggggttacggtaaaactacggaaaacgttaccgttaggngggtacctaacggcctaccgttagttcccttgttaaccc

SEQ ID NO: 413294 - DNA, 642 bp, Homo sapiens
  misc_feature: GZ8MTXP01D9J0U.15.49.E05.1.454.CMB.2.raw
  modified_base (205)..(205): a, c, t, g, unknown or other
  modified_base (216)..(216): a, c, t, g, unknown or other
  modified_base (451)..(451): a, c, t, g, unknown or other
  modified_base (486)..(486): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggcctcccagataccactggagaaatagtaatgacgcagtctccagccaccctgtctgttgtcctcgaggggaanagcccacctcncctgcagggccagtcagagtatgacagcaagttgcctggaccagcagaaacctggaccagacctccgagactcgtcattctttgctacatctcgccgacgggccacgtcggccactcccacgccctacgttccgaggtggacgtagggtcgggtacgtaggggaactaggtacgttcactttcaacctacctagtaccgagtccacggtccctaggcctaggttcagtaagtttntttcgactttttaagtttacttacggttgttaacngtacgtaagttaatacgttcggacgttccggtacccgtacgggtaccggttaccgggaaccggtaaacggggttaccggtaaaggggttaacgaaacgtaaaccgaaacgttcgttacgggtaacgctaacgacctacgttacttccgttcgttcc

SEQ ID NO: 413295 - DNA, 577 bp, Homo sapiens
  misc_feature: GZ8MTXP01EI710.15.49.E05.1.454.CMB.2.raw
  modified_base (205)..(205): a, c, t, g, unknown or other
  modified_base (370)..(370): a, c, t, g, unknown or other
  modified_base (402)..(402): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagcccacctgtctgtgtctccgaggggaaagngcccaccctctcctgcagggccagtcagagtattgacagcaagttagcctggaccagcagaaacctggccagactccagactcgtcatctttgctacatctgcaggccactggcatcccagccacgttcaggtgcagtgggtctgggcagggtattcagtttccncaccatcagcagcctgctagtctagaaagttnttgacttaagtttactacggtgtacagtactaagtatagtcgtaccgtcggtacccgttaccggtacggttaccggaaccgtaaacggggaaccgtaaagggttaacgaaaacgtaacgaaaacgttacggttgggttaacggtcaaccgtactacgttcttaacgtttccctcg

SEQ ID NO: 413296 - DNA, 798 bp, Homo sapiens
  misc_feature: GZ8MTXP01B0MH1.15.49.E05.1.454.CMB.2.raw
  modified_base (202)..(202): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctccagataccactggagaaatagtaatgacgcagtctccagccacctgtctgtgtctccgaggggaaangccaccctctcctgcagggccagtcagagtatgacagcaagttgcctggaccagcagaacctggccagactcccagctcgtcattctttgctacatcgtcgccgacgggccctacgtcgggacctaaccgttcccccgaaggtcccctaaacggtttccccgaagggttcgggacctaggggttcgggggttccgttacgggggtaaccagggttaaaccggtttcctaaacgtttttccctaccaaaccctaagttccccaaagggtcctaaacgggcccccttagggaccccgtaaggtttaccgtaggttaaaaggttttacgttttacgttaacgttttaagtttttaacgttacggttacggtttacgtaacgttaacgttaaagtttaaagttaacggttacggttaacccgttaccgggtaccccgtttacccggggttaccgggttacccgggtaaaccgggtaaaaacgggggttaaacccgtaaaggggttaaacggtaaaacgtaaaccggttaaaaccggttaacggttacgggtaaccggtaccgtaacgtaccgtaaccgttacttccgtttcgtttaaccc

SEQ ID NO: 413297 - DNA, 590 bp, Homo sapiens
  misc_feature: GZ8MTXP01EARTF.15.49.E05.1.454.CMB.2.raw
  modified_base (202)..(202): a, c, t, g, unknown or other
  modified_base (351)..(351): a, c, t, g, unknown or other
  modified_base (368)..(368): a, c, t, g, unknown or other
  modified_base (400)..(400): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccacctgtctgtgtctccgaggggaangccacctctcctgcagggccagtcagagtatgacagcaagttagcctaggaccagcagaaacctggccagacctcccagactcgtcattctttgctacatctgccagggccacgtggcactcccagccagttccaggtgctggtggtcngggcagtagttcattcncacatcagcacgctgactagtctagtaagttntttcgacttagtttattacgtgttcaagtctaagtactaatgaacgttcggcccttaccggtacgggttccgggaaccgtaaacgggggttaacccgtaaagggggttaacgaaacgttaaccggaaaaacggttcgttacgggtaacgggtactaacggaccaccgttactttccgttcgtttaacccg

SEQ ID NO: 413298 - DNA, 613 bp, Homo sapiens
  misc_feature: GZ8MTXP01AVDHB.15.49.E05.1.454.CMB.2.raw
  modified_base (200)..(200): a, c, t, g, unknown or other
  modified_base (298)..(298): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctccagataccactggagaaatagtaatgacgcagtctcagccacctgtctgtgtctccgaggggaangccacctctcctgcagggccagtcagagtattgacagcaagttgcctggaccagcagaacctggccagacctcccagacctcgtcattctttgctacntctcgccgagggccagtcggccatcccagcccacgttccaggtcggcgtaggtcgggtacgtgggaacaggtacgtttcacgtttccacgacctatcacgcacgcctgcgtaagttcgtaggtaagttcgtttcgacgttagtttttacgtacgttggtacaagtcgtaaagttactaagtcgtaacgtcggtacccgttaccggtacggttccgggaacgtaaacggggaaccgtaagggttaacggtaaaactaccggaaaacggttcgttgggtaacggcctaacggacccacttacgttccgttgtttccc

SEQ ID NO: 413299 - DNA, 505 bp, Homo sapiens
  misc_feature: GZ8MTXP01D5AL6.15.49.E05.1.454.CMB.2.raw
  modified_base (205)..(205): a, c, t, g, unknown or other
  modified_base (303)..(303): a, c, t, g, unknown or other
  modified_base (374)..(374): a, c, t, g, unknown or other
  modified_base (488)..(488): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgagggggaaangcccaccctctcctgcagggccagtcagagtattgacagcaagttgcctggtaccagcagaaacctggccagactcccagactcgtcatctttgctanatctgccagggccactggcatcccagccacgttccaggtggcaggtgggtctgggcagtagtttcatttcncacatcagcagcctgctagtctgaagtatttgctagtttatacgtgtcagctagtataatgactgtcctcgacgtcgaacaaggcaaggttgaaactcaaacgttcttggtcgntcgcacgatcgttgtcc

SEQ ID NO: 413300 - DNA, 517 bp, Homo sapiens
  misc_feature: GZ8MTXP01ALHWU.15.49.E05.1.454.CMB.2.raw
  modified_base (203)..(203): a, c, t, g, unknown or other
  modified_base (299)..(299): a, c, t, g, unknown or other
  modified_base (400)..(400): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtatgacagcaagttgcctggtaccagcagaacctggccagactcccagactcgtcatctttgctacntctgccagggccactggcactcccagccacgttccaggtggcaggtgggtctggggcagtagttcatttcctcaccatcagcagcctgcagtctagaagtntttgctagtttatacgtgtcagctagtataatgactgcctcgacgtcggcgaagggaccaaggttaggaaatcgaaacgttacgttggtaaggctcggaccaccttatcttcgttcc

SEQ ID NO: 413301 - DNA, 591 bp, Homo sapiens
  misc_feature: GZ8MTXP01CCEVA.15.49.E05.1.454.CMB.2.raw
  modified_base (204)..(204): a, c, t, g, unknown or other
  modified_base (578)..(578): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagagtatgacagcaagttgcctggaccagcaagaaacctggaccagactcccagactcgtcattcttgctacatctgccgtagggccacgtggaccactccccagcctacgttccaggtcggcgtagggttcggggtaaccgtaggggaactaggtacgtttcatttccacactatcgagcacggcctgctagtcgtagtaacgttgtttcgacttagttttactacggttgtactagtactagtaatagtcgacgtcgtaccgttcggacgttcgggaacctaaagggacctaaagggttacgaaaactcgaaaacggttattgggtcggtactcggacctaaccttnttccgttcgttcc

SEQ ID NO: 413302 - DNA, 521 bp, Homo sapiens
  misc_feature: GZ8MTXP01B780W.15.49.E05.1.454.CMB.2.raw
  modified_base (204)..(204): a, c, t, g, unknown or other
  modified_base (301)..(301): a, c, t, g, unknown or other
  modified_base (364)..(364): a, c, t, g, unknown or other
  modified_base (379)..(379): a, c, t, g, unknown or other
  modified_base (407)..(407): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangcccaccctctcctgcagggccagtcagagtattgacagcaagttgcctggtaccagcagaacctggccagactccagactcgtcatctttgctacntctgccagggccacgtggccatccccagccacgttccaggtggcaggtgggtactggggaacngtacgttcatttccncaccatcagcagctgcagtctagaagtntttgcttagtttattacgtgtcagctagtatatgactcgtcctcggtacgttcggcgaagggaccaaggttggaaactcgaaacggttcttggtggctgcacttatcttgttcc

SEQ ID NO: 413303 - DNA, 601 bp, Homo sapiens
  misc_feature: GZ8MTXP01BY689.15.49.E05.1.454.CMB.2.raw
  modified_base (204)..(204): a, c, t, g, unknown or other
  modified_base (302)..(302): a, c, t, g, unknown or other
  modified_base (422)..(422): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangcccaccctctcctgcagggccagtcagagtattgacagcaagttagcctggaccagcagaacctggccagacctccagactcgtcatctttgctacntctgccagggccacgtggcactcccagccctacgttccaggtcggctagggtgggtcctggggaacaggtacgtttccatttccgacacctatccagccagcctggctagtctagaagtntttgacttagtttattacgtgtacagtactagttataagtggtaccgtcgggtccccttaccggtaccggtttccgggaacccgtaaaggggttacccgtaaaggggttacgaaaacgttaccgaaaacggttacttcgggtgggacttcggacctacgttacttccgttgtttaaccc

SEQ ID NO: 413304 - DNA, 541 bp, Homo sapiens
  misc_feature: GZ8MTXP01AZDY3.15.49.E05.1.454.CMB.2.raw
  modified_base (205)..(205): a, c, t, g, unknown or other
  modified_base (304)..(304): a, c, t, g, unknown or other
  modified_base (356)..(356): a, c, t, g, unknown or other
  modified_base (363)..(363): a, c, t, g, unknown or other
  modified_base (372)..(372): a, c, t, g, unknown or other
  modified_base (400)..(400): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagcccaccctgtctgtgtctccgaggggaaangcccaccctctcctgcagggccagtcagagtattgacagcaagttagcctggaccagcagaaacctggccagactcccagactcgtcatctttgctacntctgccagggccatggcactcccagcccagttccaggtggcaggtggggtcngggcagngttcattcncaccatcagcagcctgcagtctgaagtnttttgcttagtttatacgtgtcagctaagttatagtgactcggtccttccggacgttcgggaaccgtaaaggggacccgaagggttagaaacgttacgaaacgttacgttggtggtctcggactaccttagtccttgttcc

SEQ ID NO: 413305 - DNA, 700 bp, Homo sapiens
  misc_feature: GZ8MTXP01DRHGF.15.49.E05.1.454.CMB.2.raw
  modified_base (207)..(207): a, c, t, g, unknown or other
tcagtctacgtagccacgaccggtgctcgatttagagcgactagcaacacacaaaaggggggaactgctcagttaggacccagacggaaccatggaagccccagcgcagcttctcttcctcctgctactctggctcccagataccactggaagaaatagtaatgacgcagtctccagccaccctgtctgtgtctccgaaggggaaangcccaccctctcctgcgagggccagtcagagtatgacagcaagttagcctaggtaccagcaagaaacctggaccagacctcccagactcgtcattctttgctacatctgccgagggccacgtggcactccccagcccacgttccaggtggacctaggggtcggggtctaggggaactaggtacgtttcctaatttccctacacctatccgaaggtccacggtcccttaggacccgtaaggttcgttaaggtaaacgtttatttttcggacttttaaagtttttacttacggtagttaccgtaaggtaccttaagttaaactaaaggttcggttaaccgtccgggtaccccgtttacccgggaaccgggtttcccggggaaaccccgtaaagggggttaaacccgtaaaggggttaacggaaaacgtaacccgaaaaacggttacgttcgggtaacgggtctaacggaccctaccgttacgttcgttcgtttcc

SEQ ID NO: 413306 - DNA, 574 bp, Homo sapiens
  misc_feature: GZ8MTXP01BXGBJ.15.49.E05.1.454.CMB.2.raw
  modified_base (205)..(205): a, c, t, g, unknown or other
  modified_base (400)..(400): a, c, t, g, unknown or other
  modified_base (438)..(438): a, c, t, g, unknown or other
  modified_base (552)..(552): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagcccaccctgtctgtgtctccgaggggaaangcccaccctctcctgcagggccagtcagagtattgacagcaagttagcctggaccagcagaacctggccagactcccagactcgtcattctttgctacatctgcccagggtccacgtggccactccccaggccctacgttccgaggtcggcgtagggttcggggtcttggggaacagggtacgtttccatttccncacctagtccagccagtcctgcgtagtctagtaacgtntttagactttagtttattacgtgttacagctagtatatgtactcggtcctcggtcgttcggaacgaacggggacctaaagggttgaaacgtacgaaacgttacgttggtcgggntcgcaccgttatcgttcgttcc

SEQ ID NO: 413307 - DNA, 613 bp, Homo sapiens
  misc_feature: GZ8MTXP01ES6PS.15.49.E05.1.454.CMB.2.raw
  modified_base (202)..(202): a, c, t, g, unknown or other
  modified_base (300)..(300): a, c, t, g, unknown or other
  modified_base (303)..(303): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccacctgtctgtgtctccgaggggaangcccacctctcctgcagggccagtcagagtatgacagctaagttgcctggtaccagcagaaacctggccagacctcccagactcgtcatcttgctacntcngcaggccacgtgcactcccagcccagttcgaggtggctaggtgggtctgggaacagtagttcattctacacctgtcagtcacgtccctgacgtaagttctagtaacgttatttcggacttaagtttttacttacggtgttaccgaagtactaaggttaatagtcgtaaccgtcggtaccccgttaccgggtaccggtttccgggaaccgtaaacggggaacccgtaaaggggttacgtaaaacgtaccgaaaaccggttagttcgggtaacggctaacggtaccaaccggttattccgttgtttaacccc

SEQ ID NO: 413308 - DNA, 842 bp, Homo sapiens
  misc_feature: GZ8MTXP01APFP1.15.49.E05.1.454.CMB.2.raw
  modified_base (204)..(204): a, c, t, g, unknown or other
  modified_base (248)..(248): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccacctgtctgtgtctccgaaggggaaangccaccctctcctgcagggccagtcagagtatgacagcaagttncctggtaccagcagaacctggccagacctccagactcgtcattctttgctacatcgtcgaccgtaggggccacgtcggaccacgttcccccaaggcccctacggtttccaacgggttggaccgtaggggttcgggggttaaccgtacgggggaacctagggtaacgttttacctaacgtttccttaccgaaaccctaatttcccgaaacgggtcctaaacgggccccttagggaaccccttaaaggttcccgttaaagggtaaaacggtttttacgtttttacggtaacgttttaaacgttttttaacgtttaccgggtttacggttaaccgtaacggtaccgtaaacgtaccgttaaagtttaaacgttaccggttaacccggttcccggggttaacccccgttaaccccgggttaacccggggttaacccgggggtaaaccccgggttaaaaacgggggtaaaccccgggttaaaagggggttaaaccggtaaaaaccgttaaacccggttaaaaaccggttaccgggtttaacgggttaccgggtaaccgttaaccggtacccttaacccgttccgtttaaccggtttccg

SEQ ID NO: 413309 - DNA, 635 bp, Homo sapiens
  misc_feature: GZ8MTXP01B3CRW.15.49.E05.1.454.CMB.2.raw
  modified_base (205)..(205): a, c, t, g, unknown or other
  modified_base (445)..(445): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagcccaccctgtctgtgtctccgaggggaaangcccaccctctcctgcagggccagtcagagtattgacagctaagttgcctggtaccagcaagaacctggaccagacctcccagacctcgtcattctttgctacatctcgaccgagggccacgtggcactcccgagccctacgttcgaggtggcgaggttcggggtctaggggaacagggtactttccagtttcctacgacctatcacgctacgccttgacgtacgttcgtagtaagtttntttcgacttaagttttatacgttgtacagtctaagttaatagtcgtacgttcggtccccgttaccggaccgggttccggaaccgggtaaacggggaacccggtaaagggttaacggtaaaacgtaaccgaaaaccgggttcgttggtaacgggtcctaacgccgtaacccttacttcgttaacgtttccc

SEQ ID NO: 413310 - DNA, 598 bp, Homo sapiens
  misc_feature: GZ8MTXP01DWCAV.15.49.E05.1.454.CMB.2.raw
  modified_base (204)..(204): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaanagcccaccctctcctgcagggccagtcagagtattgacagcaagttagcctaggaccagcaagaaacctggaccagacctcccagactcgtcattctttgctacatctgccgagggccacgtggccactcccagcctacgttccaggtggctagggtgggtactaggggcagtagttcatttccacaccatcagcagcctgctagtctaggtaaagttctttgacttagtttacttactgtacagtactaagtaactaagtgtacgtcggtcccgttccggtaaccgggttcggaaccgtaaaggggaaccgtaaagggttacggaaaacttacgaaaacggttcgttaggtcgggtctaacggaccctaccttatttccgttggtttaacccc

SEQ ID NO: 413311 - DNA, 553 bp, Homo sapiens
  misc_feature: GZ8MTXP01AC16D.15.49.E05.1.454.CMB.2.raw
  modified_base (204)..(204): a, c, t, g, unknown or other
  modified_base (401)..(401): a, c, t, g, unknown or other
  modified_base (440)..(440): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaanagccaccctctcctgcagggccagtcagagtattgacagcaagttagcctggtaccagcagaacctggccagactcccagactcgtcatctttgctacatctgcccaggggccagtggcatcccagccacgttccaggtgcagtgggtctgggcagagttcattctcaccatcagctagcctagctagtctgaagtntttgactagtttatacgtgttacagtactagtattaacngtacgtggtccctacggtaccggttcggaaccggaagggacctaaaggggttacggaaactacgaaaacggttacttaggtcgggcttcggaccaccttattccgttgttccc

SEQ ID NO: 413312 - DNA, 606 bp, Homo sapiens
  misc_feature: GZ8MTXP01A2SWE.15.49.E05.1.454.CMB.2.raw
  modified_base (205)..(205): a, c, t, g, unknown or other
  modified_base (292)..(292): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagcccaccctgtctgtgtctccgaggggaaangcccaccctctcctgcagggccagtcagagtattgacagcaagttagcctggtaccagcagaacctggccagactcccagactcgtnattctttgctacatctcgccagggccacgtggcactcccagcccacgttccaggtggcgtaggtggggtactggggaactaggtacgtttccatttcctacacctatcagccacgcctgctagtctagaacggttatttgaccttaagttttacttacgtggtacagtacgtattaatagtcgtacgtcggtcccttaccggtaccggtttaccgggaacccggtaaaggggacccgtaaaggggttacggtaaacgtacgttaaaacgcgttgggtaacggctcggacctaccgacttaacgttcgttaaccc

SEQ ID NO: 413313 - DNA, 544 bp, Homo sapiens
  misc_feature: GZ8MTXP01BF3AP.15.49.E05.1.454.CMB.2.raw
  modified_base (203)..(203): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccacctctcctgcagggccagtcagagtattgacagcaagttagcctggtaccagcagaaacctggccagactccagactcgtcatctttgctacatctgccagggcactggcatcccagccacgttccagtggcaggtggtactgggaacagtagttcattcacacatcagcagctgacagtctagaagtatttgctagtttatactgtactagctaagtataagcgtaacgtggtcccttccgacggttccggaacccgtaaagggaccgtaaagggttagggtaaaactaacaaaacggttacgttaggtaaggctaacgcaccttatcgttgttcc

SEQ ID NO: 413314 - DNA, 773 bp, Homo sapiens
  misc_feature: GZ8MTXP01C9GE2.15.49.E05.1.454.CMB.2.raw
  modified_base (204)..(204): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaancgcccaccctctcctgcgacgggccagtcagagtattgacagtcaagttgcctaggtaccagacaagaaacctggaccaagacctacccaagtacctcgtactattctttacgccttacacgttccgtcggaccccggaacgggggcccctaacggttcgggacctaacccttaccccccgaacggtaccccttaacccggttttcccgaacggggttacgggccgttaaagggggttcgggggttaacccgtacgggggtaactaagggttaacggttttaccctaactttccctaccgaaaccctaattccgacgaccgtacgtcccgttggaccgtaagtttcgtaaaggttaagtttagttttcgtacgttaagttttaacgtttaccgttggtacctaagacgttaagtaagttacgtacgtaaccgttccggtcccgtaccgggtaccggttaccgggaaccgaaacgggttaccggtaaagggttaacggtaaacgtaccggaaaaacgttcgttacgggttcggaccgtaacgaccgtacttacgttccttcggtttaacc

SEQ ID NO: 413315 - DNA, 609 bp, Homo sapiens
  misc_feature: GZ8MTXP01A4Z2D.15.49.E05.1.454.CMB.2.raw
  modified_base (205)..(205): a, c, t, g, unknown or other
  modified_base (307)..(307): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtcctccagccaccctgtctgtgtctccgaggggaaangcccaccctctcctgcagggccagtcagagtatgacagctaagttgcctggtaccagcaagaacctggccagactcccagactcgtcatctttgctacatcngccagggccactggcactcccagcctacgttaccaggtggacgtaggtcggggtactggggaactagggtacgttctattcctacaccatccgaagcgaacgcctgctaacggtctaggaacgttgttttgacttagttttatacgtgttacagtactaagttaatacgttgaaccgttcgggtacccttccggtaaccggtttccgggaacccggtaaaggggaacccgtaagggttacggtaaaacttaccggaaaacgttcgttggttaacgccgtgaccaccttagtcgttgtttccc

SEQ ID NO: 413316 - DNA, 619 bp, Homo sapiens
  misc_feature: GZ8MTXP01CECKG.15.49.E05.1.454.CMB.2.raw
  modified_base (204)..(204): a, c, t, g, unknown or other
  modified_base (420)..(420): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagcccaccctgtctgtgtctccgaggggaangcccaccctctcctgcagggccagtcagagtattgacagcaagttgcctggtaccagcagaaacctggaccagactcccagactcgtcattctttgctacatctcgccgagggccacgtggcactcccagcctacgttccgaggtggctaggtgggtctgggaacagtacgttcattcctcaccatcagcacgtcctgcgtagttctagtaagttntttagacttagttttacttacgtcgtacgtagtacgtaagttaataaagtgtaaccgtcggtaccccgtccggttaccggttccggggaacccgtaaacggggttaaacccggtaaagggttacgggtaaaaactaccggttaaaaacggttcgttacggttcgggacttcggacctaccacgttccttcgtttaaccc

SEQ ID NO: 413317 - DNA, 703 bp, Homo sapiens
  misc_feature: GZ8MTXP01ANODL.15.49.E05.1.454.CMB.2.raw
  modified_base (204)..(204): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaancgccaccctctcctgcagggccagtcagagtattgacagcaagttagcctggacagcaagaacctggaccagacctcccagactcgtcattctttgctacatctcgccagggccagtcggccactcccgagccctacgttccgaggtggacgtagggttcggggtaccgtagggggaactacgggtactttcactttcctaccaaccctatccgaagtaccgacgtcccgttaggaccgtaaggttccgttaaggtaaacggtttatttttcgacgtttaaggttttacttacggttgttaccaagttaccgtaagttaactaacggttcggtaaccggttcgggtaccccgtttaccgggtaacccggtttccggggaaacccgtaaacgggggttaaccgtaaagggttacgggaaaaacgttaccgaaaaaccggggttccttaggggtaacgggtcctaacggtacccgaaccttacgttccgttaacgtttccc

SEQ ID NO: 413318 - DNA, 710 bp, Homo sapiens
  misc_feature: GZ8MTXP01ADZQ8.15.49.E05.1.454.CMB.2.raw
  modified_base (205)..(205): a, c, t, g, unknown or other
  modified_base (215)..(215): a, c, t, g, unknown or other
  modified_base (301)..(301): a, c, t, g, unknown or other
tcagtctacgtagccacgaccggtgctcgatttagagcgactagcaacacacaaagggggggaactgctcagttaggacccagacggaaccatggaagccccagcgcagcttctcttcctcctgctactctggctcccagataccactggagaaatagtaatgacgcagtctccagcccacctgtctgtgtctccgaggggaaangcccaccctntcctgcagggccagtcagagtatgacagcaagttgcctggaccagcagaacctggccagacctccagactcgtcatctttgctacntctgccagggccacgtggctactcccagccctacgttccaggtggacctagggttcggggtactaggggaacctagggtacgtttcacgtttcctacgaaccctatccgaacgccgacggtcccttaggactaacgggtttccttaagggtaaacggtttatttttacggacctttaaggtttttacttaaccggttggtaccctaaggtaccttaaaggttaaattaacgttcggtaaacccggtttcgggtaccccgtttacccggggtaaccgtttccgggggaaacccgaaacgggggttaaacccgtaaaggggttaacggtaaaacgttaccggaaaaccggttaccgttgggttaaccggacttaaccggtaccaaccgttacgttccgttcggtttaaccc

SEQ ID NO: 413319 - DNA, 636 bp, Homo sapiens
  misc_feature: GZ8MTXP01DKA2Z.15.49.E05.1.454.CMB.2.raw
tcagtctacgtagccacgaccggtgctcgatttagagcgactagcaacacacaaagggggggaactgctcagttaggacccagacggaaccatggaagccccagcgcagcttctcttcctcctgctactctggctcccagataccactggagaaatagtaatgacgcagtctccagccaccctgtctgtgtctccgaggggaaagcgccaccctctcctgcagggccagtcagagtattgacagcaagttgcctaggtaccagcaacgaaacctggaccagacctccgagactcgtcattctttgctacatcgtcgccgagggccagtcggacactcccagcctacgttccaggtggcgtaggtcggggtacagggaacaggtacgttcacgttcctacaaccgtataccgacggcacggtcccttggacgttacggttctaaggtaacgttattttcggaactttaagttttacttacgtgtacgagtactaagtaattaacgtggtaacccgttcggtcccgttaccggacggttaccgggaaccggtaaacgggaccgtaaagggttagtaaaacctaagttaaaccggttagttcggtaagactcgacctaccgttattccgttgttaaccc

SEQ ID NO: 413320 - DNA, 646 bp, Homo sapiens
  misc_feature: GZ8MTXP01D1DFL.15.49.E05.1.454.CMB.2.raw
  modified_base (204)..(204): a, c, t, g, unknown or other
  modified_base (450)..(450): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggcctcccagataccactggagaaatagtaatgacgcagtctccagccacctgtctgtgtctccgaggggaaangcccacctctcctgcagggccagtcagagtattgacagcaagttagccctggaccagcaagaaacctggaccagacctcccgagacctcgtacattctttgctacatctgccgagggcccacgtggacactccccagcctacgttcaggtcggcgtaggtcgggtaccgtagggaactaggtacgttcctaagtttcccacgacctatcgaacgcgacgtccgtgaccgtagttcgtagtaagttntttacgatttaaagttttacttaccggttagtaccgtaagtacgttaagttaacgttaacgtcgtaaccgttcggtaccccgttaccggtaccggttacccgggaaccgtaaaggggaccgtaaagggttaacggtaaaactacgaaaaccgttgttcggcggtacttaacgcctaaccgttcttccgttcgtccg

SEQ ID NO: 413321 - DNA, 551 bp, Homo sapiens
  misc_feature: GZ8MTXP01BMR0E.15.49.E05.1.454.CMB.2.raw
  modified_base (204)..(204): a, c, t, g, unknown or other
  modified_base (414)..(414): a, c, t, g, unknown or other
tcagtctacgtagccacgaccggtgctcgatttagagcgactagcaacacacaaagggggggaactgctcagttaggacccagacggaaccatggaagccccagcgcagcttctcttcctcctgctactctggctcccagataccactggagaaatagtaatgacgcagtctccagccacctgtctgtgtctccgaggggaaancgccaccctctcctgcagggccagtcagagtatgacagcaagttagcctggaccagcaagaaacctggaccagacctcccagactcgtcattctttgctacatctgccagggccacgtggcactcccagcctacgttccaggtggctagggtggtactgggaactagtagttcactttcacgacctatcagcagctgctagtctagagtntttgcttagtttatactgtcagtctaagtataatcgtactgtcccgttccgacggttccggaacgaaagggacctaaaggttggaaaactacgaaaacgttgttggtggctcggacaccttagttcgttcgttaacc

SEQ ID NO: 413322 - DNA, 684 bp, Homo sapiens
  misc_feature: GZ8MTXP01EO2SO.15.49.E05.1.454.CMB.2.raw
  modified_base (205)..(205): a, c, t, g, unknown or other
  modified_base (305)..(305): a, c, t, g, unknown or other
tcagtctacgtagccacgaccggtgctcgatttagagcgactagcaacacacaaagggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangcccaccctctcctgcagggccagtcagagtattgacagcaagttagcctggaccagcagaaacctggccagacctcccagactcgtcatctttgctacntctgccgagggccagtggcactcccagccctagttccaggtggcgtaggttcgggtactaggggcaggtacgtttccaacgtttcctaccgaacctattaccgacgccgaacggtccccgtaggcctaacggttccgttaaggtaaagtttactttttcgggactttaagtttttaacgtttacgttgtaccgtaaggtacttaaaggtttaaactaaacgttgtaacccggttccggtcccgttaacccggtaccgggtttacccggggaaacccgtaaagggggaacccgtaaaggggttacgaaaacttaacccggaaaacggttcttgggttaaccgggctaacggacctaccgttagttccgtttaacgtttcc

SEQ ID NO: 413323 - DNA, 561 bp, Homo sapiens
  misc_feature: GZ8MTXP01E46DF.15.49.E05.1.454.CMB.2.raw
  modified_base (206)..(206): a, c, t, g, unknown or other
  modified_base (414)..(414): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagcccacctgtctgtgtctccgaagggggaaangcccaccctctcctgcagggccagtcagagtatgacagcaagttgcctggtaccagcagaaacctggccagactcccagactcgtcattctttgctacatctgccagggccacgtggcactcccagcctacgttccaggtggcaggtgggtactggggaacagtagttcacttctacaacatcagcacgcctgctagtctagaacgtntttgacttagtttattacggtgtcaggtctaagtaatagtgtaactcggtccctacggacgttcggaaccgaaagggttaccgaaagggttaggaaaactacgaaaacgttacgttcggtggactcgacaccttatccttgttaacc

SEQ ID NO: 413324 - DNA, 578 bp, Homo sapiens
  misc_feature: GZ8MTXP01A5483.15.49.E05.1.454.CMB.2.raw
  modified_base (203)..(203): a, c, t, g, unknown or other
  modified_base (299)..(299): a, c, t, g, unknown or other
  modified_base (302)..(302): a, c, t, g, unknown or other
  modified_base (554)..(554): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangcccacctctcctgcagggccagtcagagtatgacagcaagttgcctggtaccagcagaacctggccagactcccagactcgtcatctttgctacntcngcccgagggcccacgtggcacgtccccgaagcccctacgtttcccgaaggttgggccgtaggtcgggggttaactggggaacaggtaagtttccatttcctcaacctatcagccagcctgctaggtctagaagtatttgacttagtttatacggttgtacgagtcctagtactaaagtcgtaacgtcggtccctccggtaaccgttcggaacccgtaaagggaccaaggttacgaaagttacaaacggttcnggtaagctgaccacgatcttgtcc

SEQ ID NO: 413325 - DNA, 616 bp, Homo sapiens
  misc_feature: GZ8MTXP01AXOO4.15.49.E05.1.454.CMB.2.raw
  modified_base (205)..(205): a, c, t, g, unknown or other
  modified_base (308)..(308): a, c, t, g, unknown or other
  modified_base (442)..(442): a, c, t, g, unknown or other
tcagtctacgtagccacgaccggtgctcgatttagagcgactagcaacacacaaagggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangcccaccctctcctgcagggccagtcagagtattgacagctaagttgcctaggtaccagcagaacctggaccagacctcccagactcgtcattctttgctacntcgcgccgagggccacgtggcactcccagcctacgttcaggtggcaggtcggtacgagggaacagtacgttcacttcctacaccgtactacgacggactacggtcctagacgtacggttacgtaggtaaagttnttttacgacgtttaagtttttaacttacggttgtaccgtagtacgttaaagtacttaagtacgtacgtcggtcccgtaccggtacggttaccgggaaccgaaacgggttaccgaaaggttacgggaaactacgaaacgttgttcggtcgacgtcgacaccttattcgttgttcc

SEQ ID NO: 413326 - DNA, 620 bp, Homo sapiens
  misc_feature: GZ8MTXP01AKT3Q.15.49.E05.1.454.CMB.2.raw
  modified_base (204)..(204): a, c, t, g, unknown or other
  modified_base (303)..(303): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagagtatgacagcaagttgcctggtaccagcaagaacctggccagactcccagacctcgtcattctttgctacnctctcgaccgacgggccacgtggaccactcccgacgtcccgtaacgttcgaggtggccgtaggtggggtaccgtagggaactagggtactttcgactttccacgaacctatcaggtccaggccctagctaagtctaaggtaagttgtttacgacttaagttttactaacggtgtacgtagtactaggttaatagtacgtacgtcgtccccgttacgtccgggttacggaaccggtaacgggttaccgtaaagggttaccgtaaagacccgttaaaggttaccgttggtcggctcggaccacttgtccttcgttaacc

SEQ ID NO: 413327 - DNA, 545 bp, Homo sapiens
  misc_feature: GZ8MTXP01CRAX8.15.49.E05.1.454.CMB.2.raw
  modified_base (203)..(203): a, c, t, g, unknown or other
  modified_base (359)..(359): a, c, t, g, unknown or other
  modified_base (386)..(386): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtatgacagcaagttgcctggtaccagcagaacctggccagctccagactcgtcatctttgctacatctgccagggccatggcatcccagccacgttcagtgcaggtggtctgggcagtgttcattcncacatcagcagcctgcagtctagagtntttgctagtttattacgtgtacagtacagttataatggacgttcgggtccctaccggtacggttcgggaaccgtaaaggggaccctaaagggttaggaaaacttcgaaaaccggttacgttggttcggacttcggcctaccttattccgttcgttaacc

SEQ ID NO: 413328 - DNA, 620 bp, Homo sapiens
  misc_feature: GZ8MTXP01AC0O3.15.49.E05.1.454.CMB.2.raw
  modified_base (207)..(207): a, c, t, g, unknown or other
  modified_base (265)..(265): a, c, t, g, unknown or other
  modified_base (312)..(312): a, c, t, g, unknown or other
  modified_base (467)..(467): a, c, t, g, unknown or other
tcagtctacgtagccacgaccggtgctcgatttagagcgactagcaacacacaaagggggggaactgctcagttaggacccagacggaaccatggaagccccagcgcagcttctcttcctcctgctactctggctcccagataccactggagaaatagtaatgacgcagtctccagcccaccctgtctgtgtctccgagggggaaangcccaccctctcctgccaggggccagtcagagtattgacagcaagttagcctggaccngcaagaacctggcccagacctcccaagacctcgtcattcttgctacntctgccagggccacgtggcactcccagcctacgtcagtggcaggtcggtacgtaggggaacagggtacgtttcaagtttccacaaccgtatcgaagtccaacggtccctaggaccgtagtcttagtaacgttattttcggacttagtttttaacncggttggtccaaggtactaaaggttactaagtcgtaccgttcggtcccctaccggtacgttcccgggaacgaaacggggacctaagggttacgtaaaacttacgaaacgttaccgttggtaacgcgtcgaccaccgttatccgttaagttccc

SEQ ID NO: 413329 - DNA, 597 bp, Homo sapiens
  misc_feature: GZ8MTXP01BNYZU.15.49.E05.1.454.CMB.2.raw
  modified_base (205)..(205): a, c, t, g, unknown or other
  modified_base (291)..(291): a, c, t, g, unknown or other
  modified_base (306)..(306): a, c, t, g, unknown or other
  modified_base (574)..(574): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagcccaccctgtctgtgtctccgaggggaaangcccaccctctcctgcagggccagtcagagtattgacagcaagttgcctggtaccagcagaacctggccagcctcccagactcgtnattctttgcctacgntctgccgaggggcccacgtggccactcccgagtccctacgttcgaggtggctagggtcgggtcgtggggaactaggtacgttcactttccacgaacctatcagcacgtcctgctagtcgtagtaacgttatttcgacttagtttactacggtgtacgtagtactagttactaaagtcggtaccgttcggcccgttaccggtaccggttccggaacggtaacgggaccgtaaagggttacggaaactaacgaaacggttcttaggcgtntcgactacttactcgttcgttcc

SEQ ID NO: 413330 - DNA, 738 bp, Homo sapiens
  misc_feature: GZ8MTXP01AH5K4.15.49.E05.1.454.CMB.2.raw
  modified_base (205)..(205): a, c, t, g, unknown or other
  modified_base (279)..(279): a, c, t, g, unknown or other
  modified_base (328)..(328): a, c, t, g, unknown or other
  modified_base (704)..(704): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaaggggaaancgcccaccccttctcctgccgagggccagtcagagtattgacagctaagttcgcctagtacagcaacgtaaccnggaccagacctcccgagtacctcgtactactttctttcgacctaacgtntccgtcggcccgtaaccggggtccctaacgttcggcctaccgttaccccgaagtcccgtacgttcccgaggtcggagtagggtggggtacgtagggaactgggtacttcgtacttcctacaacttacgtcgaacgtcacggtcccgtcgtacgttaacggttacgttaggttaaagtttacgtttttagaacctttaaggtttttaaactttacggtacgttacgtaacgtaacggttaaattaaccgttaaagtccggttacccggtccgggttcccgttacccggggtacccggtttaccgggaaaccgggttaacggaaacccggttaagggaacggtaaaaccttaacgggaaacgtttgcgttaaccgggntaacggtacctacgttattcccgttgtttaaccc

SEQ ID NO: 413331 - DNA, 509 bp, Homo sapiens
  misc_feature: GZ8MTXP01A7WUL.15.49.E05.1.454.CMB.2.raw
  modified_base (203)..(203): a, c, t, g, unknown or other
  modified_base (249)..(249): a, c, t, g, unknown or other
  modified_base (346)..(346): a, c, t, g, unknown or other
  modified_base (365)..(365): a, c, t, g, unknown or other
  modified_base (393)..(393): a, c, t, g, unknown or other
  modified_base (395)..(395): a, c, t, g, unknown or other
  modified_base (406)..(406): a, c, t, g, unknown or other
  modified_base (410)..(410): a, c, t, g, unknown or other
  modified_base (412)..(412): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctccagataccactggagaaatagtaatgacgcagtctccagccaccctgtctgtgtctccagggggaaangccaccctctcctgccagggccagtcagagtattgacagcaagttncctgtacagcagaacctgccagactcccagactcgtcaatctttgctacatctgccagggccactggcatcccagccacgttccagtggcagtggtntgggcagagttccaattcncacatcagcagcctgcagtctgagattntnattattaattntcananatatatagactcgtctacgtacgtcgaacgaacggaacgaacggttaaggaaagtaacaaacgaaacgttacgtaagcgtcgcacactcgttcgtcg

SEQ ID NO: 413332 - DNA, 607 bp, Homo sapiens
  misc_feature: GZ8MTXP01DKJLQ.15.49.E05.1.454.CMB.2.raw
  modified_base (207)..(207): a, c, t, g, unknown or other
  modified_base (220)..(220): a, c, t, g, unknown or other
  modified_base (300)..(300): a, c, t, g, unknown or other
  modified_base (375)..(375): a, c, t, g, unknown or other
  modified_base (462)..(462): a, c, t, g, unknown or other
  modified_base (468)..(468): a, c, t, g, unknown or other
tcagtctacgtagccacgaccggtgctcgatttagagcgactagcaacacacaaagggggggaactgctcagttaggacccagacggaaccatggaagccccagcgcagcttctcttcctcctgctactctggctcccagataccactggagaaatagtaatgacgcagtctccagcccaccctgtctggtgtctccgaggggaaanagcccacccttcncctgcagggccagtcagagtatgacagcaagttagcctaggtaccaggacaagaaacctggaccagacctccagactcgnattcttgctacatcgtgccgagggcccagtcggcctatccccagccacgttccaggtggcgaggtggggttaacnggggaacagggtacgttctagtttccacacctatcccaagctacgccttggctaggtctagaacgttatttcgacttagtttacttntcgttnaagctaaatgtaaagtcggaccgttcgaccgtccggtaacggtcggaaccggaaacgggttacgaaaggggttacgtaaaacgaacgttaaaccgacgttggttcggaccttcgggtacaacccttagttccttgttcc

SEQ ID NO: 413333 - DNA, 501 bp, Homo sapiens
  misc_feature: GZ8MTXP02F351G.15.49.E05.1.454.CMB.2.raw
  modified_base (202)..(202): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctcctgcagggccagtcagagtattgacagcaagttagcctggtaccagcagaaacctggccagactcccagactcgtcatctttgctacatctgccagggccacgtggcatcccagccacgttccagtggcaggtgggtctggggcagagttcattctcaccatcagcagcctgcagtctgaagtatttgctagtttatactgtcagcagtatatgactggcctcgacgttcggacaagggaccaaggtaggaaactcgaaaacgactaggtggactgcaccatctgtc

SEQ ID NO: 413334 - DNA, 508 bp, Homo sapiens
  misc_feature: GZ8MTXP02IEPAT.15.49.E05.1.454.CMB.2.raw
  modified_base (301)..(301): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtatgacagcaagttagcctggtaccagcagaaacctggccagactcccagactcgtcatctttgctacntctgccagggccactggcatccccagcccagttccagtggcaggtgggtctgggcagagttcattctcaccatcagcagcctgcagtctgaagtatttgctagtttattactgttcagcagtataatgactggcctcgacgttcgaccgaaggaccaaggtacggaaactcgaaaacgtaactgtaaggctcgacaccatctcgttc

SEQ ID NO: 413335 - DNA, 525 bp, Homo sapiens
  misc_feature: GZ8MTXP02II8LN.15.49.E05.1.454.CMB.2.raw
  modified_base (201)..(201): a, c, t, g, unknown or other
  modified_base (355)..(355): a, c, t, g, unknown or other
tcagtctacgtagccacgaccggtgctcgatttagagcgactagcaacacacaaaggggaactgctcagttaggacccagacggaaccatggaagccccagcgcagcttctcttcctcctgctactctggctcccagataccactggagaaatagtaatgacgcagtctccagccaccctgtctgtgtctccgggggaaanagccaccctctcctgcagggccagtcagagagttgccgccagtttagcctggtaccaacagaaacctggccagcctccaggctcctcatctatgctgcatccattaggacactggtatcccagccaggttcagtggccagtggtctggcacagngttcactctcaccatcagcagcccgcagtctagagtactttgctagttatactgtacagactaatataacgaagtcggtacctattctaacgtttccggacccaaggggaacctaaaaggtggaatactaacaaacgtactacgtgctaagcactatctcgtcttactac

SEQ ID NO: 413336 - DNA, 517 bp, Homo sapiens
  misc_feature: GZ8MTXP02IU9PA.15.49.E05.1.454.CMB.2.raw
  modified_base (201)..(201): a, c, t, g, unknown or other
  modified_base (210)..(210): a, c, t, g, unknown or other
  modified_base (372)..(372): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaangccaccctntcctgcagggccagtcagagtattgacagcaagttagcctggtaccagcagaaacctggccagactcccagacctcgtcatctttgctacatctgccagggccacgtggcatccccagccacgttccagtggcaggtggtctgggacagtagttcatttccncaccatcagcagcctgcagtctgaagtatttgctagtttattactgttcagctagtatatgacgtgcctccgacgttcggaccgaagggaccaaggtacggaaactacgaaaacgtaactgtaagctacgacaccatctagttac

SEQ ID NO: 413337 - DNA, 523 bp, Homo sapiens
  misc_feature: GZ8MTXP02FR0JY.15.49.E05.1.454.CMB.2.raw
  modified_base (405)..(405): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcaagaaacctggccagacctcccagactcgtcatctttgctacatctgccagggccacgtggcactccccagccctacgttccagtggcaggtgggtctggggcagagttcattctcacatcagcagcctgcagtctagaagtntttgcttagtttatactgtcagctagtatagtgactggcctaccgacgttcggactaaagggaccaagggtaggaaactacgaaaacgtacgtgtaaggctacgacaccatcctgttc

SEQ ID NO: 413338 - DNA, 509 bp, Homo sapiens
  misc_feature: GZ8MTXP02JI420.15.49.E05.1.454.CMB.2.raw
  modified_base (203)..(203): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaagngccaccctctcctgcagggccagtcagagtattgacagcaagttagcctggtaccagcagaaacctggccagactcccagactcgtcatctttgctacatctgccagggccactggcatcccagccacgttccagtggcagtgggtctgggcagagttcattctcaccatcagcagcctgcagtctgaagtatttgctagtttattactgttcagcagcataatgactggacctcgacgttcggacccaagggacccaaaggttggaaactcgaaacgaacgtgtaggctacggctaccatcttcg

SEQ ID NO: 413339 - DNA, 491 bp, Homo sapiens
  misc_feature: GZ8MTXP02IHX6U.15.49.E05.1.454.CMB.2.raw
  modified_base (203)..(203): a, c, t, g, unknown or other
  modified_base (354)..(354): a, c, t, g, unknown or other
  modified_base (365)..(365): a, c, t, g, unknown or other
  modified_base (489)..(489): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaagngccaccctctcctgcagggccagtcagagtattgacagcaagttagcctggtaccagcagaaacctggccagactcccagactcgtcatctttgctacatctgcagggccactggcatcccagccacgttccagtggcagtggtctgggcngagttcattcncacatcagcagcctgcagtctgaagtatttgctagtttattactgtcagcagtatatgactggcctcgacgttcgacaagggacaaggtagaaactcgaaaacgactgtgctacgcacatcgtntc

SEQ ID NO: 413340 - DNA, 580 bp, Homo sapiens
  misc_feature: GZ8MTXP02JV8MQ.15.49.E05.1.454.CMB.2.raw
  modified_base (370)..(370): a, c, t, g, unknown or other
  modified_base (391)..(391): a, c, t, g, unknown or other
  modified_base (399)..(399): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccgaggggaaagagccaccctctcctgcagggccagtcagagtattgacagcaagttagcctggtaccagcagaaacctggccagactcccagactcgtcatctttgctacatctgccagggccactggcatcccagccacgttccaggtggcaggtgggtctgggcagagttcattcncacatcagcagcctgcagtcngaaagttntttgacttaagtttattagttgtacagtactaagttaataagtgtacgtcgggtacccttaccgggtacggttccggaaccggaaaacggggtaaccgtaaaaggggtaacggaaaactaaccgaaaacggtaacgttgggtaacggtaccgtacgacctaacctacgttcgtacgttacc

SEQ ID NO: 413341 - DNA, 501 bp, Homo sapiens
  misc_feature: GZ8MTXP02J08PP.15.49.E05.1.454.CMB.2.raw
  modified_base (202)..(202): a, c, t, g, unknown or other
  modified_base (424)..(424): a, c, t, g, unknown or other
  modified_base (481)..(481): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctcctgcagggccagtcagagtattgacagcaagttagcctggtaccagcagaaacctggccagactcccagactcgtcatctttgctacatctgccagggccatggcatcccagccagttccagtgcagtggtctggggcagagttcattctcaccatcagcagcctgcagtctgaagattttgctagtttattactgtcagcagtataatnactggcctcgacgttcggccaagggaccaacggtaggaaactcaaaacgaacttagnggactcgcaccatctcgttc

SEQ ID NO: 413342 - DNA, 499 bp, Homo sapiens
  misc_feature: GZ8MTXP02HNNJF.15.49.E05.1.454.CMB.2.raw
  modified_base (356)..(356): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggcccatggcatcccagccacgttccagtgcagtgggtctggggcngagttcattctcaccatcagcagcctgcagtctgaagtatttgctagtttattactgttcagcagtataatgactggcctcgacgttcggacaagggaccaaaggtggaaactcgaaacgaactgtaagctgcaccatctgtc

SEQ ID NO: 413343 - DNA, 498 bp, Homo sapiens
  misc_feature: GZ8MTXP02F05ZK.15.49.E05.1.454.CMB.2.raw
  modified_base (201)..(201): a, c, t, g, unknown or other
  modified_base (390)..(390): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaanagccacctctcctgcagggccagtcagagtattgacagcaagttagcctggtaccagcagaaacctggccagactcccagactcgtcatctttgctacatctgccagggccactggcatcccagccagttccagtgcagtggtctgggcagagttcattctcaccatcagcagcctgcagtctgaagtntttgctagtttatactgtcagctagtataatgactggcctcgacgttcgaccaagggaccaaggtaggaaactacgaaaacgactagtggctgacacctatctgttcc

SEQ ID NO: 413344 - DNA, 511 bp, Homo sapiens
  misc_feature: GZ8MTXP02J2DDB.15.49.E05.1.454.CMB.2.raw
  modified_base (203)..(203): a, c, t, g, unknown or other
  modified_base (305)..(305): a, c, t, g, unknown or other
  modified_base (373)..(373): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcagaaacctggccagactcccagactcgtcatctttgctacatcngccagggccagtggcatcccagccacgttccagtggcaggtgggtctggggcaggtagttcatttccncaccatcagcagcctgcagtctgaagtatttgctagtttatactgtcagctagtatatgactggcctcgacgttcggaccaagggaccaaggtacgaaacgtcgaaaacggactggtaagctgaccacactctacgtc

SEQ ID NO: 413345 - DNA, 611 bp, Homo sapiens
  misc_feature: GZ8MTXP02JM2ZM.15.49.E05.1.454.CMB.2.raw
  modified_base (204)..(204): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangcccaccctctcctgcagggccagtcagagtattgacagctaagttacgcctggtaccagcaacgaacctggaccagacctcccagacctcgtcattctttgctacatctcgccgtagggcctacgtcggcactccccagccctaagttcccgaggtcggacgtagggttcgggtccgtaggggactaggtacgtttccatttccgacacctatcgacgacgacgccgtgaccgtagttcgtaggtaaagtttatttacggactttagtttacttacgttgtacagtctaagttataagtcgtacgtcggtcctaccggtacgttccggaccgtaaggggacctaaagggtacgaaactacgaaacgtagtacgtcggtctacggacctaccgtactcgtcgttacc

SEQ ID NO: 413346 - DNA, 717 bp, Homo sapiens
  misc_feature: GZ8MTXP02JLO4A.15.49.E05.1.454.CMB.2.raw
  modified_base (202)..(202): a, c, t, g, unknown or other
  modified_base (211)..(211): a, c, t, g, unknown or other
  modified_base (251)..(251): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctntcctgcagggccagtcagagtattgaacagactaagttcncgtacgtaccagcaacgaaccgtcggaccaacgtaccctacccgaagtaccttccgtactactttcgtttcgaccttaactacttccgtacgacccggtacgggacccctacggtcggacctaccctaccccgacgtcccctaacgttcccgtaggtcggacgtaggggttcggggtcgtacggggactagggttacgtttacctacgtttcccaccgaacctacgtaccgacgaccgaccgtcccgttaggacccttaacgttccgtaaggtaaacggtttttgtttacgtacgttttaagtttacttacgttcgtacgagtacgtaaagttaatacgtcgtaccgtccgtacccgtaccggtaccgtaccggaaccggaaacgggtaaaccggtaaagggtaacgtaaactaaccggaaaacgtacgtaggtaacgcgtacgacctactacgttcgtacgttcc

SEQ ID NO: 413347 - DNA, 497 bp, Homo sapiens
  misc_feature: GZ8MTXP02FYISL.15.49.E05.1.454.CMB.2.raw
  modified_base (203)..(203): a, c, t, g, unknown or other
  modified_base (395)..(395): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcagaaacctggccagactcccagactcgtcatctttgctacatctgccagggccactggcatcccagccacgttccagtgcagtgggtctggggcagagttcattctcaccatcagcagcctgcagtctgaagtntttgctagtttatactgtcagctagtataatgacgtggcctcgacgtcgacgaggacaggtagaaactcgaaaacgacgtgtgctacgacacctatcgtgtc

SEQ ID NO: 413348 - DNA, 505 bp, Homo sapiens
  misc_feature: GZ8MTXP02JQ0YF.15.49.E05.1.454.CMB.2.raw
  modified_base (351)..(351): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttccagtgcaggtgggtcngggcagtagttcattctcaccatcagcagcctgcagtctagaagtatttgcttagtttattactgtcagctagtataatgactggcctcgacgttcggaccaagggaccaagggtgaaactacgaaacgactgtggctacgcacctatctcgtc

SEQ ID NO: 413349 - DNA, 539 bp, Homo sapiens
  misc_feature: GZ8MTXP02GWNGV.15.49.E05.1.454.CMB.2.raw
  modified_base (203)..(203): a, c, t, g, unknown or other
  modified_base (290)..(290): a, c, t, g, unknown or other
  modified_base (361)..(361): a, c, t, g, unknown or other
  modified_base (370)..(370): a, c, t, g, unknown or other
  modified_base (376)..(376): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggaccagcagaaacctggccagacctcccagactcgtnatctttgctacatctgccagggccacgtggcatccccagcctagttccagtggcaggtgggctgggacagngttcattcncaaccntcagcagcctgctagtctagaagtatttgactttagtttattactgtcagctaagtaataatgactcggcccttacgacgttcggacgaacgggacctaaagggtaggaaaactacgaaaacgtacttaggaacggctacggacctactactcttacgtttcc

SEQ ID NO: 413350 - DNA, 571 bp, Homo sapiens
  misc_feature: GZ8MTXP02IPR87.15.49.E05.1.454.CMB.2.raw
  modified_base (202)..(202): a, c, t, g, unknown or other
  modified_base (409)..(409): a, c, t, g, unknown or other
  modified_base (433)..(433): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaangccacctctcctgcagggccagtcagagtatgacagcaagttagcctggtaccagacaagaaacctggaccagacctcccagactcgtcattctttgctacatctgccagggccacgtggccactcccagccagttcccagtgcaggtgggtctggggacagtagttcattctacaccatcagcacgcctgctagtctagaaagttntttgattaagtttattacgtgtanagtataagtaataagtagtacgtcgtacctacggtacgttaccggaaccgaaacgggacgtaaagggtaacgtaaaactacgaaaaccgtacgttaggtaacggtactacgacctaaccgtacttaccgttacgttac

SEQ ID NO: 413351 - DNA, 583 bp, Homo sapiens
  misc_feature: GZ8MTXP02GZ6KL.15.49.E05.1.454.CMB.2.raw
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaagagccaccctctcctgcagggccagtcagagtattgacagcaagttagcctggtaccagcagaaacctggccagacctcccagactcgtcatctttgctacatctgccagggccacgtggcactccccagcctacgttccagtcggcaggtgggtctgggactaggtagttcattcctacaccatcagcagcctgctagtctagtaagtatttgacttagtttacttactgttacagtactaagttataagtcgtactcgggtcccttaccggtacggttacggacccgtaaacggggacctaaagggttacggaaaactaccgaaaacgtaacgtaggtaacggacgtacggacctaccgtacttccgttcggtttacc

SEQ ID NO: 413352 - DNA, 554 bp, Homo sapiens
  misc_feature: GZ8MTXP02JBLD3.15.49.E05.1.454.CMB.2.raw
  modified_base (204)..(204): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagagtattgacagcaagttagcctggtaccagcagaaacctggccagacctcccagactcgtcatctttgctacatctgccagggccagtggcactcccagcctacgttccagtggcaggtcgggtctggggacaggtagttcattcctacaccatcagcagcctagcctagtctagaagtattttgcttaagtttacttactgttacagtctagttaatagtagacgtggcccttacgacggttccggaccgaacggggacctaagggtacggaaactacgaaaacgtacgtaggtcggactacgacacctactcgtcgttacc

SEQ ID NO: 413353 - DNA, 573 bp, Homo sapiens
  misc_feature: GZ8MTXP02FSIS8.15.49.E05.1.454.CMB.2.raw
  modified_base (205)..(205): a, c, t, g, unknown or other
  modified_base (408)..(408): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagcccaccctgtctgtgtctccgaggggaaangccaccctctcctgcagggccagtcagagtattgacagcaagttagcctggtaccagcaagaaacctggccagactcccagactcgtcatctttgctacatctgccagggccacgtggctactccccagcccacgttccagtggcaggtgggtctggggacaggagttcattcacaccatcagcagcctgcagtctagaagtntttgcttagtttattacgtgtacagtactaagtaattaaagtgtacgtcgggccctaccggtacggttccgggaacccgtaaaacggggaacctaaaggggtacggaaaacttaccgaaaaacgtacgtaggtaaggtctacgaccaacctattccgtgttaccc

SEQ ID NO: 413354 - DNA, 499 bp, Homo sapiens
  misc_feature: GZ8MTXP02HPEZS.15.49.E05.1.454.CMB.2.raw
  modified_base (201)..(201): a, c, t, g, unknown or other
  modified_base (480)..(480): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaanagccaccctctcctgcagggccagtcagagtattgacagcaagttagcctggtaccagcagaaacctggccagactcccagactcgtcatctttgctacatctgccagggccatggcatcccagccacgttccagtggcagtgggctggggcagagttcagttctcaccatcagcagcctgcagtctgaagtatttgctagtttattactgttcagctagtataaatgaactggcctcgacgttcggacaagggccaaaggtggaaactcaaacgtacngtggctagcacatctgttc

SEQ ID NO: 413355 - DNA, 505 bp, Homo sapiens
  misc_feature: GZ8MTXP02JYB5U.15.49.E05.1.454.CMB.2.raw
  modified_base (367)..(367): a, c, t, g, unknown or other
  modified_base (422)..(422): a, c, t, g, unknown or other
  modified_base (500)..(500): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagacctcccagactcgtcatctttgctacatctgccagggccactggcatcccagccacgttccagtgcaggtggctgggcagagttcattcncaccatcagcagcctgcagtctagaagtatttgactagtttattacgtgtacagntagtaatatgactggcctcgacgttcggaccgaagggaccaaggtagaaactacgaaacgactgaagctgcacactcncgttc

SEQ ID NO: 413356 - DNA, 501 bp, Homo sapiens
  misc_feature: GZ8MTXP02J0JL1.15.49.E05.1.454.CMB.2.raw
  modified_base (203)..(203): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctcctgcagggccagtcagagtattgacagcaagttagcctggtaccagcagaacctggccagactcccagactcgtcatctttgctacatctgccagggccagtggcatccccagcccacgttccagtggcaggtgggtctggggcaggagttcattctcaccatcagcagcctgcagtctagaagtatttgctagtttattactgtcagcagtatatgactggcctcgacgttcggaccaagggaccaggtagaaactacaaacgactgtgctcgcacgatctagtc

SEQ ID NO: 413357 - DNA, 566 bp, Homo sapiens
  misc_feature: GZ8MTXP02JTHAA.15.49.E05.1.454.CMB.2.raw
  modified_base (204)..(204): a, c, t, g, unknown or other
  modified_base (371)..(371): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagagtattgacagcaagttagcctggtaccagcagaacctggccagacctcccagactcgcattctttgctacatctgccagggcccagtggaccactccccgagcccacgttccagtcggctagggttgggtctggggacnggtagttcatttcacacctatcagcagcctgcagtctagtaagttatttgacttagtttattacgtgtcagctaagtataagtcgtacgtcggcccttaccggtacgttccggaccgtaaagggacccgtaagggtacgaaactacgaaaacgtaacgtggtaacggactacgaccacctagttccgtacgttcc

SEQ ID NO: 413358 - DNA, 591 bp, Homo sapiens
  misc_feature: GZ8MTXP02GY5KQ.15.49.E05.1.454.CMB.2.raw
  modified_base (202)..(202): a, c, t, g, unknown or other
  modified_base (212)..(212): a, c, t, g, unknown or other
  modified_base (392)..(392): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctntcctgcagggccagtcagagtattgacagcaagttagcctggtaccagcaagaaacctggccagacctcccagacctcgtcattctttgctacatctcgccagggccacgtcggcactcccagccctacgttccaggtcgcgaggtcggggtctggggacagtagtttcattccacaccntcagcacgcctgcagtctagtaagttatttgctttagtttattacgtgtacagtctaagtaataagtgtacgtcgggtcccttaccggtacgtttccggaaccggaaacggggtaccgaaaggggttacggaaaacttaccgaaaaccggtagttacggtcggtacgtacggacctacgtacttcggtacgtttacccg

SEQ ID NO: 413359 - DNA, 542 bp, Homo sapiens
  misc_feature: GZ8MTXP02JQCPL.15.49.E05.1.454.CMB.2.raw
  modified_base (204)..(204): a, c, t, g, unknown or other
  modified_base (418)..(418): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaanagccaccctctcctgcagggccagtcagagtattgacagcaagttagcctggtaccagcagaaacctggccagacctcccagactcgtcatctttgctacatctgccagggccacgtggcactccccagccctacgttccaggtcggcagggtgggtctggggacaggtagttcagttcctacaccatccagccagcctgcagtctagtaagtntttgacttagtttattactgtcagtctagtataatgacgtcggccctacgtacgttcggacgaagggaccaaagggtacgaaactaccgaaaacgtacgtggtcgctacgaccacactctcgtc

SEQ ID NO: 413360 - DNA, 524 bp, Homo sapiens
  misc_feature: GZ8MTXP02HP015.15.49.E05.1.454.CMB.2.raw
  modified_base (203)..(203): a, c, t, g, unknown or other
  modified_base (213)..(213): a, c, t, g, unknown or other
  modified_base (366)..(366): a, c, t, g, unknown or other
  modified_base (415)..(415): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangcccaccctntcctgcagggccagtcagagtatgacagcaagttgcctggtaccagcagaacctggccagactcccagactcgtcatctttgctacatctgccagggccatggcatcccagccacgttccagtggcaggttggtctgggcagtagttcattcncacatcagcagcctgcagtctagacgtatttgctagtttattatgttanagactaagttataatgacgtggccctcggtacgttcggaccgtaaagggaccaaagggtacggaaactaacgaaacgaacgtggtcgctacgaccaccattctgttacc

SEQ ID NO: 413361 - DNA, 510 bp, Homo sapiens
  misc_feature: GZ8MTXP02I7AY6.15.49.E05.1.454.CMB.2.raw
  modified_base (201)..(201): a, c, t, g, unknown or other
  modified_base (299)..(299): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaanagccacctctcctgcagggccagtcagagtattgacagcaagttagcctggtaccagcagaacctggccagactcccagactcgtcatctttgctacntctgccagggccactggcatcccagccacgttccagtggcagtgggtctggggcagacgtttcatttcctacaccatcagcagcctgcagtctgaagtatttgctagtttattactgtcagctagtataatgactggcctcgacgttcggacagggaccaaggtaggaaatcgaaaacgtacgtagtcggctaggacacactcgtagttcc

SEQ ID NO: 413362 - DNA, 515 bp, Homo sapiens
  misc_feature: GZ8MTXP02HBDLM.15.49.E05.1.454.CMB.2.raw
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccacgtggcactcccagcctagttccagtggcaggtgggtctggggcagtagttcattctcaccatcagcagcctgcagtctagtaagtatttgacttagtttattactgtcagtctagtataatgactggcctcgacgttcggacgaagggaccaaggtagaaactacgaaaacgacgtgtcgctcgacaccatctagttc

SEQ ID NO: 413363 - DNA, 516 bp, Homo sapiens
  misc_feature: GZ8MTXP02JXV1J.15.49.E05.1.454.CMB.2.raw
  modified_base (204)..(204): a, c, t, g, unknown or other
  modified_base (398)..(398): a, c, t, g, unknown or other
  modified_base (506)..(506): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagngccaccctctcctgcagggccagtcagagtatgacagcaagttgcctggtaccagcagaaacctggccagactcccagactcgtcatctttgctacatctgccagggccacgtggcatcccagcccacgttccagtggcaggtgggtctgggcagagttcattctcaccatcagcacgcctgcagtctgaagtntttagctagtttattactgtcagctagtataagtgacgttgcctccgacgttcggactaacgggaccaaggtagaaactacgaaacgtaacgtgaaggctaggcaacnctactcgttc

SEQ ID NO: 413364 - DNA, 567 bp, Homo sapiens
  misc_feature: GZ8MTXP02ILOBQ.15.49.E05.1.454.CMB.2.raw
  modified_base (378)..(378): a, c, t, g, unknown or other
  modified_base (384)..(384): a, c, t, g, unknown or other
  modified_base (387)..(387): a, c, t, g, unknown or other
  modified_base (408)..(408): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccacgtggccatccccagcccacgttccagtggcaggtggggtctggggacagagtttcattccncacctntcngcagcctgcagtctagaagtntttgacttagtttattacgtgttacagtctaagttataatgtacgtcggtaccctcggacgttcggaccgaaacggggtaccaaagggttacggaaaacgttaccgaaaaacgtacgttaggaacggtactacggaccaaccgtattccgtagtttccc

SEQ ID NO: 413365 - DNA, 516 bp, Homo sapiens
  misc_feature: GZ8MTXP02H960U.15.49.E05.1.454.CMB.2.raw
  modified_base (202)..(202): a, c, t, g, unknown or other
  modified_base (298)..(298): a, c, t, g, unknown or other
  modified_base (349)..(349): a, c, t, g, unknown or other
  modified_base (361)..(361): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttgcctggtaccagcagaacctggccagactcccagactcgtcatctttgctanatctgccagggccagtgcatcccagccagtccagtgcaggtggtctgggcngtagttcattcncacatcagcagcctgctagtctagagtatttgactagtttattctgttcagtcagttataatgacgtgcctcgacgttcggacgaaagggaccaaaggtaggaaactacgaaaccgtagtaggtcggactacggactaaccgtactcgtcgtacc

SEQ ID NO: 413366 - DNA, 595 bp, Homo sapiens
  misc_feature: GZ8MTXP02HCQ7Z.15.49.E05.1.454.CMB.2.raw
  modified_base (440)..(440): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcgagggccagtcagagtattgacagcaagttagcctggtaccagcaagaaacctggaccagtacctcccagacctcgtcattctttgcttacattctcgccgacgggcccacgtggcacctccccacgccctacgttcccaggtcggacagggttcggggtctaggggacaggtagttccattcctcaacctatccgagcacgcctgctagtctagtaagttnttttgcttagtttacttactgttcagtactaagttataacttagacgtcgggcccttacggtacgttccgggaccgaaacggggtaccgaaacgggtaggaaaactacgaaaacgtacgtaggtcggacacggacaaccgtatccgtgtttaccc

SEQ ID NO: 413367 - DNA, 548 bp, Homo sapiens
  misc_feature: GZ8MTXP02HTJGO.15.49.E05.1.454.CMB.2.raw
  modified_base (370)..(370): a, c, t, g, unknown or other
  modified_base (399)..(399): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccatggcatcccagccacgttccagtggcaggtgggtctggggacaggagttcattcncaccatcagcagcctgcagtctgaagttntttgacttagtttattacttgttacagtactaagttaataagtgtacgtcggtccctaccggtacggttcggaccgtaaacgggaccgtaaggtacggaaactacgaaaacgtacgtggtaacggctacgaccactacttcgtacgttc

SEQ ID NO: 413368 - DNA, 518 bp, Homo sapiens
  misc_feature: GZ8MTXP02FRILN.15.49.E05.1.454.CMB.2.raw
  modified_base (203)..(203): a, c, t, g, unknown or other
  modified_base (303)..(303): a, c, t, g, unknown or other
  modified_base (494)..(494): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctcctgcagggccagtcagagtattgacagcaagttagcctggtaccagcagaaacctggccagactcccagactcgtcatctttgctacntctgccagggccactggcactccccagccacgttccagtgcaggtggggtctggggacagtagttcattctcaccatcagcagcctgcagtctagaagtatttgcttagtttatactgtcagacagtataagtgactcggcctccgacgttcgaccgaagggacaaggtacgaaactacgaaaacgactgnggctacgaccacgtatcgtgttcc

SEQ ID NO: 413369 - DNA, 518 bp, Homo sapiens
  misc_feature: GZ8MTXP02GNW0R.15.49.E05.1.454.CMB.2.raw
  modified_base (203)..(203): a, c, t, g, unknown or other
  modified_base (300)..(300): a, c, t, g, unknown or other
  modified_base (356)..(356): a, c, t, g, unknown or other
  modified_base (367)..(367): a, c, t, g, unknown or other
  modified_base (372)..(372): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttgcctggtaccagcagaacctggccagactcccagactcgtcatctttgctacntctgccagggccacgtggcatccccagcccagttccagtgcaggtgggtctgggcngagttcattcncaccntcagcacgctgcagtctgaacgtatttgcttagtttattactgtcagtctagtataatgactcggcctaccgtacgttccggacgtaacgggaccaaggtacgaactaccgaaacgtactgtaacggctagaccacactctgttcc

SEQ ID NO: 413370 - DNA, 514 bp, Homo sapiens
  misc_feature: GZ8MTXP02GJVS5.15.49.E05.1.454.CMB.2.raw
  modified_base (203)..(203): a, c, t, g, unknown or other
  modified_base (371)..(371): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttgcctggtaccagcagaaacctggccagactcccagactcgtcatctttgctacatctgccagggccactggcatcccagcccacgttccagtggcaggtgggtctggggacagagttcattccncaccatcagcagcctgcagtctgaagtatttgctagtttatactgtcagctagtataatgactggcctcgacgttcggaccgaagggtaccaagggtaggaaactcgaaaacgtactggtaaggctagacacctatcgtgtcc

SEQ ID NO: 413371 - DNA, 508 bp, Homo sapiens
  misc_feature: GZ8MTXP02FXE32.15.49.E05.1.454.CMB.2.raw
  modified_base (203)..(203): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcagaaacctggccagactcccagactcgtcatctttgctacatctgccagggccatggcatcccagccacgttcagtggcagtgggtctggggacagagttcattctcaccatcagcagcctgcagtctgaagtatttgctagtttattactgtcagcagtataatgactggcctcgacgttcggaccgaagggaccaaaggtaggaaactacgaaaacgacgtagtaaggctagacaccatctgttc

SEQ ID NO: 413372 - DNA, 561 bp, Homo sapiens
  misc_feature: GZ8MTXP02FW5C1.15.49.E05.1.454.CMB.2.raw
  modified_base (204)..(204): a, c, t, g, unknown or other
  modified_base (376)..(376): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaanagccaccctctcctgcagggccagtcagagtattgacagcaagttagcctggaccagcagaacctggccagactcccagactcgtcatctttgctacatctgccagggccacgtggcactccccagcccacgttccagtggcaggtgggtctggggcaggagtttcatttcncaccatcagcagcctgcagtctagaagtatttgcttagtttattactgtcagtctagtaataagtcgaacttgggccctaccggtacgtttaccgggaccgtaaaacggggacccaaaggggttacggaaaacttacgaaaacgtacgtaggtaacggcgtacgaccacctattcgtacgtttcc

SEQ ID NO: 413373 - DNA, 498 bp, Homo sapiens
  misc_feature: GZ8MTXP02JU6VN.15.49.E05.1.454.CMB.2.raw
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttccagtgcagtgggtctggggcagagttcattctcaccatcagcagcctgcagtctgaagtatttgctagtttattactgtcagcagtataatgactggcctcgacgttcgaccgaggaccaaggtgaaatcgaaacgaactgtggctacgacacactctcgttc

SEQ ID NO: 413374 - DNA, 529 bp, Homo sapiens
  misc_feature: GZ8MTXP02J1T64.15.49.E05.1.454.CMB.2.raw
  modified_base (204)..(204): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagngccaccctctcctgcagggccagtcagagtattgacagcaagttagcctggtacccagcagaaacctggccagactcccagactcgtcatctttgctacatctgccagggcccagtggcatcccagccacgttccagtgcagtggtctgggcagagttcattctcaccatcagcagcctgcagtcagaagtatttgactagtttactactgtcagtcaagttataagtgacgtcgccctcgtacgttcggaccgtaaacgggaccaaagggtagaaacgtacgaaaacgtacgtacgtggctacggacctacctatcgtcgttcc

SEQ ID NO: 413375 - DNA, 540 bp, Homo sapiens
  misc_feature: GZ8MTXP02I6HUW.15.49.E05.1.454.CMB.2.raw
  modified_base (383)..(383): a, c, t, g, unknown or other
  modified_base (410)..(410): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagagcccaccctctcctgcagggccagtcagagtattgacagcaagttagcctggtacccagcagaaacctggccagactcccagactcgtcatctttgctacatctgccagggcccactggcactcccagccacgttccagtggcaggtgggtctgggacagtagttccattcctcacctntcagcagcctgcctagtctagtaagtntttgcttagtttattactgttacagtacagtataagtgtacgtggcccgtacgtacgttccggacgtaagggaccgaaaggtaggaaactacgaaaacgacgtggcgtcgtacgaccacatcgtacgtcc

SEQ ID NO: 413376 - DNA, 520 bp, Homo sapiens
  misc_feature: GZ8MTXP02JGF50.15.49.E05.1.454.CMB.2.raw
  modified_base (203)..(203): a, c, t, g, unknown or other
  modified_base (212)..(212): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctntcctgcagggccagtcagagtattgacagcaagttagcctggtaccagcagaaacctggccagactcccagactcgtcatctttgctacatctgccagggccactggcatcccagccacgttccagtgcagtgggtctgggcagagttcattctcaccatcagcagcctgcagtctgaagtattttgcttagtttattacgtgttccagctagtattaagtgactcggccctcgacgttcggacctaaggggaccaagggtaggaaacttcgaaaacgacgtagtaaggctagccacgatcgtgttcc

SEQ ID NO: 413377 - DNA, 505 bp, Homo sapiens
  misc_feature: GZ8MTXP02JEEAI.15.49.E05.1.454.CMB.2.raw
  modified_base (203)..(203): a, c, t, g, unknown or other
  modified_base (485)..(485): a, c, t, g, unknown or other
  modified_base (488)..(488): a, c, t, g, unknown or other
  modified_base (498)..(498): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccacctctcctgcagggccagtcagagtattgacagcaagttgcctggtaccagcagaacctggaccagactcccagactcgtcatctttgctacatctgccagggccatggcactcccagccacgttccagtgcaggtcgggtctggggcagagttcattcacaccatcagcagcctgcagtctagaatatttgacttagtttattacgtgtacagctagttatatcgactggcctcgtacgttcggacgaagggaccaaaggtagaaactcgaaaacgntgngctcgacacntcgtgtc

SEQ ID NO: 413378 - DNA, 520 bp, Homo sapiens
  misc_feature: GZ8MTXP02HNWRU.15.49.E05.1.454.CMB.2.raw
  modified_base (203)..(203): a, c, t, g, unknown or other
  modified_base (395)..(395): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctcctgcagggccagtcagagtattgacagcaagttagcctggtaccagcagaaacctggccagactcccagactcgtcattctttgctacatctgccagggccatggcatcccagccacgttcagtgcaggtggtctgggacagattcattctcaccatcagcagcctgcagtctagaagtntttgctagtttattactgttcagctagtataatgactggcctccgtagttccggacgaacgggaccaagggtagaaaactacgaaacgtaactggtaacgcgtacgactaccactcgtacgttcc

SEQ ID NO: 413379 - DNA, 507 bp, Homo sapiens
  misc_feature: GZ8MTXP02JO1WX.15.49.E05.1.454.CMB.2.raw
  modified_base (203)..(203): a, c, t, g, unknown or other
  modified_base (413)..(413): a, c, t, g, unknown or other
  modified_base (487)..(487): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctcctgcagggccagtcagagtattgacagcaagttagcctggtaccagcagaaacctggccagactcccagactcgtcatctttgctacatctgccagggccactggcatcccagccagttccagtggcaggtgggtctggggacaggagtttcattctcaccatcagcagcctgcagtctagaagtatttgctagtttntactgtcagcagtataatgactcggcctcgacgttcggaccgaagggaccaaggtggaaacgtcaaaacgatgnggctggcaccatcgtgttac

SEQ ID NO: 413380 - DNA, 502 bp, Homo sapiens
  misc_feature: GZ8MTXP02GOF4U.15.49.E05.1.454.CMB.2.raw
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatccccagccacgttccagtgcagtgggtctgggcagagttcattcctcaccatcagcagcctgcagtctgaagtatttgctagtttatactgtcagcagtataagtgactggcctcgacgttcgcgagggaccaaggtgaaagtcgaaaacgacgtgaacgctacgacacagtctcgttc

SEQ ID NO: 413381 - DNA, 544 bp, Homo sapiens
  misc_feature: GZ8MTXP02H8WR7.15.49.E05.1.454.CMB.2.raw
  modified_base (377)..(377): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtatgacagcaagttagcctggtaccagcagaaacctggccagacctcccagactcgtcatctttgctacatctgccagggcccagtggcatccccagccacgttccagtggcaggtgggtctggggacaggtagttcatttccncaccatcagcagcctgcagtctgaagtatttgcttaagttttattactgtcagtcaagtatatgactcggcctaccgacggttccggaccgaaagggaccaaaggtacggaaaataccgaaaacgtacgtaggtcggctacggacctaccgtagttctacgtttacc

SEQ ID NO: 413382 - DNA, 535 bp, Homo sapiens
  misc_feature: GZ8MTXP02JGBKB.15.49.E05.1.454.CMB.2.raw
  modified_base (203)..(203): a, c, t, g, unknown or other
  modified_base (409)..(409): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctcctgcagggccagtcagagtattgacagcaagttagcctggtaccagcagaaacctggccagacctcccagactcgtcattctttgctacatctgccagggcccagtggcatcccagccacgttccagtggcaggtgggtctggggacaggtagttcattcctacacctatcagcacgcctgcagtctagaagtntttgcttagtttattactgtcagtcaagttataatgtactggccctacgacgttcggacaaacgggaccaaagggtagaaaactcgaaaacgtacgtgtaaggtctacgccacctatccgtagtcc

SEQ ID NO: 413383 - DNA, 508 bp, Homo sapiens
  misc_feature: GZ8MTXP02HFTIL.15.49.E05.1.454.CMB.2.raw
  modified_base (201)..(201): a, c, t, g, unknown or other
  modified_base (395)..(395): a, c, t, g, unknown or other
  modified_base (413)..(413): a, c, t, g, unknown or other
  modified_base (428)..(428): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaanagccaccctctcctgcagggccagtcagagtattgacagcaagttgcctggtaccagcagaaacctggccagactcccagactcgtcatctttgctacatctgccagggccactggcatcccagcctacgttccagtggcaggtgggctggggcagtagttcattctcacatcagcagcctgcagtcagaagtntttgcttagtttatactntcagctagtataatnactggcctcgacgttcggacaagggaccaaggtagaaatcgaaacgaactgaacggtctacggcaccgtatccgtagtcc

SEQ ID NO: 413384 - DNA, 495 bp, Homo sapiens
  misc_feature: GZ8MTXP02I8VTJ.15.49.E05.1.454.CMB.2.raw
  modified_base (353)..(353): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttccagtgcagtggctgggcngagttcattctcaccatcagcagcctgcagtctgaagtatttgctagtttattactgtcagctagtatatgactggcctcgacgttcgaccgaaggaccgaggtacggaaactcgaaaacgactagtggctgcacatctgtc

SEQ ID NO: 413385 - DNA, 578 bp, Homo sapiens
  misc_feature: GZ8MTXP02JVCGS.15.49.E05.1.454.CMB.2.raw
  modified_base (302)..(302): a, c, t, g, unknown or other
  modified_base (350)..(350): a, c, t, g, unknown or other
  modified_base (395)..(395): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaacctggccagactcccagactcgtcatctttgctacntctgccagggccacgtggcatcccagccagttccagtgcaggtggtcngggcagagttcattcacaccatcagcagcctgcagtctgaagttntttgacttagtttattacgtgtacagtactaagttaattaagtcgtacgttcggtacccgttaccggtaccggttccgggaaccggtaaaacggggaaccgtaaacggggtaacggtaaaacgtaaccgaaaaccggtaacgtaggtaacggctacggaccaaccgtacgtaccgttacgtcc

SEQ ID NO: 413386 - DNA, 562 bp, Homo sapiens
  misc_feature: GZ8MTXP02H5IT7.15.49.E05.1.454.CMB.2.raw
  modified_base (203)..(203): a, c, t, g, unknown or other
  modified_base (411)..(411): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaanagcccaccctctcctgcagggccagtcagagtattgacagcaagttagcctggtaccagcagaaacctggaccagacctcccagactcgtcatctttgctacatctgccagggccagtggcatccccagccacgttcccaggtcggcaggtgggtctggggacaggtattcatttccacaccatccagcagcctgcagtctagaagtnttttgactagtttattactgttacagtcaagttataaagtgacgtcggcccttaccgacggttccggaccgaaaaggggtacccgaaacggtaggaaaacgtaacgaaaacgtaacgtgtaacggctacggaccacacgtccttacgtacc

SEQ ID NO: 413387 - DNA, 600 bp, Homo sapiens
  misc_feature: GZ8MTXP02I0R90.15.49.E05.1.454.CMB.2.raw
  modified_base (203)..(203): a, c, t, g, unknown or other
  modified_base (371)..(371): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcagaaacctggccagacctcccagactcgtcatctttgctacatctgccagggccactggcactccccagccacgttccagtggcaggtgggtctgggcagagttcattcncaccatcagcagcctgcagtctagaagtattttgcttagtttattacgtgttcagtctaagttataaagttgtaacgttcggtcccttacccggtaaccggtttcccgggacccggtaaaacggggaacccgtaaaggggttaacggtaaaaacgttacccgaaaaacggtaaccgttagggtaacggtaccgtacggaccctaaccgtacttccgttacggtttaccc

SEQ ID NO: 413388 - DNA, 730 bp, Homo sapiens
  misc_feature: GZ8MTXP02G2Z76.15.49.E05.1.454.CMB.2.raw
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaagacgcccaccctctcctgcagggccagtcagagtattgacagcaagttagcctaggaccagcaagaaacctggaccagacctcccagacctcgtctattctttgctacatcgtcgccgagggccacgtcggcctactccccagccctagttcccgaggtcggacgtagggtcggggtacgtaggggactaggttacgttacctacgtttcccgtaccaacccgtagtaccgaacggcccgtaacgtccccgttaggacccgtaagtttacccgtaaggttaaacggttttacgttttacggtaccgttttaaagtttttaccgtttaccgttaggttaaccctaagggttacttaaaggttaaacttaaggtacggttacccgttccgggtacccccgttaccgggtaacgggttacccgggaacggtaaaaccggggtaccgtaaagggggtacgtaaaacgttaccgaaaacgtacgtagggtaacggtacctacggaccctaacgtacttccgttacgtttaccc

SEQ ID NO: 413389 - DNA, 543 bp, Homo sapiens
  misc_feature: GZ8MTXP02J3KUA.15.49.E05.1.454.CMB.2.raw
  modified_base (205)..(205): a, c, t, g, unknown or other
  modified_base (377)..(377): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagcccaccctgtctgtgtctccgaggggaaangcccacctctcctgcagggccagtcagagtattgacagctaagttgcctggtaccagcagaacctggccagacctcccagactcgtcattctttgctacatctgccgagggccagtggcactcccagccacgttcagtgcaggtcggtcgtggggacagtacgtttcattcncacatcagcacgcctgcctaggtctagtagtagttttgacttagtttattactgtcagctagtataatgacgtcggcctaccggtacggttcggaccgaacgggaccgaaagggtacgaaactacgaaacgtaacgtggtcggctacgaccaactctctcgtttcc

SEQ ID NO: 413390 - DNA, 517 bp, Homo sapiens
  misc_feature: GZ8MTXP02JXQRP.15.49.E05.1.454.CMB.2.raw
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagacctcccagactcgtcatctttgctacatctgccagggccactggcatcccagccacgttccagtgcaggtggtctggggcagagttcattctcacatcagcagcctgcagtctgaagtatttgctagtttattactgtcagcagtataatgactggcctcgtacgttcggaccaacgggaccaaggtacggaaactacgaaacgaacgtggtcggactacgacctacacgtctacgttcc

SEQ ID NO: 413391 - DNA, 501 bp, Homo sapiens
  misc_feature: GZ8MTXP02GJY90.15.49.E05.1.454.CMB.2.raw
  modified_base (203)..(203): a, c, t, g, unknown or other
  modified_base (359)..(359): a, c, t, g, unknown or other
  modified_base (368)..(368): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaanagcccaccctctcctgcagggccagtcagagtattgacagcaagttagcctggtaccagcagaaacctggccagactcccagactcgtcatctttgctacatctgccagggccactggcatcccagccacgttccagtgcagtgggtctgggcagngttcattcncacatcagcagcctgcagtctgaagtatttgcttagtttattactgtcagcagtataatgactggcctccgacgttcggactaagggaccaaggtagaaactcgaaaacgactgtgctcgcaccgatctgttc

SEQ ID NO: 413392 - DNA, 561 bp, Homo sapiens
  misc_feature: GZ8MTXP02IDRHZ.15.49.E05.1.454.CMB.2.raw
  modified_base (268)..(268): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtatgacagcaagttagcctggtaccagcagaaccnggccagactcccagactcgtcattctttgctacatctgccagggccacgtggcactcccagcccagttccagtgcaggtgggtctggggcagtagttcagttcctcactatcagcacgcctgcagtctagaagtatttgactagtttattactgttacagtctagtataagtagacgtcggccttaccgtacgttcggaccgtaaacgggaccgaaaggtacggaaaacttaccgaaaacgtaacgtggtaacggtaccgtaggaccctaaccgtacttaccgtttacgtccc

SEQ ID NO: 413393 - DNA, 770 bp, Homo sapiens
  misc_feature: GZ8MTXP02I9UIC.15.49.E05.1.454.CMB.2.raw
  modified_base (204)..(204): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaancgccaccctctcctgcacgggccagtcagtagtattgacagactaagttacgccgtaggtacccaggcaagaaacctggaccagacctcccagactcgtacattctttgactacattctcgccgtaacggggccctaccgtggacctacctaccccgacgcccgttaccggttaccctacgggttcgggactcggggttcggggttccgtaggggaccgtaggtacggtttactacgtttccaccaacctacgtaccgcgtaccgaacgtcccgtgtacccgtaggtttcctaagggaaaacgttttgtttaccgcggtttaaaattttttaaccgttaacgtttcgggtttacacggtaaccgtttaaaagtttaaacttaaagttcggtaacccgttcggggttaccccttaccggggtttaccccggttacggggaaaacccggtaaacgggggaaacccgttaaagggggttaaaacgaaacgttaaaccccgaaaaaggttcccgttaaggggtcgggtcctaacgggaccctaaaacggtctttaacgttcgtttaaccc

SEQ ID NO: 413394 - DNA, 537 bp, Homo sapiens
  misc_feature: GZ8MTXP02FTVGF.15.49.E05.1.454.CMB.2.raw
  modified_base (203)..(203): a, c, t, g, unknown or other
  modified_base (403)..(403): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcagaaacctggccagactcccagactcgtcatctttgctacatctgccagggccactggcatcccagccacgttccagtggcaggtgggtctgggacagtagttcactttcacaccatcagcacgcctgcacgtctagaagtnttttagcttaagtttattacgttgtcagtactagtataagtgacgtcggcctccgtacgttcggaccgaacgggaccgaaaggtagaaacgtacgaaaacgactaggtaaggctagaccacgtatcctagttac

SEQ ID NO: 413395 - DNA, 546 bp, Homo sapiens
  misc_feature: GZ8MTXP02INHIA.15.49.E05.1.454.CMB.2.raw
  modified_base (202)..(202): a, c, t, g, unknown or other
  modified_base (360)..(360): a, c, t, g, unknown or other
  modified_base (362)..(362): a, c, t, g, unknown or other
  modified_base (372)..(372): a, c, t, g, unknown or other
  modified_base (400)..(400): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaanagccaccctctcctgcagggccagtcagagtattgacagcaagttagcctggtaccagcagaaacctggccagactcccagactcgtcatctttgctacatctgccagggccacgtggcactcccagcctacgttccagtggaagtgggtctgggacngngttcattccncacatcagcacgctgcagtctgtaagtntttgactagtttattactgtcagtctagtataagtgactcggtccttccggtacggttcggaccgtaaacgggaccgtaaagggtacggaaaacgtacgaaaacgaacgttggtaggaacgtcgactacctatccgtgttccttac

SEQ ID NO: 413396 - DNA, 665 bp, Homo sapiens
  misc_feature: GZ8MTXP02JBSGK.15.49.E05.1.454.CMB.2.raw
  modified_base (204)..(204): a, c, t, g, unknown or other
  modified_base (309)..(309): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaanagccaccctctcctgcagggccagtcagagtattgacagctaagttagcctggtaccagcaagaaacctggaccagacctcccagacctcgtcatctttgctacntctgccagggccacgtggcactcccagccctacgttcagtggcgtaggttcgggtctggggactaggtacgtttcaacgtttccacaaccctataccgaacgccaacggtcccttggaccgtagttcctagggtaaattgttttacgctttaaagttttacttaaccgtggttaccaaggtacgtaaagttaagtaaacgttacggtacgttccgggtaccccgttaccgggtaaccggtttacccggggaaccgtaaaaccgggggtaaaccggtaaaggggttaaacgaaaaacgttaccgaaaaaccgtacgttgggtaacggctacgaccgactacgttccgttcgtttacc

SEQ ID NO: 413397 - DNA, 502 bp, Homo sapiens
  misc_feature: GZ8MTXP02JWCJN.15.49.E05.1.454.CMB.2.raw
  modified_base (202)..(202): a, c, t, g, unknown or other
  modified_base (391)..(391): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaanagccacctctcctgcagggccagtcagagtattgacagcaagttagcctggtaccagcagaaacctggccagactcccagactcgtcatctttgctacatctgccagggccactggcatcccagccacgttcccagtggcaggtggtctggggacagagttcattctcaccatcagcagcctgcagtcngaagattttgctagtttatactgtcagctagtataatgactggcctcgacgttcgcaagggaccaaggtggaaactacgaaaacgactgtaaggctgacaccatctagttc

SEQ ID NO: 413398 - DNA, 515 bp, Homo sapiens
  misc_feature: GZ8MTXP02FYNXQ.15.49.E05.1.454.CMB.2.raw
  modified_base (203)..(203): a, c, t, g, unknown or other
  modified_base (278)..(278): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctctgcagggccagtcagagtattgacagcaagttagcctggtaccagcagaaacctggccagacncccagactcgtcatctttgctacatctgccagggccactggcatccccagcccacgttccagtggcagtggggtctggggacagagttcattctcaccatcagcagcctgcagtctgaaagtattttgctagtttatactgtcagcagtataaatgactggccctccgacgttcggccgaagggaccgaaacggtaggaaagtacaaaacgaactagtggctcgcaccactctgttc

SEQ ID NO: 413399 - DNA, 563 bp, Homo sapiens
  misc_feature: GZ8MTXP02G7NHW.15.49.E05.1.454.CMB.2.raw
  modified_base (403)..(403): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaagagccaccctctcctgcagggccagtcagagtattgacagcaagttagcctggtaccagcagaaacctggccagactcccagactcgtcatctttgctacatctgccagggccactggcatccccagccacgttccagtggcaggtgggtctggggcaggtagttcatttccacaccatcagcagcctgctagtctgaagtnttttgcttagtttatactgtacagtactagtaataagtgtacgtcggcccttaccggtacgttccgggaccgtaacggggaaccgtaaacggggtaggaaaactacgaaaaccggtacgtaggtaacggcgtacggaccaacgtacttcgtacgtttccg

SEQ ID NO: 413400 - DNA, 542 bp, Homo sapiens
  misc_feature: GZ8MTXP02IC8BB.15.49.E05.1.454.CMB.2.raw
  modified_base (203)..(203): a, c, t, g, unknown or other
  modified_base (288)..(288): a, c, t, g, unknown or other
  modified_base (300)..(300): a, c, t, g, unknown or other
  modified_base (347)..(347): a, c, t, g, unknown or other
  modified_base (362)..(362): a, c, t, g, unknown or other
  modified_base (391)..(391): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaanagccacctctcctgcagggccagtcagagtatgacagcaagttagctggtaccagcagaacctggaccagactcccagactcgtnattctttgctanatctgccagggccagtggcatcccagccagttccagtgcagtggtcngggcagattcattcnaccagtcagcagcctagcagtcagaattnttgattagtttatactgtacagtatagtaataatagtacgtcgtaccgtaccgtaccgttacggtaccggaacggaaccggtaaacggtaaaggtaaacgtaacgaaacgtaaacgtagtaacgtacgtacgacgacgtactactacgtcg

SEQ ID NO: 413401 - DNA, 581 bp, Homo sapiens
  misc_feature: GZ8MTXP02FUQFT.15.49.E05.1.454.CMB.2.raw
  modified_base (204)..(204): a, c, t, g, unknown or other
  modified_base (379)..(379): a, c, t, g, unknown or other
  modified_base (408)..(408): a, c, t, g, unknown or other
  modified_base (430)..(430): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagagtattgacagcaagttagcctggtacccagcagaaacctggaccagactcccagactcgtcatctttgctacatctgccagggccacgtggcactcccagccacgttccagtcggcgtaggtgggtctggggacagtagttcattcncaccatcagcagcctgcagtctagaagtntttgcttaagtttatactgtanagtactagttaataagtgaacttcggaccccttacgggtaccgttccggaccggtaaacggggaccgtaaagggtaacggaaaacttacgaaaaaccggtaacgttaggtaaccgggtactacggaccctacctacgttccgtgtttaccc

SEQ ID NO: 413402 - DNA, 530 bp, Homo sapiens
  misc_feature: GZ8MTXP02GF0SI.15.49.E05.1.454.CMB.2.raw
  modified_base (202)..(202): a, c, t, g, unknown or other
  modified_base (211)..(211): a, c, t, g, unknown or other
  modified_base (370)..(370): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaangccaccctntcctgcagggccagtcagagtattgacagcaagttagcctggaccagcagaacctggccagactcccagactcgtcatctttgctacatctgccagggccactggcatcccagcccagttccagtggcaggtgggtctggggacaggtagttcattccncaccatcagcagcctgcagtcagaagtatttgctagtttatactgtcagtctagtataagtgactcggcctaccgtacgttccggacgaacgggaccaaagggtacgaaaactacgaaaacgtacgtaggtaaggctacgaccaccgtatctcgtttacc

SEQ ID NO: 413403 - DNA, 527 bp, Homo sapiens
  misc_feature: GZ8MTXP02GP5GM.15.49.E05.1.454.CMB.2.raw
  modified_base (203)..(203): a, c, t, g, unknown or other
  modified_base (368)..(368): a, c, t, g, unknown or other
  modified_base (397)..(397): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctcctgcagggccagtcagagtattgacagcaagttagcctggtaccagcagaaacctggccagacctcccagactcgtcatctttgctacatctgccagggccacgtggcatcccagccacgttcagtgcaggtggtctgggcagagttcattcncaccatcagcagcctgcagtctagaagtntttgcttagtttattactgtcagtcagtaatatgacgtcggcctccgacgttccggaccgaacgggacctaagggtacggaaactacgaaaacgaacgtgtcggtactacggaccacctatcgttagtcc

SEQ ID NO: 413404 - DNA, 625 bp, Homo sapiens
  misc_feature: GZ8MTXP02JFFFH.15.49.E05.1.454.CMB.2.raw
  modified_base (205)..(205): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaagngccaccctctcctgcagggccagtcagagtattgacagctaagttagcctggtaccagcaagaaacctggaccagacctcccagactcgtcatctttgctacatctgccaggccagtggcactcccagcctagtccagtggctaggtcggggtctggggactaggtagttctagttcctacaacctatcgacgcacgcctgctagtctagaacgttatttgactttaagtttacttacgtgtctaggactaagttaactaagttcgaacgttcggacccgttaccggtacggttacccgggaaccgtaaaacgggggaaccctaaaaggggttacgggaaaaaccttaccggaaaaaccggtaacgttgggaacgggtcccttaggaaccccgtaacctaacgtttccgtacgtttcccc

SEQ ID NO: 413405 - DNA, 656 bp, Homo sapiens
  misc_feature: GZ8MTXP02FS1AQ.15.49.E05.1.454.CMB.2.raw
  modified_base (202)..(202): a, c, t, g, unknown or other
  modified_base (215)..(215): a, c, t, g, unknown or other
  modified_base (234)..(234): a, c, t, g, unknown or other
  modified_base (236)..(236): a, c, t, g, unknown or other
  modified_base (238)..(238): a, c, t, g, unknown or other
  modified_base (247)..(247): a, c, t, g, unknown or other
  modified_base (256)..(256): a, c, t, g, unknown or other
  modified_base (371)..(371): a, c, t, g, unknown or other
tcagtctacgtagccacgaccggtgctcgatttagagcgactagcaacacacaaagggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctcctcngacgcggcatcgagtattntnangactagtcncgtacgacngcaaactacgcgacagcccacgagtactcgtacatttcgtgacctaactctcgtccgacggacggaccctacgggtcggacctaacccgtcccgacgtccccgttacgttaccgnggggtcgacgtggggttcggtcggtacgggacagggttacttctacttccaccactactacgacgacgaccgtccgtcgacgttacgtcgtaaggtaattttagtttacgacgtttaagttttacttacgttcgtacgtacggtagttaagtaaattagtacgtacggtccgtcccgtaccggtaccggttccgaaacggggtaacggaaaccggtaagggtaaacgtaaactaaccgaaaaccgtgtaggtcggtactacgacctaacgtctacgttactttcc

SEQ ID NO: 413406 - DNA, 507 bp, Homo sapiens
  misc_feature: GZ8MTXP02JY8G7.15.49.E05.1.454.CMB.2.raw
  modified_base (203)..(203): a, c, t, g, unknown or other
  modified_base (354)..(354): a, c, t, g, unknown or other
  modified_base (365)..(365): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcagaaacctggccagactcccagactcgtcatctttgctacatctgccagggccagtggcatcccagccacgttcagtgcaggtggtctgggcngagttcattcncacctatcagcagcctgcagtctgaagtatttgctagtttattactgtcagctagtataatgactggccctcgacgttcggaccaagggaccaaagggtacgaaactcgaaacgtaactgaacgctagcacactcgtgttcc

SEQ ID NO: 413407 - DNA, 593 bp, Homo sapiens
  misc_feature: GZ8MTXP02JDV8E.15.49.E05.1.454.CMB.2.raw
  modified_base (203)..(203): a, c, t, g, unknown or other
  modified_base (307)..(307): a, c, t, g, unknown or other
  modified_base (361)..(361): a, c, t, g, unknown or other
  modified_base (379)..(379): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcaagaaacctggaccagacctcccagacctcgtcattctttgctacntctgccagggccacgtggccactcccagcctacgttccagtgctaggtgggtcngggcagtagttcattccncaccatcagcacgctgcagtctagaagtatttgacttagtttatacgtgtacagtctaagttataagtcgtaaccgttcggacccgttaccgtaaccggtttaccgggacccgtaaaagggggaaccctaaaaggggttaacgaaaaacgttaccgaaaaacggtacgttgggtaacggacttacgacccaaccgtactaccgtttacgttccg

SEQ ID NO: 413408 - DNA, 591 bp, Homo sapiens
  misc_feature: GZ8MTXP02GH0DE.15.49.E05.1.454.CMB.2.raw
  modified_base (203)..(203): a, c, t, g, unknown or other
  modified_base (434)..(434): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctcctgcagggccagtcagagtattgacagcaagttgcctggtaccagcagaaacctggccagactcccagactcgtcatctttgctacatctgccagggccacgtggcactccccagccctacgttccagtcggctaggtgggtctaggggcaggtagttcattcctacaccatcagcagcctgcagtctagtaagtatttgacttagtttatactgttanagtctaagtaataagtgtaacgtcgggtccctaccggtaacggttccggaacccgtaaacggggacccgtaaaggggtaacggaaaacttaaccgaaaaacggtaacgtagggtaacggtaccgttacggacctaacccgtattcgttacgtttacc

SEQ ID NO: 413409 - DNA, 718 bp, Homo sapiens
  misc_feature: GZ8MTXP02JG7JS.15.49.E05.1.454.CMB.2.raw
  modified_base (205)..(205): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaagngccacccctctcctgcagggccagtcagagtattgacagcaagttagcctggtaccagcagaacctggaccagacctcccagactcgtcatctttgctacatctgccgagggcccagtggccactccccagccctacgttccaggtggcctagggttcgggtcgtggggaccgaggtacgtttccagtttcctaccaaccctatccgagaccacggtccctggtacagttccgtaagggtaaatttacgtttttagacttttaaaggtttttaactttacgttacggttacgtaacggttacctaaaggtttaaattaagttacggtaacccgtttcgggtacccccgttacccgggtaccgggtttaccccggggaacccggtaaaaccgggggtaacccggtaaagggggttaaacgggtaaaacgttaacccggaaaaaaccgggtaccgttaggggtaaccgggtacttaaccggaccgttaaccctaacgtttccgtcgttttacccg

SEQ ID NO: 413410 - DNA, 660 bp, Homo sapiens
  misc_feature: GZ8MTXP02JHZCI.15.49.E05.1.454.CMB.2.raw
  modified_base (293)..(293): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaagagccaccctctcctgcagggccagtcagagtattgacagcaagttagcctggtaccagcaagaaacctggaccagacctcccagactcgtnatctttgctacatctgccagggcccacgtggcatcccagccctacgttcagtggctaggtcgggtctggggacagtagttcaattcctacaaccctagtaccaggccaacggccccttaggccctaagttccctaggtaaacgttagtttttcggactttaaaggtttttatttaaccgttggttaccaaggtactaaagttaattaaagtgaacgttcggaccccttaccggtaccggtttccgggaaccgtaaaacgggggaacccgtaaacgggggttaaagaaaaacgttacccgaaaaaaccgtagttaccggttaagggaaaccttcggaacctaaacccgtatttcccgtaggtttcccc

SEQ ID NO: 413411 - DNA, 612 bp, Homo sapiens
  misc_feature: GZ8MTXP02JUVQZ.15.49.E05.1.454.CMB.2.raw
  modified_base (304)..(304): a, c, t, g, unknown or other
  modified_base (307)..(307): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaagagccaccctctcctgcagggccagtcagagtattgacagcaagttagcctggtaccagcagaaacctggccagactcccagactcgtcatctttgctacntcngccagggccacgtggcactcccagcctacgttccagtggcaggtgggtctggggacaggtagttcattcctacaccatacgagcacgccctggcctagttctaggtaagttatttcggactttagtttattacgtggtactagtactaagttaataagtcggtacgtcggtccccttacggtaccgttccggaaccggtaaacggggtaacccgtaaaggggttacggaaaacgttaccgaaaaaccggtacgttgggtaacggtaccgttacggaccctaccgtactttaccgtcgtttacccg

SEQ ID NO: 413412 - DNA, 610 bp, Homo sapiens
  misc_feature: GZ8MTXP02G70K8.15.49.E05.1.454.CMB.2.raw
  modified_base (202)..(202): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaangccaccctctcctgcagggccagtcagagtattgacagcaagttagcctggtaccagcagaacctggccagacctcccagactcgtcattctttgctacatctgccacgggccacgtggcactcccagccctacgttccagtggcaggtcgggtctggggacaggtagttccagtttcctaccaacattccaagccagccctgcagtctagtaacgttatttgacttagtttattccgtgtacagtactaagttataaagttcgacgttcggacccgttaccggtacggtttacccggaccggaaaacggggtacccgtaaagggttaacggaaaacgttaccgaaaacggtaccgttagggtaacggccgttacggaccctaccgtaacgttccgttacggtttccc

SEQ ID NO: 413413 - DNA, 729 bp, Homo sapiens
  misc_feature: GZ8MTXP02I22TX.15.49.E05.1.454.CMB.2.raw
  modified_base (201)..(201): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccacctgtctgtgtctccaggggaangccacctctcctgcagggccagtcagagtattgacagcaagttacgcctggtacccagcaagaaacctggaccagacctcccagacctcgtcatctttgctacatctgccgaggcctacgtggctactccccagccctacgttcccagtacggccaggttcggggtctggggacctagtacggtttccagtttccaccgaacctataccgacgccctacgtcccgttaggacctacggttccgtaaggtaaaaggttttacgttttacgacgtttttaaacgtttttaactttacggttacgtttaccgacggttacgttaaaagtttaaacgttaacggttaccgtaaccgggttaccggttaccccggttaaccgggttaaccggggtttacccgggaaaccgggtaaaacgggggtaaaccgtaaaacggggtaaacggtaaaacctaaccggtaaaaacggtacggttacgggtaacggtaaccgtacgtaaccgtaaccgttacgtttccgtttaccgtttac

SEQ ID NO: 413414 - DNA, 557 bp, Homo sapiens
  misc_feature: GZ8MTXP02H88JH.15.49.E05.1.454.CMB.2.raw
  modified_base (204)..(204): a, c, t, g, unknown or other
  modified_base (356)..(356): a, c, t, g, unknown or other
  modified_base (374)..(374): a, c, t, g, unknown or other
  modified_base (406)..(406): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagngccaccctctcctgcagggccagtcagagtattgacagctaagttagcctggtaccagcagaaacctggccagacctcccagactcgtcattctttgctacatctgccagggcccagtggcactcccagccacgtccagtcgcaggtggtcngggcagtagttcattccncactatcagcagcctgcctagtctagtaaatnttttgacttagttttacttacgtgtactagactaagtataagtgacgtcggtccctacgggacgtttaccggaccgtaaaaggggaccctaaagggtacgaaactacgaaaaccgtagtaggtcgcgtacggacaacgtctcgttacgtcc

SEQ ID NO: 413415 - DNA, 530 bp, Homo sapiens
  misc_feature: GZ8MTXP02J3D7U.15.49.E05.1.454.CMB.2.raw
  modified_base (203)..(203): a, c, t, g, unknown or other
  modified_base (212)..(212): a, c, t, g, unknown or other
  modified_base (379)..(379): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctntcctgcagggccagtcagagtattgacagctaagttgcctggtaccagcagaaaccctggccagacctcccagactcgtcatctttgcttacatcctgcccagggcccagtcggcactcccagccacgttccagtggcaggtgggtctggggcagagtttcatttcncaccatcagcagcctgcaggtctgaagtattttgctagtttattactgtcagctagtataatgacgtcgggcctccggtacgttcggaccaagggaccaagggtaggaaactacgaaacgaactgtaaggctacgcaccattctcgtttcc

SEQ ID NO: 413416 - DNA, 522 bp, Homo sapiens
  misc_feature: GZ8MTXP02JWIQF.15.49.E05.1.454.CMB.2.raw
  modified_base (203)..(203): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcagaacctggccagactcccagactcgtcatctttgctacatctgccagggccacgtggcatccccagccacgttccagtgcaggtgggtctggggacagagttcattctcaccatcagcagcctgcagtctgaagtatttgactagtttattactgtcagctagtatatgactggcctccgacgttccggaccgaagggaccaaagggtcggaaactacgaaaacgacgtagtaaggcgtagacctaccacgtactcgtcc

SEQ ID NO: 413417 - DNA, 633 bp, Homo sapiens
  misc_feature: GZ8MTXP02F0R39.15.49.E05.1.454.CMB.2.raw
  modified_base (204)..(204): a, c, t, g, unknown or other
  modified_base (403)..(403): a, c, t, g, unknown or other
  modified_base (441)..(441): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagagtattgacagcaagttagcctggtaccagcaagaaacctggccagacctcccagacctcgtcatctttgctacatctgccgagggccacgtggcactcccagccctacgttccaggtggctagggtcgggtcgttggggaccagtacgtttcctatttcctacaaaccctntaccgaagccacgcctaggctaggtcctagtaaagttnttttacgacttaagttttactacgttcgtacagtactaagttaactaagtcgtacgtcgggtccctaccggtcggttaccgggaccgtaaaggggaacccgtaaaggggtaacggaaaactaccgtaaaaacggtacgttacgggttaacggttcgaacctacctacggtttccttacggttacctttaccg

SEQ ID NO: 413418 - DNA, 514 bp, Homo sapiens
  misc_feature: GZ8MTXP02J23BL.15.49.E05.1.454.CMB.2.raw
  modified_base (204)..(204): a, c, t, g, unknown or other
  modified_base (362)..(362): a, c, t, g, unknown or other
  modified_base (511)..(511): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagagtattgacagcaagttagcctggtaccagcagaaacctggccagacctcccagactcgtcattctttgctacatctgccagggcccagtggcatccccagcccacgttccagtggcaggtggctggggcngtagttcattctcaccatcagcagctgcagtcagagtatttgcttagtttatactgtcagtcagtatatcgactggcctcgtacgtcggaccgaagggaccaagggtagaactacgaaaacgaacttggcggactcgaccaccatcgtntcc

SEQ ID NO: 413419 - DNA, 548 bp, Homo sapiens
  misc_feature: GZ8MTXP02JTPAQ.15.49.E05.1.454.CMB.2.raw
  modified_base (204)..(204): a, c, t, g, unknown or other
  modified_base (383)..(383): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagagtattgacagcaagttagcctggtaccagcagaaacctggccagactcccagactcgtcatctttgctacatctgccagggccactggcactccccagccctacgttcccaggtcggctaggtcgggtctggggacaggagtttcatttcncaccatcagcacgcctgcagtctagaagtatttgcttagtttattactgtacagtctagtatagtagactggccctacgtacgttcggaccgaacgggtaccgaacgggtagaaactacgaaaacgtacgtggtaacggtctacgacgacctacttcctagttcc

SEQ ID NO: 413420 - DNA, 631 bp, Homo sapiens
  misc_feature: GZ8MTXP02I502B.15.49.E05.1.454.CMB.2.raw
  modified_base (202)..(202): a, c, t, g, unknown or other
  modified_base (489)..(489): a, c, t, g, unknown or other
tcagtctacgtagccacgaccggtgctcgatttagagcgactagcaacacacaaaggggggaactgctcagctaggacccagacggaaccatggaagccccagcgcagcttctcttcctcctgctactctggctcccagataccactggagaaatagtaatgacgcagtctccagccaccctgtctgtgtctccgagggaancgccacctctcctgcgacgggccagtcagagttattgacgagactaagttacgccgtaggtaaccaggaccaacgtaaaccgtcggacccaacgaccctccccgaagtacctcgtacctatttccgtttcgacctaactacgtccgtcgacccgtaaccgggccctacgtcggcctacctccccgacgtcctacccgttacaggtcggacgtagggtggtcgtggggactaggtacgttcagttccacaccagtcagcacgtccctgactacgtctaagtaaagttntttgacttagtttatacgtgtacagactaagtataacgtcgacttcggaccctacggtcgttaccgggaacgaacggtaaccgaaggtaagaaacgtaaccaacggtatgggtacgacctagaccctacttacgtcgttacg

SEQ ID NO: 413421 - DNA, 512 bp, Homo sapiens
  misc_feature: GZ8MTXP02F22ZV.15.49.E05.1.454.CMB.2.raw
  modified_base (203)..(203): a, c, t, g, unknown or other
  modified_base (404)..(404): a, c, t, g, unknown or other
  modified_base (494)..(494): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctcctgcagggccagtcagagtattgacagcaagttagcctggaccagcagaaacctggccagactcccagactcgtcatctttgctacatctgccagggcccagtggcactcccagcccacgttccagtggcaggtgggtctggggacagtagttcattcctcaccatcagcagcctgcagtctagaagtntttgcttagtttattactgtcagcagtataatgactggcctcgacgttcggaccgaagggaccaaggtagaaactacgaaaacgactggngctcgacactatctgttc

SEQ ID NO: 413422 - DNA, 544 bp, Homo sapiens
  misc_feature: GZ8MTXP02I8PVW.15.49.E05.1.454.CMB.2.raw
  modified_base (204)..(204): a, c, t, g, unknown or other
  modified_base (302)..(302): a, c, t, g, unknown or other
  modified_base (360)..(360): a, c, t, g, unknown or other
  modified_base (374)..(374): a, c, t, g, unknown or other
  modified_base (379)..(379): a, c, t, g, unknown or other
  modified_base (403)..(403): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagagtattgacagcaagttgcctggtaccagcagaaacctggccagactcccagactcgtcatctttgctacntctgccagggccacgtggcactcccagccacgttcagtggcaggtgggtctggggacngtagttcatttccncaccntcagcagcctgcagtctgaagttnttgacttagtttatcgtgtacagtactaagtatagtcgtacgtcggccttacggtacgttcggaccgtaagggaaccgtaagggtacgtaaaactacgaaaacgtcgtaggtaacgcgtacgaccacgtactcgtacgttc

SEQ ID NO: 413423 - DNA, 571 bp, Homo sapiens
  misc_feature: GZ8MTXP02F9Y92.15.49.E05.1.454.CMB.2.raw
  modified_base (378)..(378): a, c, t, g, unknown or other
  modified_base (402)..(402): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcaagaaacctggccagacctcccagactcgtcatctttgctacatctgccagggccacgtggcactcccagcctacgttccagtgcaggtgggtctgggacagagttcattctcacntcagcagctgcagtctagaagttntttgacttagttttactacgttgtacagtactaagttaataagttgacgttcgggtccctaccggtaacggttccggaaccgtaaaacggggaccgtaaacgggtacggaaaataccgaaaacgtacgttaggaacggtctacggacctaccgtattccgtacgtttcc

SEQ ID NO: 413424 - DNA, 560 bp, Homo sapiens
  misc_feature: GZ8MTXP02IH3BM.15.49.E05.1.454.CMB.2.raw
  modified_base (203)..(203): a, c, t, g, unknown or other
  modified_base (369)..(369): a, c, t, g, unknown or other
  modified_base (385)..(385): a, c, t, g, unknown or other
  modified_base (391)..(391): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcagaaacctggaccagactcccagacctcgtcattctttgctacatctgccagggcccacgtggccatccccagcctacgttccagtcgctaggtgggtcctggggacnggtacgttcatttccncaaccntcagcagcctgcagtctagaagtactttgacttagttttactagtgtacagtctaagtataagtgacgtcgcctaccggtacgttccggacgtaaacggggaaccgaagggtacggaaaacttaccgaaaacgtactggtaacgctacgacctaactcttactgttacc

SEQ ID NO: 413425 - DNA, 516 bp, Homo sapiens
  misc_feature: GZ8MTXP02FT34H.15.49.E05.1.454.CMB.2.raw
  modified_base (204)..(204): a, c, t, g, unknown or other
  modified_base (386)..(386): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaanagccaccctctcctgcagggccagtcagagtattgacagcaagttagcctggtaccagcagaaacctggccagactcccagactcgtcatctttgctacatctgccagggccactggccatccccagcccacgttccagtgcaggtggtctggggcagagttcattctcacatcagcagccngcagtctgaagtatttgacttagtttattactgtcagactagtatatgacgtgcctacgtacgttcggaccgaagggaccaaggtaggaaactacgaaaacgactggtaacgctacgcacgactctgtcc

SEQ ID NO: 413426 - DNA, 637 bp, Homo sapiens
  misc_feature: GZ8MTXP02JR2KB.15.49.E05.1.454.CMB.2.raw
  modified_base (203)..(203): a, c, t, g, unknown or other
  modified_base (299)..(299): a, c, t, g, unknown or other
  modified_base (353)..(353): a, c, t, g, unknown or other
  modified_base (371)..(371): a, c, t, g, unknown or other
  modified_base (376)..(376): a, c, t, g, unknown or other
  modified_base (402)..(402): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaangccacctctcctgcagggccagtcagagtattgacagcaagttgcctggtaccagcagaacctggaccagactcccagactcgcatctttgctacntctgcctagggccagtggcactcccagcccagttccagtcggctaggtgggtcngggacagtagttcattcncaccntcagcagcctgctagtcctagaagtnttttgacttaagtttacttaccgtagtcgtaagtaccgtaagttaacttaaacgttcggaaccgtttcggtccccgttacccgggtaccgggtttacccggggacccgtaaaacgggggtaaccctaaaagggggttacggtaaaaaccttaccggaaaaaccggtaaccttggggtaaccgggtacccttacgggacccctaaccggtttacttacccggttcgttttaccccg

SEQ ID NO: 413427 - DNA, 546 bp, Homo sapiens
  misc_feature: GZ8MTXP02GA24B.15.49.E05.1.454.CMB.2.raw
  modified_base (203)..(203): a, c, t, g, unknown or other
  modified_base (386)..(386): a, c, t, g, unknown or other
  modified_base (414)..(414): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcaagaaacctggccagacctcccagactcgtcattctttgctacatctgccagggcccactggcactccccagccctacgttccagtcgcaggtcgggtctggggacagtagttcattcctcaccntacagcagcctgcctagtctagaagttntttgacttagtttattacttgtacagtactagtaatatgactcggcctaccgcgttcggacgtaacgggaccgtaagggtagaaacgtacgaaaacggtatgtaaggctacgaccacgacttctcgtttacc

SEQ ID NO: 413428 - DNA, 633 bp, Homo sapiens
  misc_feature: GZ8MTXP02FPZD1.15.49.E05.1.454.CMB.2.raw
  modified_base (205)..(205): a, c, t, g, unknown or other
  modified_base (435)..(435): a, c, t, g, unknown or other
tcagtctacgtagccacgaccggtgctcgatttagagcgactagcaacacacaaagggggggaactgctcagttaggacccagacggaaccatggaagccccagcgcagcttctcttcctcctgctactctggctcccagataccactggagaaatagtaatgacgcagtctccagccaccctgtctgtgtctccgaggggaaancgccaccctctcctgcagggccagtcagagtatgacagcaagttagcctggaccagcaagaaacctggaccagacctcccagacctcgtcattctttgctacatctcgccgagggccacgtggccactccccagcctacgttccaggtcggctagggttcgggtcgtaggggaccaggtacgtttcatttccacacctatcgagcacgcctgactagtcgtagtaagttnttttagactttaaggttttattactggtactagtacgtaaagttaataagtcgtacgttcggacccttacccgggtacggttacccgggaaaccgtaaacgggggaaaccgtaaaggggttaaggaaaaacttaccgaaaaacggtccgttagggtaacggtactacggacctaaccgtacttccgtttacgttaccc

SEQ ID NO: 413429 - DNA, 668 bp, Homo sapiens
  misc_feature: GZ8MTXP02JF7F3.15.49.E05.1.454.CMB.2.raw
  modified_base (204)..(204): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagagtattgacagcaagttagcctggtaccagcaagaacctggaccagactcccagactcgtcattctttgctacatctgccgagggcccagtcggcactcccagcccagttcccaggtcggactaggttcgggtctaggggacctaggtacgtttcacttcctacaaccctagtccgacgaccgacgtcccgtgacgtaacgttcgtaggtaaagttagttttcggactttaaggttttactttacgtcggttacagtacgtaagttaattaaaggtcgaaacggttcggaccccgttaccggtacgggttacccgggaacccggtaaacgggggtaaacctaaacgggggtaacgtaaaacgttaaaccgaaaaccggtaaccgttaggtaacggtaccgtacggtaaccctacgtacgttccgtttacggtttccc

SEQ ID NO: 413430 - DNA, 572 bp, Homo sapiens
  misc_feature: GZ8MTXP02JLCBF.15.49.E05.1.454.CMB.2.raw
  modified_base (204)..(204): a, c, t, g, unknown or other
  modified_base (213)..(213): a, c, t, g, unknown or other
  modified_base (425)..(425): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagcccaccctgtctgtgtctccgaggggaangccaccctntcctgcagggccagtcagagtattgacagcaagttagcctggaccagcagaacctggccagacctcccagacctcgtcattctttgctacatctcgccgagggcccagtggacctactccccgagccctagttccaggtggctagggtcgggtctaggggacaggtagtttccattcctacaccatcagctagcctagcagtcagtaagttntttgacttagtttatacgtgtcagtactaagtatagtcgacgtcgaccctcgtacgtccggacgtaaacgggtacctaaggtagaaactaccgaaaacgtacgttggaacggtacctaacggaccctaacctagtccgtacgtttac

SEQ ID NO: 413431 - DNA, 701 bp, Homo sapiens
  misc_feature: GZ8MTXP02F4YKV.15.49.E05.1.454.CMB.2.raw
  modified_base (203)..(203): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttgcctggtaccagcagaacctggccagacctccagactcgtcatctttgctacatctgccagggcccatggcactcccagcctacgttcccaggtcggcaggggttgggtcctggggacctaggtacgtttcacgtttccaccgacctataccgagtccaacgtcccgtgcgtagttaccgtaaggtaacgtagtttttagcgtttaaaggtttttaactttacgttacgttacgtaagtaccgttaaagttaagttaaagttcggtaacgtttccggggtacccccttacccgggggttaaaccgggttttacccggggaaccccggtaaaaggggggtaaaccccctaaaagggggtttaacgggaaaaaccgttaaccggaaaaaccggtaacggtttacgggtaagggtacccgttaggaccctaaccgtacttccgtttacgtttccccg

SEQ ID NO: 413432 - DNA, 659 bp, Homo sapiens
  misc_feature: GZ8MTXP02ILK0Z.15.49.E05.1.454.CMB.2.raw
  modified_base (201)..(201): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccacctgtctgtgtctcgaggggaancgccaccctctcctgcagggccagtcagagtattgacagcaagttgcctggtaccagcagaacctggaccagacctcccagactcgtcattctttgctacatctcgccgagggccagtcggaccactaccccaactacgttcacggtcggctagggtcgggtcgtaggggactagggtacgttctacttccgaccaccatacacgcacgtcctgactagtcgtaggtaacgttacgttttagactttaagttttacttacgtttagtacgtaagtacttaaagtaagttaagtcggtacttacgggtcccgttaccgggtaccggttaccgggaaacccgtaaacgggtaaaacccggtaaggggtaaacggtaaaaccgttaaacgaaaaccggttacgtaacggttacggtaaccgtacggaacctacctactttcccgtacggtttaccttaccg

SEQ ID NO: 413433 - DNA, 599 bp, Homo sapiens
  misc_feature: GZ8MTXP02GB0D6.15.49.E05.1.454.CMB.2.raw
  modified_base (204)..(204): a, c, t, g, unknown or other
  modified_base (251)..(251): a, c, t, g, unknown or other
  modified_base (419)..(419): a, c, t, g, unknown or other
  modified_base (442)..(442): a, c, t, g, unknown or other
tcagtctacgtagccacgaccggtgctcgatttagagcgactagcaacacacaaagggggggaactgctcagttaggacccagacggaaccatggaagccccagcgcagcttctcttcctcctgctactctggctcccagataccactggagaaatagtaatgacgcagtctccagccaccctgtctgtgtctccgaggggaangccaccctctcctgcagggccagtcagagtattgacagcaaggttancctggtaccagcagaaacctggaccagacctcccagtacctcgtcatctttgctacatctgccgacgggccacgtggctactcccagccacgttcagtggcaggtcgggtctggggacagtacgttcatttcctacaccatacagccagcctgctagtctagtaagtntttgacttagtttattacgtgtnagtactagttaatagtcgacgttcgcccgtacggtacggttaccggaccggtaaacgggaaccgtaaaggggttaaacggaaaacgttaccgaaaaaccggtacgtacgggtaacggtacccgtacggtacctaccgtacttccgttacgtttaccc

SEQ ID NO: 413434 - DNA, 558 bp, Homo sapiens
  misc_feature: GZ8MTXP02GGDU6.15.49.E05.1.454.CMB.2.raw
  modified_base (204)..(204): a, c, t, g, unknown or other
  modified_base (364)..(364): a, c, t, g, unknown or other
  modified_base (408)..(408): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaanagcccaccctctcctgcagggccagtcagagtattgacagcaagttgcctggtaccagcagaacctggaccagacctcccagactcgtcatctttgctacatctgccagggccagtggcactcccagccctacgttccagtgcaggtgggtctggggacngtagttcagttcacaccatcagcagcctgcagtctagaaagttnttttgacttagttttactactggtacagtactaagtaattaagtgacgttcggccctacggtacggttcggaccgtaaaggggacctaaaggggtacggaaaactaccgaaaacgtagtggtcgctacgcctaacctactcgtacgttcc

SEQ ID NO: 413435 - DNA, 533 bp, Homo sapiens
  misc_feature: GZ8MTXP02HEZDY.15.49.E05.1.454.CMB.2.raw
  modified_base (365)..(365): a, c, t, g, unknown or other
  modified_base (374)..(374): a, c, t, g, unknown or other
  modified_base (387)..(387): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaagacgccaccctctcctgcagggccagtcagagtattgacagcaagttagcctggtaccagcagaacctggccagctcccagacctcgtcatctttgctacatctgccagggccacgtggcactcccagccagttccaggtggcaggtgggtctggggacagngttcattcncaccatcagtcanccgtgctagtcaggtaacttattttgactttagtttacttacgtgtacagtctaaagtataagtcacgtcgcccgtcgtacgtcggacgtaagggactaaggtagaacgtacaaaacgcttgaagtctcgactacagtctacgtcc

SEQ ID NO: 413436 - DNA, 551 bp, Homo sapiens
  misc_feature: GZ8MTXP02FG5IF.15.49.E05.1.454.CMB.2.raw
  modified_base (205)..(205): a, c, t, g, unknown or other
  modified_base (414)..(414): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagcccaccctgtctgtgtctccgaggggaaangccacccctctcctgcagggccagtcagagtattgacagcaagttagcctggtacccagcagaaaccctggaccagacctcccagactcgtcatctttgctacatctgccagggccactggcactcccagccctagttccagtggctaggtgggtctggggacaggagttcattctacacctatcagcagcctggcagtctagaagttntttagcttagtttatacgtgtacagtactagttataagtgactcggacctccgtacgtcggacgaaacgggaccgaaagggtagaaactacgaaaacgtacgtaggtaacggctacgaccacctacgtcgtcgttcc

SEQ ID NO: 413437 - DNA, 632 bp, Homo sapiens
  misc_feature: GZ8MTXP02JHDI1.15.49.E05.1.454.CMB.2.raw
  modified_base (445)..(445): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaagcgccaccctctcctgcagggccagtcagagtattgacagctaagttagcctggtaccagcaagaaacctggaccagacctcccagacctcgtcattctttgctacatctgccagggccacgtggcactcccagccgtacgttccgaggtggacgtagggtcggggtacgtaggggactaggtacgtttcctaatttcctaccacctatcccgaagcgacgtcctgcgtatcgtagtaagtntttcgacttaagtttatactcgtacagtactaagttataaacgttcgtacgttcggacccgttaccggtacggtaccgggtaccggaaaacggggtaccgtaaacggggtaacgtaaaacgtaccgaaaaacggtacgttacggtaacggacttacggaccctaaccgtacttaccgtacgtttacc

SEQ ID NO: 413438 - DNA, 584 bp, Homo sapiens
  misc_feature: GZ8MTXP02FT2QQ.15.49.E05.1.454.CMB.2.raw
  modified_base (204)..(204): a, c, t, g, unknown or other
  modified_base (425)..(425): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagagtattgacagcaagttgcctggtacccagcaagaaacctggaccagacctcccagactcgtcatctttgctacatctgccagggccacgtggctactcccagccctacgttccagtggctaggtcgggtcgtaggggacaggtacgtttcacgtttcctacaccatcagcacgcctgctagtcgtagaagttntttgcttaagttttacttatgtctagtactaagtatagtgtacgtcggtccctaccgtacggttccggaccgtaaacggggacctaaaggggtaacggaaacttaccgaaaacggtacgtaggtaacggtactacggaccacgtactcgtacgtttccc

SEQ ID NO: 413439 - DNA, 497 bp, Homo sapiens
  misc_feature: GZ8MTXP02IPUY5.15.49.E05.1.454.CMB.2.raw
  modified_base (356)..(356): a, c, t, g, unknown or other
  modified_base (395)..(395): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccacgtggcactcccagccacgttcagtgcagtggtctgggcngagttcattctcaccatcagcagctgcagtctagaagtntttgcttagtttatctgtcagcagtatatgactgcctcgacgttcgaccgtaggaccaaggtagaaactcgaaaacgctagtgctagacacgtatctcgttc

SEQ ID NO: 413440 - DNA, 524 bp, Homo sapiens
  misc_feature: GZ8MTXP02HXUJO.15.49.E05.1.454.CMB.2.raw
  modified_base (204)..(204): a, c, t, g, unknown or other
  modified_base (357)..(357): a, c, t, g, unknown or other
  modified_base (366)..(366): a, c, t, g, unknown or other
  modified_base (370)..(370): a, c, t, g, unknown or other
  modified_base (374)..(374): a, c, t, g, unknown or other
  modified_base (394)..(394): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaangccaccctctcctgcagggccagtcagagtattgacagcaagttagcctggtacccagcagaaacctggccagactcccagactcgtcatctttgctacatctgccagggccatggcactcccagcctagttcagtgcagtggtctgggcagngttcattcncacntcancagctgcagtctagtaagtntttgcttagtttattactgttacagtctagtataagtgtactggtcctacgtacgttcgacgaagggacctaaggtaggaaaactacgaaaacgtaacgtggtaagtctagaccactacttcgtacgttc

SEQ ID NO: 413441 - DNA, 610 bp, Homo sapiens
  misc_feature: GZ8MTXP02JXQ4F.15.49.E05.1.454.CMB.2.raw
  modified_base (205)..(205): a, c, t, g, unknown or other
  modified_base (215)..(215): a, c, t, g, unknown or other
  modified_base (310)..(310): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagcccaccctgtctgtgtctccgaggggaaangcccaccctntcctgcagggccagtcagagtattgacagcaagttagcctggtaccagcagaaacctggaccagacctcccgagacctcgtcattctttgctacntctgccagggccagtggccactccccagtccctagttcccgagtggactaggtggggtctggggacaggtacgttcagttcctccaaccatccaagccaggtccctggacctagtctaggaacgttattttcgacttagttttatacgtgtcagactagtaattaacgtgtaccgtaggtcccgtaccggtacgttccgggaacccggaaaaggggtaacccgtaaaggggtaacgtaaactaaccgaaaacggtacgtagggtaacgacgtcgacctaacctacgttcctaggtttccc

SEQ ID NO: 413442 - DNA, 581 bp, Homo sapiens
  misc_feature: GZ8MTXP02JOUFH.15.49.E05.1.454.CMB.2.raw
  modified_base (205)..(205): a, c, t, g, unknown or other
  modified_base (305)..(305): a, c, t, g, unknown or other
  modified_base (391)..(391): a, c, t, g, unknown or other
  modified_base (418)..(418): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaagngcccaccctctcctgcagggccagtcagagtattgacagcaagttagcctggtaccagcagaaacctggccagactcccagactcgtcatctttgctacntctgccagggccagtcggccactccccgagccctacgttcccaggtcggctaggtgggtctgggacagtcgttacattctacaccntcagtcacgcctgctagtcagtaagtntttgcttagtttattacgtgtacagtactaagttataacgtgtaacgtcggtcccttaccgggtacgttaccgggaccgaaaggggtacccgaaggggtacgaaaacttaccgaaaacgtacgtcgtaaggacgtacgtaccgactacgtccgtacgtttacc

SEQ ID NO: 413443 - DNA, 709 bp, Homo sapiens
  misc_feature: GZ8MTXP02GUWIK.15.49.E05.1.454.CMB.2.raw
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaagcgccaccctctcctgcgacgggccagtcagagtattgacagacaagttagcctaggtaccagacaagaacctggaccacgacctacccagtacctcgtactatttctttcgaccttacattccgtacggaccgaacggggtccccacgttcggacctacctaccccacggtaccctaccgtttccgacgggttggccgtagggttcggggtcgtagggacgtagtacggtttcctacttcctacgaccatcgacgcgtacgcctgaccgttagtcgttagtaaagttcgtttagactttaaagtttacttacgttacgtactaacggtacttaaaggttaattaaggtcgtacgttcggccccgttaccgggtaacgggttcccggaaaccgggtaaacggggtaaacccgtaaaagggttacggaaaaccttaccggaaaaacggttacgttacgggtaacgtacgttaccggactacccctaaggtttccttacgtttacccg

SEQ ID NO: 413444 - DNA, 538 bp, Homo sapiens
  misc_feature: GZ8MTXP02I02DC.15.49.E05.1.454.CMB.2.raw
  modified_base (203)..(203): a, c, t, g, unknown or other
  modified_base (301)..(301): a, c, t, g, unknown or other
  modified_base (305)..(305): a, c, t, g, unknown or other
  modified_base (353)..(353): a, c, t, g, unknown or other
  modified_base (364)..(364): a, c, t, g, unknown or other
  modified_base (368)..(368): a, c, t, g, unknown or other
  modified_base (409)..(409): a, c, t, g, unknown or other
  modified_base (412)..(412): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcaagaacctggccagacctccagactcgtcatctttgctanatcngccaggccatggcacgtccagcctagttccagtgcagtggctgggacngagttcattcncacntcagcacgcctgcagtctagagtatttgctagtttacttangtnagctaagtatagtcgacgtacggtccgttccgacggtttcccgacggtaaacggggaccaaagggtacggtaaaactaccgaaaacggtctggtaagccgttacgaccacgtacttctacgtttcc

SEQ ID NO: 413445 - DNA, 560 bp, Homo sapiens
  misc_feature: GZ8MTXP02I0OG5.15.49.E05.1.454.CMB.2.raw
  modified_base (202)..(202): a, c, t, g, unknown or other
  modified_base (362)..(362): a, c, t, g, unknown or other
  modified_base (381)..(381): a, c, t, g, unknown or other
  modified_base (406)..(406): a, c, t, g, unknown or other
  modified_base (431)..(431): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaanagccaccctctcctgcagggccagtcagagtattgacagcaagttagcctggtaccagcagaacctggaccagacctcccagactcgtcatctttgctacatctgccgagggcccagtggacactccccagccacgttccagtgctaggtggctgggacngtagtcagttcctcacctntcagcagcctgcagtctagaaactntttgcttagtttatactgtcacgtntaaagtataaagtgtacgtcgggtcccctacgtaccggttcgacccgtaaaggggacccgaaagggttacggaaaactccgaaaaacgtcgttaggtaacggactacggaccaccgtattcgtactttc

SEQ ID NO: 413446 - DNA, 535 bp, Homo sapiens
  misc_feature: GZ8MTXP02FY5A7.15.49.E05.1.454.CMB.2.raw
  modified_base (203)..(203): a, c, t, g, unknown or other
  modified_base (400)..(400): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcagaacctggccagactcccagactcgtcatctttgctacatctgccagggccagtggcatcccagcccagttccagtggcaggtgggtctggggcaggagttcattccacaccatcagcagcctgcagtctagaagttntttgacttagtttacttactgtctagtactagttatagtgacttcggccctcgacgttcggaccgaagggacctaagggtaggaaaactacgaaaacgtacgtaggtcggactcgacctaccgatccgtagttcc

SEQ ID NO: 413447 - DNA, 662 bp, Homo sapiens
  misc_feature: GZ8MTXP02F4ICC.15.49.E05.1.454.CMB.2.raw
  modified_base (205)..(205): a, c, t, g, unknown or other
  modified_base (310)..(310): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtcctccgaaggggaancgcccaccctctcctgcagggccagtcagatatgacagcaagttagcctaggtaccagcaagaacctggaccagacctcccaagacctcgtcattctttgctacntcgtgaccgagggccacgtcggacactccccgagcccgtacgttcccaggtcggacgtagggtcgggtaccgtaggggactaggtacgttactacttccacaaccgtataccgacgccgaacgccgtagcgtaacgtcgttagaaagtttatttacgactttaaaggttttacttacgtcgtacgtagtactaaagttaactaagtcggtacgtccggtaccgtaccggtacggttaccggaaccggtaaaacggggaacccgtaaaggggtaaacgaaaccgtaaccgtaaaaccggtagtttacggaacggtacctacgaccttaccggttacttaccgttacgtttacc

SEQ ID NO: 413448 - DNA, 614 bp, Homo sapiens
  misc_feature: GZ8MTXP02HD78N.15.49.E05.1.454.CMB.2.raw
  modified_base (206)..(206): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagcccaccctgtctgtgtctccgaggggaaagngccaccctctcctgcagggccagtcagagtattgacagcaagttacgcctggtaccagcaagaaacctggccagacctcccagacctcgtcattctttgcctacatctcgccgacgggcctacgtggccactccccagtcccagttccagtgcaggtcgggtctggggacagtacgttcacttcacacctatcgagccacgtcctgcgtagtctagtaacgttagttttgactttaggtttaactttacgtcgttacgtagtacgtaagttaactaagtcgtacggttacggtcccgtaccggtacggttccggaaccggaacgggtaaccggaagggttacggaaaactaccgtaaaacgtacgttaggtaacggcgtacgacctacgtactacgttacgtttaccg

SEQ ID NO: 413449 - DNA, 650 bp, Homo sapiens
  misc_feature: GZ8MTXP02JYF38.15.49.E05.1.454.CMB.2.raw
  modified_base (204)..(204): a, c, t, g, unknown or other
  modified_base (320)..(320): a, c, t, g, unknown or other
  modified_base (323)..(323): a, c, t, g, unknown or other
  modified_base (417)..(417): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagcccaccctgtctgtgtctccgaggggaanacgcccaccctctcctgcagggccagtcagagtattgacagctaagttacgcctaggtaccagcaaggaacctggaccagacctccccgaagtactcgtcactttctttgctaacntcnggccgtacgggccctagtcggacactcccgagcccctagtccaggtgacctagggtcgggtctaggggcaggtagttactattcctaaccactntcgaacgcctacgccctgaccgtagttccgtagtaaaggttttcgtttgtacgtttagttttaacgttacgttgtaccgagtacgttaaattacgtaaggttccgtacggttccggtacccgttaccggttacggttacccggtaacgaacgggtacggtaaacgggtaagtaaaacgaacgtaacgtaaacgttcggaacgttaccgactacgacctacgttctttacgtcg

SEQ ID NO: 413450 - DNA, 531 bp, Homo sapiens
  misc_feature: GZ8MTXP02JU3TP.15.49.E05.1.454.CMB.2.raw
  modified_base (204)..(204): a, c, t, g, unknown or other
  modified_base (374)..(374): a, c, t, g, unknown or other
  modified_base (378)..(378): a, c, t, g, unknown or other
  modified_base (506)..(506): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaanagccaccctctcctgcagggccagtcagagtattgacagcaagttgctggtaccagcagaacctggcagactcccagactcgctatctttgctacatcgtgccacgggccacgtggcactcccagccctagtccaggtgcaggtcgggtctggggcagtagttcagtccncacntcacgcacgctgctgtctgaagttctttgacttagtttatacgtgttacaggtcaagttataagtgactcggacccttcggacgttcggaccaacggggactaacgggtagaaactacgaaacgtacnggtggactcgacacacgtctacgtc

SEQ ID NO: 413451 - DNA, 609 bp, Homo sapiens
  misc_feature: GZ8MTXP02H77WL.15.49.E05.1.454.CMB.2.raw
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagctcccagactcgtcatctttgctacatctgccagggccactggcactccccagcccacgttccagtcggcaggtgggtctggggacaggtagtttcattcctcaccatcagcagcctgcctagtctagtaacgtattttgcgttaagttttacttaactggttctagcgtaagttaattaaagtcgtacgtcgggtacccgttaccggtaccggtttccgggaaccggaaacggggtaccgtaaaggggttaacggaaaacgttacgaaaaaccggtaccgttagggaacggtaccgttacggacccgtaacctacggtttcctcggtttacc

SEQ ID NO: 413452 - DNA, 528 bp, Homo sapiens
  misc_feature: GZ8MTXP02JPJAV.15.49.E05.1.454.CMB.2.raw
  modified_base (203)..(203): a, c, t, g, unknown or other
  modified_base (353)..(353): a, c, t, g, unknown or other
  modified_base (370)..(370): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcagaaacctggccagactcccagactcgtcatctttgcttacatctgccagggccacgtggcatcccagcctagttccagtgctaggtggtcngggcagtagttcattcncaccatcagcagcctagcagtctagaagtatttgcttagtttataccgtgtcagctagttatatgactcggtccctacgtacgttcggaccgaagggaccgaaaggtaggaaactacgaaaacgtaacgtgtcggactcggaccactactcgtcttcc

SEQ ID NO: 413453 - DNA, 672 bp, Homo sapiens
  misc_feature: GZ8MTXP02JLUA0.15.49.E05.1.454.CMB.2.raw
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaagcgcccaccctctcctgcacgggccagtcagagtatgacagctaagttacgccgtaggtacccagcaacgaacctggaccagacctacccagacctcgtctacttctttgcctacatctcgccgacggggcccacgtcggcctacgtccccgacgcccgtacgttccgaggtcggacgtagggttcggggtcgtacggggaccgtaggtacgtttccgactttacctaccacctaactcgacgcacgtccgtgcgtagtacgtagtaacgttatttagaccgtttaagtttacttacgtgtacgtagtactaagttaactaacgtcgtaaccgtcggtaccccgtaccggttacggttacccggaaccggtaaacgggaaccggtaacgggaaacgtaaaacgtaccgtaaacgtaacggtggtaaccggtacgttacgaccgtaccttacgttcccgtacgtttaccc

SEQ ID NO: 413454 - DNA, 556 bp, Homo sapiens
  misc_feature: GZ8MTXP02IWNX7.15.49.E05.1.454.CMB.2.raw
  modified_base (204)..(204): a, c, t, g, unknown or other
  modified_base (372)..(372): a, c, t, g, unknown or other
  modified_base (377)..(377): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaaanagcccaccctctcctgcagggccagtcagagtatgacagcaagttagcctggtaccagcagaaacctggccagactcccagacctcgtcatctttgctacatctgccagggccactggcactcccagccacgttcagtcgcaggtggtctgggacagtagttcattcncaccntcagcagcctgcagtctagaagtatttgcttagtttattactgtcagctagtataagtgacgtcggtcccttccgacgttccggaccgtaaacggggaaccgtaaaggggtacggaaaacttaccgaaaacgtaacgttggtaacggtctacggaccacctacttccgttacgtttacc

SEQ ID NO: 413455 - DNA, 544 bp, Homo sapiens
  misc_feature: GZ8MTXP02F3O5C.15.49.E05.1.454.CMB.2.raw
  modified_base (203)..(203): a, c, t, g, unknown or other
  modified_base (359)..(359): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaangccaccctctcctgcagggccagtcagagtattgacagcaagttagcctggtaccagcagaaacctggccagactcccagactcgtcatctttgctacatctgccagggccactggcatcccagccacgttccagtggcaggtgggtctggggacngagttcattctcaccatcagcagcctgctagtctagaagtatttgcttagttttattactgtactagactaagtaattaagtgactgggcccttaccgtcggttaccggaccgagggaaacccgtaaagggtaggtaaactacgaaaacgtactaggtaagcgtacgaccactactctcgttacc

SEQ ID NO: 413456 - DNA, 717 bp, Homo sapiens
  misc_feature: GZ8MTXP02IK8S2.15.49.E05.1.454.CMB.2.raw
  modified_base (202)..(202): a, c, t, g, unknown or other
  modified_base (212)..(212): a, c, t, g, unknown or other
  modified_base (266)..(266): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaangccaccctcncctgcagggccagtcagagtattgacagcaagttgcctggaccagcagaaaccnggaccagacctcccagacctcgtcattctttgctacatctgccagggccagtggccactccccagccctacgttcccaggtcggcaggttcggggtcgtaggggactaggtacgtttcacgtttccctacgaaacctagtaccgaaggaccctacggccccttggacccgtacggttaccttaaggtaaagtttactttttacggacctttaaaggtttttaactttacgttacgtttaacgaggttaacctaaaggtttaattaaacgttcggtaaaccgttcgggtacccccgttaccgggtaaccgggtttaacccgggacccggtaaaacgggggtaaacccggtaaagggttaaaccgggtaaaaacttaaccggaaaaaccggtaacgtttcgggtaacggtccgtaacggtaccctaaccgtacgtttccgttacgtttacccg

SEQ ID NO: 413457 - DNA, 705 bp, Homo sapiens
  misc_feature: GZ8MTXP02JY6IC.15.49.E05.1.454.CMB.2.raw
  modified_base (208)..(208): a, c, t, g, unknown or other
  modified_base (267)..(267): a, c, t, g, unknown or other
  modified_base (276)..(276): a, c, t, g, unknown or other
  modified_base (303)..(303): a, c, t, g, unknown or other
  modified_base (307)..(307): a, c, t, g, unknown or other
  modified_base (312)..(312): a, c, t, g, unknown or other
tcagtctacgtagccacgaccggtgctcgatttagagcgactagcaacacacaaagggggggaactgctcagttaggacccagacggaaccatggaagccccagcgcagcttctcttcctcctgctactctggctcccagataccactggagaaatagtaatgacgcagtcctccagcccaccctgtctgtgtctccgaaggggaaanacgcccacccctctcctggcagggccagtcagagtatgacagacaagttgcctggaccngcaagaacnggaccagcctccagctcgtctatcttnctanactcncgccgaggccacgtcggcctacgtccccgagtacccctacggttcccaggtcggcgtaggggttcgggtaccgtaggggaccgtaggtacgtttcctattccctcaaaccctagtccgagtaccacgtccctacggacgtacggtccgttagggtaaagtttacgttttcgtaacgtttagttttaactttaccggttagttaccgtaagttaccgttaaagttaaattacggttacgtaaccggttcggttacccgttaccccgggttacggggttaacccggaacccgggtaaaacggggaccggtaaacggggtaaaggtaaacctaaccggtaaaaccggtgtacggtcgtacgtaccggacctaccgtactttccgttacgtttaccc

SEQ ID NO: 413458 - DNA, 630 bp, Homo sapiens
  misc_feature: GZ8MTXP02F68TY.15.49.E05.1.454.CMB.2.raw
  modified_base (205)..(205): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctaccgaggggaaancgcccacctctcctgcacgggccagtcagagtattgacagcaagttagcctaggaccagcaagaacctggaccagacctcccaagtaccttcgtactattctttagctacatctcgaccgtagggcccacgtggacctaccgtcccagccctaggttcccagtcggctaggggtggtacgtaggggacagggtacgttctaactttccacaacctatccgagaccagcctgactagtctagtaagttcgtttagactttaagtttattacgttgtacagtacttaagtaagtagtcgtacgtcggtaccttaccggacggttacccggaacggtaaaacggggtaccaaaggggtaaacgtaaactaaccgtaaaacgtacgttagtaacgacgtacgaccgtactacgttcgttcgtttacccg

SEQ ID NO: 413459 - DNA, 724 bp, Homo sapiens
  misc_feature: GZ8MTXP02HEMQF.15.49.E05.1.454.CMB.2.raw
  modified_base (201)..(201): a, c, t, g, unknown or other
  modified_base (713)..(713): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctcgagggaanagccaccctctcctgcgagggccagtcagagtattgacagctaagttagcctggtaccagcaagaaacctggaccagacctcccgagtacctcgtacattctttacgcttactatccgtacgccgacggggccctacgtcggccaaccgtcccgagccccgtaagtttcccgaggttcggaccgtaggggtcggggtcgttacggggacgtaggtacgtttcctatttcctacaccctagtccgaagcccttacgccgttacgacgttacgtctaagggtaacttaggttttacacgtttaaagtttttcgtaacgttgtaccgtaaggtacttaaagttaattacgttacgtaacccgttcggacccccgtttaccggggtaacggtttccccgggaaaaccggttaaacccgggggaaccgttaaaaggggtaaaccggtaaattaaacccggtaaaacgtaccggtttaggaaccggtacgtaacgaccctaaactcgtttaccggttntttaacccccg

SEQ ID NO: 413460 - DNA, 551 bp, Homo sapiens
  misc_feature: GZ8MTXP02FK30R.15.49.E05.1.454.CMB.2.raw
  modified_base (203)..(203): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccaggggaaanagccaccctctcctgcagggccagtcagagtattgacagcaagttagcctggtacccagcaagaaacctggccagactcccagactcgtcatctttgctacatctgccagggccacgtggccatccccagccacgttcagtgcaggtgggctgggcagagttcattctcaccatcagcagcctgctagtctagaagtatttgctagtttatacgtgtcagtcaagttataagtgtacgtcgggcccttaccggacggtttccggaccgtaaaggggacctaaacggggtacgaaaactaccgaaaacgtacgtaggtaaggctacgaccaccgtagttcgtcgttacc

SEQ ID NO: 413461 - DNA, 666 bp, Homo sapiens
  misc_feature: GZ8MTXP02IV2VD.15.49.E05.1.454.CMB.2.raw
  modified_base (203)..(203): a, c, t, g, unknown or other
  modified_base (305)..(305): a, c, t, g, unknown or other
  modified_base (308)..(308): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctccgaggggaancgccaccctctcctgcacgggccagtcagtagtattgacagctaagttagcctggtaccagcaagaaacctggccagctccagactcgtcatctttgctacntcncgccagggcctacgtggacactccccgagccctacgtttccgaggtcgacgtagggttcggggtacgtggggactggtacgtttaccactttccacgacctactccgacgtccacgtccctgaccgtagtccgtaagtaacggttatttagctttaaagttttaactttcctaggtttaccaagtctaaagttataagtcggtacttccgggtcccttaccgggaccgggtttaccggaaccggtaaacgggaaaccggtaaaggggtaacggaaaacttaacccggaaaaacggttcgttacgggtaacggtacccgttaggtacccgtacctacgttccggtttacgtttaacccg

SEQ ID NO: 413462 - DNA, 716 bp, Homo sapiens
  misc_feature: GZ8MTXP02FOEJS.15.49.E05.1.454.CMB.2.raw
  modified_base (204)..(204): a, c, t, g, unknown or other
tcagtctacgtagccacgaccggtgctcgatttagagcgactagcaacacacaaagggggggaactgctcagttaggacccagacggaaccatggaagccccagcgcagcttctcttcctcctgctactctggctcccagataccactggagaaatagtaatgacgcagtctccagccaccctgtctgtgtctccgaggggaangccaccctctcctgcagggccagtcagagtattgacagacaagttgcctggtaccagcaagaacctggaccagacctcccagtacctcgtacactttcctttagaccttaacattccgtcggacccgtaacggggccccacgtcggacctacctccccgaagccccgttacgttcccgaggttcggacgtaggggttcgggtccgttaggggacctaggtacgtttacacgtttccaccgacctagtaccgacgacctacgtccgtgaccgtagttccgtaaggtaaacgtttgtttaacgacgttttaaaggttttacttaggttacgtacgtaacgtacgttaaaggttaataaacgttcgaaccgttccggtaccccgttaaccgggtaccggttacccgggaaacgtaaaaccggggtaacgtaaacggggtaacgtaaaacctaaccgtaaaacggtaccgttaggtaacggaccttacgaccgtactacggtccttaggtttaccc

SEQ ID NO: 413463 - DNA, 569 bp, Homo sapiens
  misc_feature: GZ8MTXP02HMM0X.15.49.E05.1.454.CMB.2.raw
  modified_base (242)..(242): a, c, t, g, unknown or other
  modified_base (260)..(260): a, c, t, g, unknown or other
  modified_base (293)..(293): a, c, t, g, unknown or other
  modified_base (297)..(297): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctcaggggaaagccaccttcctgcaggccagtcagatatgacagcaagttcnctggtaccagcagaaccnggcagacctcccagactcgtcattctttgctanatcncgccgaggccacgtgactacgtcccagcctacgttccagtcgcaggttcgggtccgtgggacagtattcatttccctacactaactcacgctacgtcctagacgtacgttcgtagtaagttagtttgacgtttagttttacttactgttacagtactaaagtactaagtcgtacgtcggtaccctacggtacgtaccgaacgaacggtacgaacggtacgtaaaactacgtaaacgtacgtagaacgcgtacgacaacctatccttagttcc

SEQ ID NO: 413464 - DNA, 617 bp, Homo sapiens
  misc_feature: GZ8MTXP02G67BT.15.49.E05.1.454.CMB.2.raw
  modified_base (206)..(206): a, c, t, g, unknown or other
  modified_base (447)..(447): a, c, t, g, unknown or other
  modified_base (594)..(594): a, c, t, g, unknown or other
tcagtctacgtagccacgaccggtgctcgatttagagcgactagcaacacacaaagggggggaactgctcagttaggacccagacggaaccatggaagccccagcgcagcttctcttcctcctgctactctggctcccagataccactggagaaatagtaatgacgcagtctccacgccaccctgtctgtgtctccgaaggggaancgccaccctctcctgcagggccagtcagagtatgacagactaaggttacgcctaggtaccagacaacgaaacctggaccacgacctccccgaagtacctcgtactattctttgctacactctcgaccgacggccacgtcggacactacccgacgcctacgttccgaggtcgcgtaggggtcgggtaccgtagggacgtaggtactttcgacttccgtacaccagttacacgtcacgcgtancgtagtcgtagtaagttgtttacgtacttagtttacttgtcgtacgagtacgtaagttaatacgtcgtacgtcggtacctcggtacgttccggaacgtaagggtacgaacggttaaaggaaacttacggaaaacgtcgtgtcggacncgtaccaatctacgtactttccg

SEQ ID NO: 413465 - DNA, 628 bp, Homo sapiens
  misc_feature: GZ8MTXP02JHT47.15.49.E05.1.454.CMB.2.raw
  modified_base (202)..(202): a, c, t, g, unknown or other
  modified_base (270)..(270): a, c, t, g, unknown or other
  modified_base (396)..(396): a, c, t, g, unknown or other
  modified_base (504)..(504): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctcccagataccactggagaaatagtaatgacgcagtctccagccaccctgtctgtgtctcgaggggaangccaccctctcctgcagggccagtcagagtattgacagctaagttagcctggtaaccagcaagaaccnggactagacctcccagacctcgtcacttctttacgcttaacgatctcggcccgacggggccccagtcggactaccgtccccacgtccctaacgtttcccgaggtcggacgagggttcggggtccgnggggtacgaggtaggttccatttcctaccaccgtattaccagccgacgtcccgtgcccgtagtcgtagtaagttactttgacttagtttacttagtcggttacagtanaagttaagtaaactgtaccgtggcccttacggtaccggttacggaccgtaacggggacctaaggggtaacgaaaactcgaaaacgtcgttagcggtactaggcctacctagtcttacggttacc

SEQ ID NO: 413466 - DNA, 565 bp, Homo sapiens
  misc_feature: GZ8MTXP02I4K73.15.49.E05.1.454.CMB.2.raw
  modified_base (204)..(204): a, c, t, g, unknown or other
  modified_base (250)..(250): a, c, t, g, unknown or other
  modified_base (302)..(302): a, c, t, g, unknown or other
  modified_base (311)..(311): a, c, t, g, unknown or other
  modified_base (401)..(401): a, c, t, g, unknown or other
  modified_base (428)..(428): a, c, t, g, unknown or other
  modified_base (443)..(443): a, c, t, g, unknown or other
  modified_base (469)..(469): a, c, t, g, unknown or other
tcagtctacgtagccacgaccggtgctcgatttagagcgactagcaacacacaaagggggggaactgctcagttaggacccagacggaaccatggaagccccagcgcagcttctcttcctcctgctactctggctcccagataccactggagaaatagtaatgacgcagtctccagccacctgtctgtgtctccgaggggaaangccaccctctcctgcagggccagtcagagtattgacagcaagttancctggtacagcacgaacgtgccagacctccagactcgtcattctttgctacntctcgccgnggccactcggcctacgtccccagcctacgttccgaggtcggcgtaggtggggtcctaggggactaggtcgtttcagtttccctacacctntcagcacgcctgctagtctagtagttntttcgatttagtttnttacgtgtcagctaagtactagtacncgttcggccctacgggtacgtccggaccgaacgggaacctaggtacgaaactaacgaaacgtcgttggcgtacgtgaccactactcgtacgtttac

SEQ ID NO: 413467 - DNA, 648 bp, Homo sapiens
  misc_feature: GZ8MTXP02H9V34.15.49.E05.1.454.CMB.2.raw
  modified_base (206)..(206): a, c, t, g, unknown or other
  modified_base (502)..(502): a, c, t, g, unknown or other
  modified_base (613)..(613): a, c, t, g, unknown or other
tcagtctacgtagccacgaccggtgctcgatttagagcgactagcaacacacaaaggggggaactgctcagttaggacccagacggaaccatggaagccccagcgcagcttctcttcctcctgctactctggctccagataccatggagaaatagtaatgacgcagtctccagccaccctgtctggtgtctaccgaagggggaaanacgcccaaccctctcctggcaaggggccaggtcaagagtatgacagctaaagttacgcctggtacccagacaagaaaccctggccaagacctacccaagactcgcaagttctttgactacatcctgaccgaggccaacgttggacctaacgtccccaacggtacccgtaaccgtttcgaaggttcgggactaggggttcgggtacgtcgggggactaagggtcgttactaagttcaacgactagtcacgacagcctgaccagtctagtaagtatttcgacttacgtttattacgtntacgagactaagtacttaaacgtcggactacgggtccctaccgttacggtaccggtaaccggaaacggtacgaaaacggttaacggaaacgttaaacgaaacggtaacggngtaagccgtacgacctactacgttaccgtactccg

SEQ ID NO: 413468 - DNA, 249 bp, Homo sapiens
  misc_feature: GZ8MTXP01C3V6Y.8.55.E11.1.454.CMB.2.raw
  modified_base (248)..(249): a, c, t, g, unknown or other
tcagctcgcgtgtccacgaccggtgctcgatttagcactcgcacgttgggtttgggggtgtggtggtctccactcccgccttgacgaggccgactattactgcggagcatgggatagcagcctgaacactgtggtcttcggcggagggaccaagctgaccgtccttagtcagcccaaggctgcccctcggtcactctgttcccaccctcctcgacacgcgagctgagcgggctggcaaggcgcatagnn

SEQ ID NO: 413469 - DNA, 253 bp, Homo sapiens
  misc_feature: GZ8MTXP01D2MUL.8.55.E11.1.454.CMB.2.raw
  modified_base (252)..(253): a, c, t, g, unknown or other
tcagctcgcgtgtccacgaccggtgctcgatttagcactcgcacgttgggtttggggggtgtggtggtctccactcccgccttgacgaggccgactattactgcggagcatgggatagcagcctgaacactgtggtcttcggcggagggaccaagctgaccgtccttagtcagcccaaggctcgccccctcggtcactctcgttcccgccctcctcgacacgcgagctgagcgggctggcaaggcgcatagnn

SEQ ID NO: 413470 - DNA, 646 bp, Homo sapiens
  misc_feature: GZ8MTXP01EJQVP.17.61.F06.1.454.CMB.2.raw
  modified_base (245)..(245): a, c, t, g, unknown or other
  modified_base (261)..(261): a, c, t, g, unknown or other
  modified_base (394)..(394): a, c, t, g, unknown or other
  modified_base (396)..(396): a, c, t, g, unknown or other
  modified_base (400)..(401): a, c, t, g, unknown or other
tcagcgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcgatcaccatctcctgcactggaaccagcagtngacgtgtatatatatntctctacgtaccaacaacgaaccagacaacgaccccaaactacatatatttatagtagtactagtaactggacccccttcaggggtttctaagttcgacttctctgctccaagtctaggcaacatgctcctcncnctcnncctcgtcgtccgtaccggtacgtaccggtacggacggtacgggacgggtacgtacggtaacgtttaacgttaacgttacgttaccgtacgtaccgtaacgtaacgttaacttaaacgtaaacgttaacgaaccgtaccgaccgaccgttacccgttaacccgggttaccggggtttaaccggggtttacccgggggtaccgggggttaacccggggtaacccggggttaaaccgggtaacccggg

SEQ ID NO: 413471 - DNA, 516 bp, Homo sapiens
  misc_feature: GZ8MTXP01B54SO.17.61.F06.1.454.CMB.2.raw
  modified_base (238)..(238): a, c, t, g, unknown or other
  modified_base (268)..(268): a, c, t, g, unknown or other
tcagcgtagactagcacgaccggtgctcgatttagctacgctctaagggaaagggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcgatcaccatctcctgcactggaaccngcagtgacgttggtacttataactatgtcncctggtaccaacagaacccaggcaaagcccccaaatcatgatttatgagtcagtaatcggccctgaggggtttctaatccgcttctctggctacaagtctggcaacatggccctccctgacccatcctcgtgggctcaggctgagacgagctgattattactgcagtctcatatacaagcagcagcacgttcgtgggttgttcgggcggagggccagctgaaccgtctaggttcaacggcccaacggg

SEQ ID NO: 413472 - DNA, 519 bp, Homo sapiens
  misc_feature: GZ8MTXP01E4GZD.17.61.F06.1.454.CMB.2.raw
  modified_base (269)..(269): a, c, t, g, unknown or other
  modified_base (335)..(335): a, c, t, g, unknown or other
  modified_base (425)..(425): a, c, t, g, unknown or other
  modified_base (439)..(439): a, c, t, g, unknown or other
  modified_base (451)..(451): a, c, t, g, unknown or other
  modified_base (461)..(461): a, c, t, g, unknown or other
  modified_base (494)..(494): a, c, t, g, unknown or other
tcagcgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcgatcaccatctcctgcactggaaccagcagtgacgttggtacttataactatgtcncctggtaccaacagaacccaggcaaacgcccccaaatcatgatttatgagtcagtaatcggccctnaggggtttctaatcccgcttctctggctaccaaagtctgggcaaacatggcctccctgacccatctcgtgggctccgaggctgaggacgnggctgattattacngcagctcattanacaagcagcngcacttccgtgggttgtcggcggaggccaagcngaaccgtcgagcaacgcccgaacgg

SEQ ID NO: 413473 - DNA, 580 bp, Homo sapiens
  misc_feature: GZ8MTXP01BQ3Z8.17.61.F06.1.454.CMB.2.raw
  modified_base (268)..(268): a, c, t, g, unknown or other
tcagcgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcgatcaccatctcctgcactggaaccagcagtgacgttgtacttataactatgtcncctggtaccaacaagaacccaggacaaacgcccccaaactcatgtatttatgagtcagtaatcggccctcgaggggtttctaatccgcttctctggctaccaagtcgtggcaacatcggcctcctcgacctatctcgtgggcctcgaggctaggacggacgagctagtagttattaactgacagtcctcaatactaacaagcagcagcctaacgttccgttagggggttcgttacggggcgggacgggacccgttaaggccgtacggtaacccgtaccgtacgggttacgaacccggttaacccgaaccggg

SEQ ID NO: 413474 - DNA, 523 bp, Homo sapiens
  misc_feature: GZ8MTXP01C2KOE.17.61.F06.1.454.CMB.2.raw
  modified_base (317)..(317): a, c, t, g, unknown or other
  modified_base (329)..(329): a, c, t, g, unknown or other
  modified_base (472)..(472): a, c, t, g, unknown or other
tcagcgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctcgtgtctgggtctcttggacagtcgatcaccatctcctgcactggaaccagcagtgacgttgtacttataactatgtctcctggtaccaacagaacccaggaccaaacgcccccaaactcatgatttangaggtcagtaancggccctgaggggtttctaatccgcttctctggctaccaagtctggcaacatcggccctcctgacctatctctgggctccgaggctgacggacgaggctagattattctgcagctcatatacagcagcagcacttcgttgggngtcgggacggacgggccaagctcgaaccgtcgaggttcaacgccgaacggg

SEQ ID NO: 413475 - DNA, 523 bp, Homo sapiens
  misc_feature: GZ8MTXP01D1159.17.61.F06.1.454.CMB.2.raw
  modified_base (234)..(234): a, c, t, g, unknown or other
  modified_base (310)..(310): a, c, t, g, unknown or other
  modified_base (403)..(403): a, c, t, g, unknown or other
  modified_base (438)..(438): a, c, t, g, unknown or other
  modified_base (457)..(457): a, c, t, g, unknown or other
  modified_base (511)..(511): a, c, t, g, unknown or other
tcagcgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcgatcacatctctgcatgaacngcagtgacgttgtacttataactatgtctctggtaccaacagaacccaggacaaacgccccaaactcatgatttangagtcagtaatcggccctgtaggggtttctaatccgtcttctctggctaccaagtcgtggcgacatcggccctcctcgaccatctcgtgggcnccaggctggaggacgagctagattagttactgacngctcatataacagcagcgncacttcgttgggttcgttcgggcggaggttaccagctggaaccgtcgtagttcncgccgtaaccgg

SEQ ID NO: 413476 - DNA, 704 bp, Homo sapiens
  misc_feature: GZ8MTXP01AO1P6.17.61.F06.1.454.CMB.2.raw
  modified_base (322)..(322): a, c, t, g, unknown or other
tcagcgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcgatcaccatctcctgcactggaaccagcagtgacgttgtacttataactatgtctcctggtaccaacacgaacccaggaccaaaacgcccccaaaactcaatgatttanagagtcagtaactcggcccttgaggggtttctaagtccgtacttctacgtcggtctaacccgtaagtctcgggaccaaactacgtcgggaccctccccgtgaccctattctccgtcgggggcccttaccgaacgggtccgttaggaacgggacggtaacgggccgttggtaaacttttaacggttaacttcgggacctaaggtcctaacgtaattaacttaaaccgaaggtaccacgaccaaggtaacctaaccggtttcccgggttgggggttcgggttacccgggggacgggggttaaccggggttacccgaaacgggtccggtaccgggtaacccgttcccggtaccgggttacaacccgggttaaccccgaaccgggg

SEQ ID NO: 413477 - DNA, 533 bp, Homo sapiens
  misc_feature: GZ8MTXP01DT5PG.17.61.F06.1.454.CMB.2.raw
  modified_base (234)..(234): a, c, t, g, unknown or other
  modified_base (443)..(443): a, c, t, g, unknown or other
tcagcgtagactagcacgaccggtgctcgatttagctacgctctaagggaaagggcttcagggacctctgggctgatccttggtctcctgctcctcaggctcaccggggcccagcacagactcactggcatgtgtttctcctctttccagggtcctgggcccagtctgccctgactcagcctgcctcgtgtctgggtctcttggacagtcatcaccatctcctgcactgaaccngcagtgacgttgtacttatactatgtctctgtaccaacacgaaccaggacaaacgccccaaatcatgatttatgaggtcagtaatcggacccttcgtaggggtttctaatcccgtcttctctcggctaccaagtctggacaacatcggcctccagacctatctcgtgggctcgaggctaggaggacgagtctagtatttatactgacanctacatacaacgagcagcagctacgttccgttgggttgttacgggcggacggttacagcgtagccgtcgtacggttcaacggccgaacgg

SEQ ID NO: 413478 - DNA, 531 bp, Homo sapiens
  misc_feature: GZ8MTXP01ANXAZ.17.61.F06.1.454.CMB.2.raw
  modified_base (318)..(318): a, c, t, g, unknown or other
  modified_base (335)..(335): a, c, t, g, unknown or other
  modified_base (437)..(437): a, c, t, g, unknown or other
  modified_base (442)..(442): a, c, t, g, unknown or other
  modified_base (447)..(447): a, c, t, g, unknown or other
  modified_base (451)..(451): a, c, t, g, unknown or other
  modified_base (459)..(459): a, c, t, g, unknown or other
tcagcgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcgatcaccatctcctcactggaaccagcagtgacgttggtacttataactatgtctcctggtaccaacacgaacccaggaccaaacgcccccaaatcatgatttangagtcagtaatcgcctntaggggtttcaagtcgtccttctctggctccaaagtctggacaaacatcggcctccctgaccatctcgtggctccgagctaggagacgaggctgattatacngtcancctanatanacaagcancacgctcttcggttgggtcgttcgggacggaacggacgcgcgtaacgccgtcgagtacgacgtccgcgtccg

SEQ ID NO: 413479 - DNA, 559 bp, Homo sapiens
  misc_feature: GZ8MTXP01DA6WS.17.61.F06.1.454.CMB.2.raw
  modified_base (237)..(237): a, c, t, g, unknown or other
tcagcgtagactagcacgaccggtgctcgatttagctacgctctaagggaaaggggcttcagggacctctgggctgatccttggtctcctgctcctcaggctcaccggggcccagcacagactcactggcatgtgtttctcctctttccagggtcctgggcccagtctgccctgactcagcctgcctcgtgtctgggtctgttggacagtcgatcaccatctcctgcactggaaccngcagtgtacgttgtacttataatatgtctctggtacaacacgaaccagaccaaacgccccaaactcatgattatgagtcagtaatccggcctcgtagggttactatccgtcttctcgtgctacagtctgcaaacacgtcggcctcctgacctactctcgtcgggacctccgaggtctaggaggacgagctagtatttagttactggacagtcctacatactaacgaagctagcagtcaacgttccggttgggttcggttcgggacggttacgggccgttaaggccgtcgaaccgtccgtaggttcgtaaccgccgaacccgg

SEQ ID NO: 413480 - DNA, 564 bp, Homo sapiens
  misc_feature: GZ8MTXP01DMV7X.17.61.F06.1.454.CMB.2.raw
tcagcgtagactagcacgaccggtgctcgatttagctacgctctaagggaaaggggcttcagggacctctgggctgatccttggtctcctgctcctcaggctcaccggggcccagcacagactcactggcatgtgtttcctccctctttccagggtcctgggcccagtctgccctgactcagccctgcctccgtgtctgggtctcttggacagtcgatcaccatctcctgcactggaaccagcagtgacgtttgtacttataactatgtctcctaggtaacccaacacgaacccaggaccaaaacgcccccaaaagtcatgatttatgaggtcagtaatcggccttcgtagggtttcaactccgctttactcgtcggcctaaccgaagttcgtaggaccaaacgatcgggccctcccgtagaccctattccgtcgtgggcctccgaggtctggacggacgagctagtattagtactgcacgctacatataacagcagcagcctacttcggttgggttcgtcgggcggaacggccaagctacgccgtcgagcaacgccgtaacgg

SEQ ID NO: 413481 - DNA, 610 bp, Homo sapiens
  misc_feature: GZ8MTXP01BQC6V.17.61.F06.1.454.CMB.2.raw
  modified_base (145)..(145): a, c, t, g, unknown or other
  modified_base (369)..(369): a, c, t, g, unknown or other
  modified_base (384)..(384): a, c, t, g, unknown or other
  modified_base (389)..(389): a, c, t, g, unknown or other
  modified_base (398)..(398): a, c, t, g, unknown or other
  modified_base (407)..(407): a, c, t, g, unknown or other
  modified_base (416)..(416): a, c, t, g, unknown or other
  modified_base (467)..(467): a, c, t, g, unknown or other
  modified_base (483)..(483): a, c, t, g, unknown or other
tcagcgtagactagcacgaccggtgctcgatttagctacgctctaagggaaaggggcttcagggacctctgggctgatccttggtctcctgctcctcaggctcaccggggcccagcacagactcactggcatgtgtttctccctntttccagggtcctgggcccagtctgccctgactcagcctgcctccgtgtctgggtctcgttggacagtcgatcaccatctcctgcactggaaccagcagtgtacgtttgtacttataactatcgtctacctaggtaaccaacaagaaccccaggaccaaaacgcccccaaaatcatgtatttagagaggtacagtaactccggcctgtaggttcaatccgcttncgtgcctacaagtcngacantcgcctcanccatctcgnggcctacgnggctggacggacgaggtctagtaacttcgtacgtgcagtacactaattaanaaccgagtacgagacncgcctacccggttcggttaggggttccgggttacggggaaccgggttaacggggacccaacggggtcctttacccggggaaccgttcccggttaaggttacccgaaacggttcccccggtaaacggg

SEQ ID NO: 413482 - DNA, 677 bp, Homo sapiens
  misc_feature: GZ8MTXP01CI7I3.17.61.F06.1.454.CMB.2.raw
  modified_base (210)..(210): a, c, t, g, unknown or other
  modified_base (244)..(244): a, c, t, g, unknown or other
  modified_base (273)..(273): a, c, t, g, unknown or other
  modified_base (323)..(323): a, c, t, g, unknown or other
  modified_base (559)..(559): a, c, t, g, unknown or other
tcagcgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctcgtgtctgggtctcgttggacngtcgatccactatctcctgactacgtggaaaccngcagtgtacgttagtactatactatgtcnctagaccaacacgaaccaggaccaaacgccccaaatctatgtaatttagngtaggtactagtaacgtccggtcccttagtacggggtttactaacgtcccgttactttcacggtcggtccctaaccgtaacgttcgaggaaccctaacgtaccggtccggaccccttacccgtaggtaaacccttaccgttccgttacggggttccggggaaccttccggggaacggcgtacgggaacgggacggtacgtacgtgttaaacttctacgtacgctaagtctaactanacgtaccgaatccgagtccgtacgtccgttcggttacgggtgggttacggtacgggacgggaaccgacgttacgtccgtacggtaacctcgggtacggaccgtaaccggccgtaaccg

SEQ ID NO: 413483 - DNA, 531 bp, Homo sapiens
  misc_feature: GZ8MTXP02GUK5R.17.61.F06.1.454.CMB.2.raw
  modified_base (316)..(316): a, c, t, g, unknown or other
  modified_base (453)..(453): a, c, t, g, unknown or other
tcagcgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaagcccccaaactcatgatttangaggtcagtaatcggccctgaggggtttctaatccgcttctctggctccaagtctggcaacatcggcctcctgaccatctctgggctcccgaggctggacggacgaggctagattattactgcagctcatatacaancagcaagcactccgttgggtcgttcgggcggaacgggaccaagccgtaggaccgttcctagggtcacgaccccgaagg

SEQ ID NO: 413484 - DNA, 520 bp, Homo sapiens
  misc_feature: GZ8MTXP02GVBXA.17.61.F06.1.454.CMB.2.raw
  modified_base (314)..(314): a, c, t, g, unknown or other
  modified_base (447)..(447): a, c, t, g, unknown or other
  modified_base (451)..(451): a, c, t, g, unknown or other
  modified_base (455)..(456): a, c, t, g, unknown or other
  modified_base (462)..(462): a, c, t, g, unknown or other
tcagcgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcatcaccatctcctgcactggaaccagcagtgacgttggtacttataactatgtctcctggtaccaacagaacccaggcaaagcccccaaatcatgatttangaggtcagtaaatcggccctcgaggggtttctaagtccgtcttctctggctaccaagtcctggcaaacatcggccctccctgacccatctcgtgggcctcgagctgaggacgagctgattatactgcagctanatanacannagcacnctacgttcgtggtcgtcggacgacggacagcgtacgaccgtcgacgtcacgaccgacg

SEQ ID NO: 413485 - DNA, 529 bp, Homo sapiens
  misc_feature: GZ8MTXP02JNOI2.17.61.F06.1.454.CMB.2.raw
  modified_base (315)..(315): a, c, t, g, unknown or other
  modified_base (448)..(448): a, c, t, g, unknown or other
tcagcgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaagcccccaaatcatgatttangaggtcagtaatcggcctcagggatttcaactcgcttctctggctccagtctggcaacatcggcctccctgaccatcctcgtcgggctcgaggctggaggacgaggctggattataatgcagtctacaataanacagacagacacgctacgttcggttgggtcggtcgggacggacggacgaagtcgtacgtaccgtacgtacgacgacgaccg

SEQ ID NO: 413486 - DNA, 526 bp, Homo sapiens
  misc_feature: GZ8MTXP02JTOD9.17.61.F06.1.454.CMB.2.raw
  modified_base (238)..(238): a, c, t, g, unknown or other
  modified_base (314)..(314): a, c, t, g, unknown or other
  modified_base (435)..(435): a, c, t, g, unknown or other
tcagcgtagactagcacgaccggtgctcgatttagctacgctctaagggaaagggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcgatcaccatctcctgcactggaaccngcagtgacgttggtacttataactatgtctctggtaccaacagaacccaggcaaacgcccccaaatcatgatttangaggtcagtaatcggcctgaggggtttcaatccgcttctctggctccaagtctggcaacatggccctcctgacccatctcgtgggctccgaggctggaggacgaggctggatttagttacngcagtctacaatacaacaagcagcacgcctacgttcggttgggtcgtcgggacggacggacagcgtacgaccgtcgacgacacgaccgacg

SEQ ID NO: 413487 - DNA, 506 bp, Homo sapiens
  misc_feature: GZ8MTXP02F9NZQ.17.61.F06.1.454.CMB.2.raw
  modified_base (315)..(315): a, c, t, g, unknown or other
  modified_base (334)..(334): a, c, t, g, unknown or other
  modified_base (462)..(462): a, c, t, g, unknown or other
tcagcgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaagcccccaaatcatgatttangagtcagtaatcggccctnaggggttctaatccgcttctctgctccaagtctggcaacatcggcctcctgaccatctctgggctccaggctggaggcgaggctagattatactgcagctcatatacaagcagcagcactcgttgggngttcggcgaacggccaagcgtgacccgtcgagtcacgccaacgg

SEQ ID NO: 413488 - DNA, 526 bp, Homo sapiens
  misc_feature: GZ8MTXP02J3RAA.17.61.F06.1.454.CMB.2.raw
  modified_base (453)..(453): a, c, t, g, unknown or other
tcagcgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcatcaccatctcctgcactggaaccagcagtgacgttgtacttataactatgtctctggtaccaacagaacccaggaccaaagcccccaaactcatgattatgaggtcagtaatcggccctcgtaggggttctaatccgcttctctggctccaagtctggcaacatcgccctcctagacccatcctcgtggggcctccgagggctaggaggacgaggctgattattactgcagctcattanacaagcagctagcacgtctgggtcgttcggcggacggaccaagcgcgaccgtcgtaaggccacgacccgacgg

SEQ ID NO: 413489 - DNA, 526 bp, Homo sapiens
  misc_feature: GZ8MTXP02IMN23.17.61.F06.1.454.CMB.2.raw
  modified_base (238)..(238): a, c, t, g, unknown or other
  modified_base (394)..(394): a, c, t, g, unknown or other
tcagcgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcgatcaccatctctgcactggaaccngcagtgacgttgtacttatactatgtctctggtaccaacagaacccaggcaaacgcccccaaatcatgatttatgaggtcagtaactcggccctcgtaggggtttctatccgtcttctctgctccaagtctgcaacatcgcctcctgaccatctcnggctccgagctgagacgagctagtattatactgacagtctcatactacaaagcaagcagctacttccgttgggtcgttcggcggtacgggacaaggcgtacggaccgtcctaggtaccacgacccgtaacgg

SEQ ID NO: 413490 - DNA, 540 bp, Homo sapiens
  misc_feature: GZ8MTXP02FT6F3.17.61.F06.1.454.CMB.2.raw
  modified_base (239)..(239): a, c, t, g, unknown or other
  modified_base (314)..(314): a, c, t, g, unknown or other
tcagcgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcgatcaccatctcctgcactggaaccngcagtgacgttgtacttataactatgtctcctggtaccaacagaacccaggcaaagcccccaaatcatgatttangagtcagtaatcggccctcgaggggtttctaatccgcttctctggctccaagtctggcaacatcggcctccctgaccatcctctgggcctccgaggcctggaggacgaggctagtattattactgcagctacatactaacaagcaagcaagctactcgttgggtcgttcggcggacgggaccaaggtcgtacggacccgtacgtacggtcaccggacccgaacggg

SEQ ID NO: 413491 - DNA, 640 bp, Homo sapiens
  misc_feature: GZ8MTXP02IPM9I.17.61.F06.1.454.CMB.2.raw
  modified_base (239)..(239): a, c, t, g, unknown or other
  modified_base (314)..(314): a, c, t, g, unknown or other
tcagcgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcttggacagtcgatcaccatctcctgcactggaaccngcagtgacgttgtacttataactatgtctctggtaccaacagaacccaggacaaacgccccaaatcatgatttangagtcagtaatcggccctcgtagggtttactactcgcttctctggctccaagtctgcaacatcgcctcctcgacctatctcgtcgggctccgaggccgtaggacggacggacggcttaggtaattttagttaacgttggacctaggtcctacgtaactaactaacgaaacgcgaggacaacggtaccctaaccgtttcccggggtttaggggtttccggggtttaccgggggaccgggggtaaaccgggtaacccgaaacggtccgttaccggtacccggttacccggttaaacggggtcccgaaccggaaccccggtaaccgggg

SEQ ID NO: 413492 - DNA, 558 bp, Homo sapiens
  misc_feature: GZ8MTXP02JKGSW.17.61.F06.1.454.CMB.2.raw
  modified_base (260)..(260): a, c, t, g, unknown or other
  modified_base (308)..(308): a, c, t, g, unknown or other
  modified_base (320)..(320): a, c, t, g, unknown or other
  modified_base (383)..(383): a, c, t, g, unknown or other
  modified_base (401)..(401): a, c, t, g, unknown or other
  modified_base (476)..(476): a, c, t, g, unknown or other
  modified_base (483)..(483): a, c, t, g, unknown or other
tcagcgtagactagcacgaccggtgctcgatttagctacgctctaagggaaagggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctctggacagtcatcaccatctcctgcactggaaccagcagtgacgttgtacttataactntgtctctgtaccaacagaaccaggtcaaacgccccaaatcatgattangagtcagttacncggtccctagtaggggttctaatcccgtcgttctctggtctaccgaagtctggacctaaacgntcggccctcctgaacctntccgtcgtgggcctccgaggcctaggacggtacgacggcttagtaacgtttataccgtgactagctacgtattanacgaacncacgctacgctcgtcggtcggtacggtacggacggacggactacgccgtacgtacgtcgtacgacgacgacgacg

SEQ ID NO: 413493 - DNA, 540 bp, Homo sapiens
  misc_feature: GZ8MTXP02GEZFE.17.61.F06.1.454.CMB.2.raw
  modified_base (237)..(237): a, c, t, g, unknown or other
  modified_base (243)..(243): a, c, t, g, unknown or other
  modified_base (460)..(460): a, c, t, g, unknown or other
tcagcgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctcgtgtctgggtctcttggacagtcatcaccatctcctgcactggaaccngcagtnacgttgtactatactatgtctctgtacaacacgaaccagacaaacgccccaaactcatagtattatgagtcaagtaactcggccctagtagggttctaatcccgtcttctctcggctaccaagtcgtagacaacacgtcggacctccctgaccctatcctcgtggctccgagcgtggacggacgtaggctagtacttatactgtcagtctacattanacaagcagcacgctacgtcgtgggtacgtcgggacggacggacgaagtcgacgtaccgtcgtacgtcacgaccgtaacgg

SEQ ID NO: 413494 - DNA, 615 bp, Homo sapiens
  misc_feature: GZ8MTXP02IYR3J.17.61.F06.1.454.CMB.2.raw
  modified_base (240)..(240): a, c, t, g, unknown or other
  modified_base (264)..(264): a, c, t, g, unknown or other
  modified_base (313)..(313): a, c, t, g, unknown or other
  modified_base (318)..(318): a, c, t, g, unknown or other
  modified_base (324)..(324): a, c, t, g, unknown or other
  modified_base (442)..(442): a, c, t, g, unknown or other
tcagcgtagactagcacgaccggtgctcgatttagctacgctctaagggaaaggggcttcagggacctctgggctgatccttggtctcctgctcctcaggctcaccggggcccagcacagactcactggcatgtgtttctccctctttccagggtcctgggcccagtctgccctgactcagcctgcctccgtgtctgggtctcgttggacagtcgatcaccatcctctgcactggaaccngcagtgtacgttgtacttatactntgtctctgaaccaacacgaaccagacaaaccgccccaatcatgatttangagtnagtacncgacctgtacggtactatccgtcttctcgtcgctaccgagtcgtggacaactacgtccggtaccctccgtacgaccctacgttccgtcgtcggacctccgaggtcgaggtacggacgngtactagtatttactcgtgcacgtctacgtaaattacgaacgaacggtacacgtactaacggtccttaccgggtttcgggtttacgggggttccggtacggggaccggggtaaccgtaccggacgtaaccgtaccggtaccgtaccgtacgaccgtaccggaccgtaacccgg

SEQ ID NO: 413495 - DNA, 510 bp, Homo sapiens
  misc_feature: GZ8MTXP01D1R05.25.28.C06.1.454.CMB.2.raw
  modified_base (288)..(288): a, c, t, g, unknown or other
  modified_base (328)..(328): a, c, t, g, unknown or other
tcagactgtacagtcacgaccggtgctcgatttagagctcacgtattgggtttggggcagaagtctctctcagtcaggacacagcatggacatgagggtccctgctcagctcctgggactcctgctgctctggctcccagctatcagatgtggcatccagatgaccaagtctccatcctccctgtctgcatctgttggagacagagtcaccatcacttgccgggcgagtcagggcattggaaattattggctggtatcagcagaaaccagggaaattcctaactcctnatctatgctgcatccactttgctaagtttcggggtccctntcgattcagcggcagtgggtctgggacagaattcactctcaccatcagccagcctgcagccgtgtaaggaatgttgtactaacttaattaacctagtactaaaattaagtacaagtgaccgtcgttagtagttcggttccgcggacgaacggtaggaacgactacgaacgaacgttaagtgg

SEQ ID NO: 413496 - DNA, 395 bp, Homo sapiens
  misc_feature: GZ8MTXP01EIAZN.25.28.C06.1.454.CMB.2.raw
  modified_base (284)..(284): a, c, t, g, unknown or other
  modified_base (390)..(395): a, c, t, g, unknown or other
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcaccgtgggcatgggggagtgtgtcacaagatttgggctctgggcaccgtgggcacggggagtgtgtcacaagagtttggccagggccaccctggtcaccgtctcctcagcttccacaagggcccatcggtcttccccnggcgccctgctccaggacgcacctcgtggggcacgagcggccctgggctgcctggtcaaggctacttccactgtacagtcctgagcgggctggcaaggcgcatagnnnnnn

SEQ ID NO: 413497 - DNA, 467 bp, Homo sapiens
  misc_feature: GZ8MTXP01C5VB0.25.28.C06.1.454.CMB.2.raw
  modified_base (382)..(383): a, c, t, g, unknown or other
  modified_base (385)..(385): a, c, t, g, unknown or other
  modified_base (397)..(397): a, c, t, g, unknown or other
  modified_base (419)..(419): a, c, t, g, unknown or other
  modified_base (431)..(431): a, c, t, g, unknown or other
  modified_base (454)..(454): a, c, t, g, unknown or other
  modified_base (464)..(464): a, c, t, g, unknown or other
tcagactgtacagtcacgaccggtgctcgatttagagctcacgtattgggtttggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgcccgggcgagtcagggcattggaaattatttggcctggtatcagcagaaaccagggaaattcctaacctcctcatctatgctgcatcactttgcaatttggggtccctctcgattcagcggcagtgggtctgggacagaattcactctcaccatcagcagccnncngcgtgagatgtnctacttatatatataaatatanaagtcgacgtgngtgtcgcgcgacgaagagaacanacactaacgngtg

SEQ ID NO: 413498 - DNA, 535 bp, Homo sapiens
  misc_feature: GZ8MTXP01EN0MF.25.28.C06.1.454.CMB.2.raw
  modified_base (254)..(254): a, c, t, g, unknown or other
  modified_base (306)..(306): a, c, t, g, unknown or other
  modified_base (347)..(347): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttggcccggggcgagtcgagggctagttaggaaattnttggcctggtatcagcaagaaaccgaggggtaaactttcctaaacctcctanattctatgctgcatcctactttgactagtttcggggccctntcgattcagcgcaggtgggtctgggacagattcactctcaccgatcagcagcctcgcacgcgtagaagtatgttgtactaacttattactacgtaataaaattagtactaagtacgttaccgtacggttagtcgttcggaccggacgggaccgtaaggtaggaacgaacgtacgaacgtaacgttgtg

SEQ ID NO: 413499 - DNA, 553 bp, Homo sapiens
  misc_feature: GZ8MTXP01BIHNR.25.28.C06.1.454.CMB.2.raw
  modified_base (502)..(502): a, c, t, g, unknown or other
  modified_base (512)..(512): a, c, t, g, unknown or other
tcagactgtacagtcacgaccggtgctcgatttagagctcacgtattgggttttgggggaagaggaagactgacggtcctcccaggagttcaggtgctgggcaccttgggcacggggaggcgtggtccagcctgggaagtccctgagactctcctgtgtggcgcctagactcaccttcagtagttatggcttcgtctgggtccgccagtgtccaggcaaggggctggagtggctgggagttacttggtctgacagacaaatgacatatcacgcggagtccgtgagggccgattcaccatctccagggacaattccaagagaaccctctatctgcaaatgaacaacttgagagtccgaggatacggccgtttataactgtgcgacctcaggagtggctaggaaaagtcgtagtctcattcccgtcgacctcgtggggccagggcaccgtcggtcgacgtctcctcacgcttccaccaacggcccatccggtctcccctggccncctcgctccnggacgcacctcgtgggggcacgacgccggcccgttggggcc

SEQ ID NO: 413500 - DNA, 579 bp, Homo sapiens
  misc_feature: GZ8MTXP01DGU7L.25.28.C06.1.454.CMB.2.raw
  modified_base (245)..(245): a, c, t, g, unknown or other
  modified_base (269)..(269): a, c, t, g, unknown or other
  modified_base (388)..(388): a, c, t, g, unknown or other
tcagactgtacagtcacgaccggtgctcgatttagagctcacgtattgggtttggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagatcaccatcacttgccgggcgagtcagggcattggaaattnttggctggtatcagcaagaaaccngggaaattccaactctcatctatgctgcatctactttacgtctaagtttcgggtcccgtcgtccgtattcgacgcggcgtagtgggtcgtgggacgagaattctactctcacactacanacacgctcgcacgacgtagtaagtagtagttacgtactaactttaactttaacttaacgttaaacttaaaacgttaacgtaacgtaacgtacggttaccggtacggttacgttacggttaccggttaccggacgggaaccggtaacgggtaacggtaacgtaacgtaacgaaacgtaacgttaacgtaacg

SEQ ID NO: 413501 - DNA, 553 bp, Homo sapiens
  misc_feature: GZ8MTXP01ESZFQ.25.28.C06.1.454.CMB.2.raw
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagactctctgtgtggcgcctagactcaccttcagtagtatggcttcgtctgggtccgccagtgtccagggcaagggggctgggagtgggcgtggggagtttacgttggtctgacagaaccaaatgaacatatcacgcggagtccgtgacggggccatcaccatctccaggacaatacaagacgaacctctatctagacaaataggaaactaacttgagagtcgaggatacggtcgttattactgtgcgtacttcgaggagtggacgttaggaaaagttcgtaagtctctactccgttcgtaaccgttcgtcggg

SEQ ID NO: 413502 - DNA, 552 bp, Homo sapiens
  misc_feature: GZ8MTXP01BC73Z.25.28.C06.1.454.CMB.2.raw
  modified_base (299)..(299): a, c, t, g, unknown or other
  modified_base (494)..(494): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaagtccctgagactctcctgtgtggcgcctagactcaccttcagtagtatggcttcgtctgggtccnccagtgtccaggcaagggggctggagtggctgggagttacgtggtctgacagaccaaatgacatatcacgcggagtccggtggacggggccattcacatctcgaggacaattccaaagacgaaccctctatctagacaaatggaaacaacttgagagtcgaggatacggtctttattactgtgcgacttcgaggngtggcgttagggaaagttcgtaagtctctacgttcccgttcgtaaccgttcgtcgggg

SEQ ID NO: 413503 - DNA, 509 bp, Homo sapiens
  misc_feature: GZ8MTXP01DU51O.25.28.C06.1.454.CMB.2.raw
  modified_base (225)..(225): a, c, t, g, unknown or other
tcagactgtacagtcacgaccggtgctcgatttagagctcacgtattgggtttggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggngagtcagggcattggaaattattggcctggtatcagcaagaaaccaggggaaattcctaactcctcatctatgctgcatccacttttcgctaagtttcgggggtccctctccgaattccagcggcaggtgggtctggggacagaattcactctcaccatcagcagcctgcagcctgaagtatgttgctaacttattactgtacaaaatttgaacaagtgaccgtgagtcgttcgacccgagggaccgaaggtgggaaccagtacaaaacgtaacgttgtaacgg

SEQ ID NO: 413504 - DNA, 579 bp, Homo sapiens
  misc_feature: GZ8MTXP01BXOH4.25.28.C06.1.454.CMB.2.raw
  modified_base (290)..(290): a, c, t, g, unknown or other
  modified_base (318)..(318): a, c, t, g, unknown or other
  modified_base (323)..(323): a, c, t, g, unknown or other
  modified_base (354)..(354): a, c, t, g, unknown or other
  modified_base (383)..(383): a, c, t, g, unknown or other
  modified_base (409)..(409): a, c, t, g, unknown or other
  modified_base (473)..(473): a, c, t, g, unknown or other
tcagactgtacagtcacgaccggtgctcgatttagagctcacgtattgggtttgggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggaggcgtggtccagccggggaatccctgagactctcctgtgcagtgtccgcgtccacttcgtgtttgcattcactggtccncaggctccaggcaagggctggagtgggngcgtnatagtggtggatggaagtactgctattttangacagctccgtgaacgggccatcacatcncagagcagctaccaagactactttanctgactaattacgggaaacgtgaacgacgtacgaccgacgacggtctacgtacttagttaccgnggcggtcggggttactaggaaacgtaacggtcggggttccggggcccgttacggtaacgggctaagggtcgggaccggttccgggtcgggggaacccgtaacgggg

SEQ ID NO: 413505 - DNA, 548 bp, Homo sapiens
  misc_feature: GZ8MTXP01D56YT.25.28.C06.1.454.CMB.2.raw
  modified_base (273)..(273): a, c, t, g, unknown or other
  modified_base (299)..(299): a, c, t, g, unknown or other
  modified_base (371)..(371): a, c, t, g, unknown or other
  modified_base (490)..(490): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagactctcctgtgtggcgcctagactcaccttnagtagtatggcttcgtctgggtcccnccagtgtccaggcaagggggctgggagtgggctgggggagtttacgttggtctgacagaccaaatgacatancacgcggagtccgtgacggggccattcacatctcgaggacatacaagacgaacctcatctagacaaatagaactaacttgagagtcgagatacggtcgttatactgtgcgcttcgaggngtggcgttaggaaaagttcgtaagtctctacttcccgttcgtaaccgttcggtcgggg

SEQ ID NO: 413506 - DNA, 783 bp, Homo sapiens
  misc_feature: GZ8MTXP01EIXBJ.25.28.C06.1.454.CMB.2.raw
  modified_base (223)..(223): a, c, t, g, unknown or other
  modified_base (244)..(244): a, c, t, g, unknown or other
tcagactgtacagtcacgaccggtgctcgatttagagctcacgtattgggtttggggcagaagtctctctcagtcaggacacagcatggacatgagggtccctgctcagctcctgggactcctgctgctctggctcccagctatcagatgtggcatccagatgacccagtctccatcctcctgtctgcatctgttggagacagagtcacatcacttgccgggngagtcagggcattggaaattnttggctggtatcagcaagaaaccagggtaaacttcctaaacctctacatctatgctgctatcctactttcgcgtaagttttcgggggtaccccttcttaccgatttccgaggtccgggtccgtaagggttcgggggttaccgtagggggtaacctaaagggttaaatttcccgaaacttcccttaccaaccctaacgttccaacggtccaacggccccttgggacccttacgggaccccgtttaggaaaacggggttacgtttacgggttaaacgtaacccgtttaaaaccgttttaaacgtttaaacccgtttaaacggttaaaaccgttaaaaaaggtttaaacctttaaaaccgtttaaaccccgttacccggttaacccccctttacccggtttaacccgtttaaacccggggttttacccgggggaaaccgggggttaaaccgggggttaaacccggttaaaagggggttaacgggtaaacgttaaaccgtaaacccggttaaaaaccggttaaccgggtttcgggttaaccgg

SEQ ID NO: 413507 - DNA, 515 bp, Homo sapiens
  misc_feature: GZ8MTXP01DZN0E.25.28.C06.1.454.CMB.2.raw
  modified_base (224)..(224): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagatcacatcacttgccgggngagtcagggcattggaaattattggctggtatcagcagaaaccagggaaagttcctaacctcctacatctatgctgcatcctactttcgctaagtttcggggtccctctacgattcgagcggcagtgggtctgggacagaattcactctcacatcagcagctgcagccgtagaagtatgttagactaactttattactagtaactaaaattgaactaagtcgaccgtggttacgttcggttacgccgagggacccgaaggtcggaacagtacaaacgtaacgttgtaacgg

SEQ ID NO: 413508 - DNA, 499 bp, Homo sapiens
  misc_feature: GZ8MTXP01DKUB7.25.28.C06.1.454.CMB.2.raw
  modified_base (389)..(389): a, c, t, g, unknown or other
  modified_base (391)..(391): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgaccaagtctccatcctccctgtctgcatctgttgagacagagtcaccatcacttgccgggcagtcagggcattggaaattattggcctggtatcagcaagaaaccagggaaattcctaacctctcatctatgctgcatcctatttcgctagtttcggggccctcgtcgtattcgagcggactaggtgggtctaggggacagtattcactctcacatcagcagccncncagcgtagagtatagtgtactacttattatataataaatagtataagtcgttacgtcgttcgtcgtcgaccgacggacgaaggtagaacactacaacgtaacgttgtg

SEQ ID NO: 413509 - DNA, 647 bp, Homo sapiens
  misc_feature: GZ8MTXP01BEQVP.25.28.C06.1.454.CMB.2.raw
  modified_base (300)..(300): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtctgggggagcgtggtccagcctgggaagtccctgagactctcctgtgtggcgcctagactcaccttcagtagtatggcttcgtctggggtccccncagtcgtccgaggcgaagggggctgggaggtggcgtggggtagtttacgttggtctgacagaaccaaatgacatactcgacggcggacgtccggtagggacgggggtcctattccactactcgtaccgacggacaacttaccgaaacgacgtaaccctctactctacgactaaatacggaaactaacgtagacggtacgtacggaggtacgtaccggtacgtttaacgttacgttcggtcgtccgtaaccgttacggagggttacggtaggtacggttaagggttaaaacggttcgttaacggtctaacgtaccgttcccggttaccgtaaccgttccggtccgggg

SEQ ID NO: 413510 - DNA, 523 bp, Homo sapiens
  misc_feature: GZ8MTXP01DKL3G.25.28.C06.1.454.CMB.2.raw
  modified_base (246)..(246): a, c, t, g, unknown or other
  modified_base (329)..(329): a, c, t, g, unknown or other
tcagactgtacagtcacgaccggtgctcgatttagagctcacgtattgggtttggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattnttggctggtatcagcagaaaccagggaaacgttcctaacctctcatctatgctgcatccactttgctaagtttggggtccctntcgattcagcggcagtggctgggacagatcactctcacatcagcagcctgacacgccgtagaagtatgttgactaacttattaactagtactaaaatttcgaactaagtcgttacccggtggttagttcgttccgggacccgacgggttaaccgtaaggttaggaactacgtacgaaacgtaacgttgtaacgg

SEQ ID NO: 413511 - DNA, 575 bp, Homo sapiens
  misc_feature: GZ8MTXP01AO81V.25.28.C06.1.454.CMB.2.raw
  modified_base (298)..(298): a, c, t, g, unknown or other
  modified_base (519)..(519): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtctgggggagcgtggtccagcctgggaagtccctgagactctcctgtgtggcgcctagactcaccttcagtagtatggcttcgtctgggtccnccagtgtccaggcaagggggctgggagtgggctgggggagtttacgttggtctgacagaccaaatgaacatactcaacgcggagtccggtggacgggggccattcaccatctccgagggacaacttaccaaagacgaaccctctactctagacaaactacggaaactaacgttagaagagtacgaggagtacggtcgtttatactgtgcgtacttcgaggngtggcgttaggaaagttcgtaagtctcgtacttcccgttcgtaaccgttcgtcggg

SEQ ID NO: 413512 - DNA, 568 bp, Homo sapiens
  misc_feature: GZ8MTXP01BQQQ6.25.28.C06.1.454.CMB.2.raw
  modified_base (298)..(298): a, c, t, g, unknown or other
  modified_base (383)..(383): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagactctcctgtgtggcgcctagctcaccttcagtagtatggcttcgtctgggtcccnccagtgccaggcaagggggctgggagtggcgtggggatttacgttggtctgacagaaccaaatgaacatatcacgcggagtccgnggacggggccattcacatctcgaggacaatacaagacgaacctctatctagacaaataggaaactaacgttagaagagtacgaaggtagtacggtaccgtttattacgtgtcgcgtaccgttacgaggagtggacgttaggaaaagttcgtaagtctctacttcccgttcgtccgttcgtcgggg

SEQ ID NO: 413513 - DNA, 628 bp, Homo sapiens
  misc_feature: GZ8MTXP01EHDRE.25.28.C06.1.454.CMB.2.raw
  modified_base (318)..(318): a, c, t, g, unknown or other
  modified_base (538)..(538): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctgggtggagtcgtggggggatcggtggtcgacgcgtcgggaggtacctcgagactctctcgtgtggcgcctacacgtctaccttctagtaagtatggcgttcgtcgtcgggtccggccngtgtccgacggcgaggggcgtggaggtggcgtgggtaggtttacttggtctgacgacgaacaaatagacatatacacgcggagtaccgtggaggggccgacttctaacccgatactcccgaaggggaactaacttacgaaacgagtaaaccccctctatactagacaaactagggaactaacgttagagagtcgaggtactacgggtccgttatttacgngtcgaacgaccttggaggaggtcgtaacgttaaaggttaaaacggttcgtctcttccgtaccgttcccggttaccgtccgttcggcgggg

SEQ ID NO: 413514 - DNA, 542 bp, Homo sapiens
  misc_feature: GZ8MTXP01BUGBS.25.28.C06.1.454.CMB.2.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttggccgggcgagtcgagggcattggaaattattggcctggtatcagacaaggaaaccaggggtaaacttcctaaacctcctacatctatgctgctatcctacttttcgactaagtttcgggggtccctctacgacttcgagtcggctaggtgggtctgggacagattcactctacacatcagcagcctgcacgccgtagaagtcttgttacgactaaactttattaaccgtagtaactaaaatttgacgtaagtcgaccggtgttacgtcggttccgacccgagggaccgaagggtcgaacacgtacaaacgtcgttggtaacg

SEQ ID NO: 413515 - DNA, 563 bp, Homo sapiens
  misc_feature: GZ8MTXP01C53PK.25.28.C06.1.454.CMB.2.raw
  modified_base (175)..(175): a, c, t, g, unknown or other
  modified_base (272)..(272): a, c, t, g, unknown or other
  modified_base (297)..(297): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagnggtgtccagtgtcaggcgcatctggtggagtcgtgggggagcgtggtccagcctgggaatccctgagactctcctgtgtggcgcctagactcacttnagtagtatggcttcgtctgggtccnccagtgtccaggccaagggggctgggagtggctgggattactggtctgacagaccaaatgacatatcacgcggagtccgtgacggggccattcacatctccaggacaattccaagacgaaccctctatctagacaaattaggaaactaacgttagaagagtcgaggactaacggtccgtttaattacgtgtgcgtaaccttgaggagttgggcttagggaaaagttcgtaagtctctacttcccgttacgtaaccgttcgtcgggg

SEQ ID NO: 413516 - DNA, 593 bp, Homo sapiens
  misc_feature: GZ8MTXP01CC1DK.25.28.C06.1.454.CMB.2.raw
  modified_base (262)..(262): a, c, t, g, unknown or other
  modified_base (276)..(276): a, c, t, g, unknown or other
  modified_base (302)..(302): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtggggggagcgtggtccagcctgggaatccctgagactctcctgtgtggcncctagactcacttnagtagtatggcttcgtctgggtcccncagtgtccaggcaagggggctgggagtggcgtggggatttacgtggtctgacagaccaaatgacatatcacggcggagtcccggtagggacggggcctattcaaccactctaccgagggacaacttaccgaagacgaacctctactctagacaaatacggaaactaacgttagaagtagtacggaggtacgtacggtcgtttattacgtcgtcgcgtacgttcgaggagtaggacgttaaggttaaaacgttcgtaagtctctacgtcccgttcgtaaccgttcgtcgggg

SEQ ID NO: 413517 - DNA, 616 bp, Homo sapiens
  misc_feature: GZ8MTXP01DCIQ4.25.28.C06.1.454.CMB.2.raw
  modified_base (295)..(295): a, c, t, g, unknown or other
  modified_base (298)..(298): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcagtcagggcatggaatattggctgtatcagcagaaaccaggaaagttacctaaacctacctcatctatnctncactctacttcgtactaagtttcgggtcccgtctacgtattcgagcggcgaggtagggtcggtagggacgaagtaacttactactctaccaaccaactacacgacgacgtccgtacgacgacgaccgtacgtaaagtaagttagttacgtactaaactttaaactttaaacttaacgttaaacgttaaaaaatttaaagtaacgtaacgtacggttaccggtacgggttacgttacggttaccggttacccggaccgggaaaccggtaaacgggtaacggtaacgtaactaacgttaaaaccgtaaacgttaacgtgg

SEQ ID NO: 413518 - DNA, 564 bp, Homo sapiens
  misc_feature: GZ8MTXP01ELNN9.25.28.C06.1.454.CMB.2.raw
  modified_base (271)..(271): a, c, t, g, unknown or other
  modified_base (279)..(279): a, c, t, g, unknown or other
  modified_base (296)..(296): a, c, t, g, unknown or other
tcagactgtacagtcacgaccggtgctcgatttagagctcacgtattgggtttgggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctgggtggagtcgtgggggagcgtggtccagcctgggaatccctgagactctcctgtgtggcgcctagactcacttnagtagtanggcttcgtctgggtccnccagtgtccagggcaagggggctggaggtgggtcgtgggtagttacttggtctgacagaaccaaatagacaatatacacgcggagtccgtgggaggggccgatctaccactctccgagggacaacttacctaacgaacgtaaccctcctatctgacaaataggaactaactagagagtcgagtagtacggtccgttattactgtgcacttcaggagtgcgttaggaaaggttcgtaagtctctactccgttccgtaacgttcgtgggg

SEQ ID NO: 413519 - DNA, 474 bp, Homo sapiens
  misc_feature: GZ8MTXP01E3092.25.28.C06.1.454.CMB.2.raw
  modified_base (331)..(331): a, c, t, g, unknown or other
  modified_base (385)..(385): a, c, t, g, unknown or other
  modified_base (389)..(389): a, c, t, g, unknown or other
  modified_base (402)..(402): a, c, t, g, unknown or other
  modified_base (425)..(425): a, c, t, g, unknown or other
  modified_base (427)..(427): a, c, t, g, unknown or other
  modified_base (436)..(436): a, c, t, g, unknown or other
  modified_base (461)..(461): a, c, t, g, unknown or other
  modified_base (471)..(471): a, c, t, g, unknown or other
  modified_base (473)..(473): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttgagacagatcaccatcacttgccgggcgagtcagggcattggaaattatttggcctggtatcagcaagaaaccaggggaaacttccaacctctcatctatgctgcatccactttgctaagtttcggggtccctntcgattcagcggcaggtgggtctgggacagaattcactctcacatcagcagccncgcngcgtagagatgtntactacttatatataataaatanangtcgcgtgngtcgtcgcgacgacgaagagaacanacacgtaagngng

SEQ ID NO: 413520 - DNA, 565 bp, Homo sapiens
  misc_feature: GZ8MTXP01D24HD.25.28.C06.1.454.CMB.2.raw
  modified_base (257)..(257): a, c, t, g, unknown or other
  modified_base (297)..(297): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtggggggagcgtggtccagcctgggaatccctgagctctcctgtgtggcncctagactcacttcagtagtatggcttcgtctgggtcccncagtgccaggcaagggggctgggagtgggctggggattacgttggtctgacagaccaaatgacatatcacgcggagtccggtggacggggccattcacatctcgaggacaatacaagacgaacctctatctagacaaatacggaaactaacttagagagtacgaggagtacggtcgtttatacgtgtcgcgacgttcgaggagtcggacgttaagggaaaagttcgtaagtctctacgttcccgttaccgtaaccgttcggtccgggg

SEQ ID NO: 413521 - DNA, 503 bp, Homo sapiens
  misc_feature: GZ8MTXP01BU2ER.25.28.C06.1.454.CMB.2.raw
  modified_base (226)..(226): a, c, t, g, unknown or other
  modified_base (293)..(293): a, c, t, g, unknown or other
  modified_base (335)..(335): a, c, t, g, unknown or other
  modified_base (442)..(442): a, c, t, g, unknown or other
  modified_base (467)..(467): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctcctgtctgcatctgttggagacagagtcaccatcacttggccgggngagtcagggcattggaaattgttggctggtatcagcagaaaccaggggtaaacttcctaacctcctnatctatgctgcatcctactttcgctaagtttcggggtccctntacgattcgagcggcagtgggtctgggacagtaattcactctcacatcagcagcctgcagcctagaagtattgtagctaatttattactagttactaaaatttgaanaagtgacccgtgagtcgtcgcccgngggaccaaggtgaacagacaacgaacgttgtaacgg

SEQ ID NO: 413522 - DNA, 543 bp, Homo sapiens
  misc_feature: GZ8MTXP01AJKKY.25.28.C06.1.454.CMB.2.raw
tcagactgtacagtcacgaccggtgctcgatttagagctcacgtattgggtttgggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtctgggggagcgtggtccagcctgggaagtccctgagactctcctgtgtggcgcctagactcaccttcagtagtatggcttcgtctgggtccgccagtgtccaggcaagggggctggagtggctgggagtttactggtctgacagaccaaatgacatatcacgcggagtccgtgaggggccattcaccatctccagggacaattcccaaagacgaaaccctctaatctgacaaatggaaacaacttgagagtcgagatacggccgttatactgtgcgacttcaggagtggcttaggaaaagttcgtaagtctcacttcccgttcgaaccgttcgtcgggg

SEQ ID NO: 413523 - DNA, 529 bp, Homo sapiens
  misc_feature: GZ8MTXP01BHE5S.25.28.C06.1.454.CMB.2.raw
  modified_base (199)..(199): a, c, t, g, unknown or other
  modified_base (222)..(222): a, c, t, g, unknown or other
  modified_base (242)..(242): a, c, t, g, unknown or other
  modified_base (285)..(285): a, c, t, g, unknown or other
  modified_base (295)..(295): a, c, t, g, unknown or other
  modified_base (388)..(388): a, c, t, g, unknown or other
  modified_base (392)..(392): a, c, t, g, unknown or other
  modified_base (409)..(409): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctcctgtctgcatctgttganacagatcacatcacttggccggngagtcaggcagttgaaattnttggctgtatcagcagaaaccgagggaaacttccaacctctanatctatgctncatcctactttcgctagtttcggggccccttgtacgattcgagccgggactagggtgggtctagggacagtacttcactctcacatcagcacncgtnacgacgacgtagaagtntgtacgactaacttattactagtaactaaattcgaactaagtcgaccggtagacgttcggtaccgaccgttacgggacccgtaagggtcgaactaacgacgaaaccgtaagttggtaacg

SEQ ID NO: 413524 - DNA, 624 bp, Homo sapiens
  misc_feature: GZ8MTXP01DKZ76.25.28.C06.1.454.CMB.2.raw
  modified_base (275)..(275): a, c, t, g, unknown or other
  modified_base (283)..(283): a, c, t, g, unknown or other
  modified_base (300)..(300): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaatccctgagactctcctgtgtggcgcctagactcaccttnagtagtanggcttcgtctgggtccncagtgtccaggcaagggggctgggagtgggcgttgggggtagtttacgttggtctgacagaaccaaatgaacatatacacggcggagtccggtagggacgggggccctattccaccactctaccgagggacaacttaccaaagaacgtaaccctctactctagacaaatacggaaactaacgttagaagtagtacggaggaacgtaccggtaccgtttaattacgtgtgaaccgtaccttcgaggaggtacggacgttaagggttaaaacgttacggtaagtctaacgtacgttcccgttccgtaacccgttcggtaaccgggg

SEQ ID NO: 413525 - DNA, 559 bp, Homo sapiens
  misc_feature: GZ8MTXP01BOFW2.25.28.C06.1.454.CMB.2.raw
  modified_base (305)..(305): a, c, t, g, unknown or other
  modified_base (346)..(346): a, c, t, g, unknown or other
  modified_base (433)..(433): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtcctccatcctccctgtctgcatctgttggagacagagtcaccatcacttggccgggcgagtcagggctagttaggaaattgttggcctggtatcaggacaagaaaaccaggggaaactttccctaacctcctanatctatgctgctatcctatttcgactagtttcggggccctntacgtattcgaggcggtctagggtcgggtactaggggacagtaacttcactctcacatcagcagcctgacgacgccgtagaaagttntagtactacttaactttattactagttaaattaaagttcgaagtaacgtcgttaccggtggttacgtcggtaccggaccggacgggacgtaaggtacgaactacgtacgaaacgtaacgttggtcg

SEQ ID NO: 413526 - DNA, 519 bp, Homo sapiens
  misc_feature: GZ8MTXP01BW6EJ.25.28.C06.1.454.CMB.2.raw
  modified_base (359)..(359): a, c, t, g, unknown or other
  modified_base (420)..(420): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcacatcacttggccggcgagtcgagggctagttaggaaattagttggcctggtatcagacaagaaaccgagggtaaacttcctaacctctacattctatgctgcatcctactttcgacttaagtttcggggtccctctacgattcgagcgntaggtggtctgggacagtatcactctcacatcagcacgctgcacgcgtagaagtatgttanacctaatttattactagtaactaaaattcgaataagtcgaccgtgagtcggtcgccgagggaccgaaggtgaactacacgaaaccgtaagttgtaacgg

SEQ ID NO: 413527 - DNA, 511 bp, Homo sapiens
  misc_feature: GZ8MTXP01B0URA.25.28.C06.1.454.CMB.2.raw
  modified_base (415)..(415): a, c, t, g, unknown or other
tcagactgtacagtcacgaccggtgctcgatttagagctcacgtattgggtttggggcagaagtctctctcagtcaggacacagcatggacatgagggtccctgctcagctcccgggactcctgctgctctggctcccagctatcagatgtggcatccagatgacccagtctccatcctccctgtctgcatctgttggagacagagtcaccatcacttgccgggcgagtcagggcattggaaatattggcctggtatcagcagaaccagggaaattcctaactcctcatctatgctgcatccacttttgcctaagttttcgggggtccctctcgaaattcgaagcggcagtggggtctggggacagattcactctcaccatcagcagctgcagcctggagtatgtgactaacttnttactagtactaaaatttgactagtcgaccgttggtacttggttcggccgttagggccaagggtcggacaacgtacgaacgacgtggttaaggtcc

SEQ ID NO: 413528 - DNA, 535 bp, Homo sapiens
  misc_feature: GZ8MTXP01BNKE3.25.28.C06.1.454.CMB.2.raw
  modified_base (226)..(226): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgaccaagtctccatcctcctgtctgcatctgttggagacagagtcaccatcacttggccgggngagtcgagggcagttggaaattattggcctggtatcagcagaaaccagggaacttcctaacctctcatctatgctgctatcctactttcgactaagtttcgggggtcccttactcgattcgagtcggctaggtgggtcgtgggacagtacttcactctcacatcagcagcctgcagccgtagaagtatgttagactaacttattactagtactaaaattcgataagtacgaccggtgagtcggttccggacccgaggggttaacccaagggtacggaactacgtaccgaaacgtaacgttaacggtcgg

SEQ ID NO: 413529 - DNA, 608 bp, Homo sapiens
  misc_feature: GZ8MTXP01CY84Q.25.28.C06.1.454.CMB.2.raw
  modified_base (214)..(214): a, c, t, g, unknown or other
  modified_base (283)..(283): a, c, t, g, unknown or other
  modified_base (341)..(341): a, c, t, g, unknown or other
  modified_base (370)..(370): a, c, t, g, unknown or other
tcagactgtacagtcacgaccggtgctcgatttagagctcacgtattgggtttgggctgagctgggttttcctcgttgctcttttaagaggtgtccagtgtcaggtgcagctggtgcagtctgggggaggcgtggtccaccctgggaggtccctgagactctcctgtgcagcctctggattcatcttcaacacctatgcaatgcactgggtccncaggctccgaggcaaggggctgggagtgggtgctagttattcatatgataggaaactaaataaaaagtntgtgactccggtggcggccattcaccgtctccagagacagataccaaagaagacggtntactacctacaaaatcaaacaacctgaanctaccgaggacacgggctagtgtattacgtgtgacgagacgacgtcgggcggcacgggtcctaccccgaaggaacgtaccggactaactagttaccgactagtcggactagtccggtaggggacgaacgggacccgtcgggtaactacgttccgtccttccgttcgccgccccttcccgaaccgtaaccgggccctaacggttcccgggtcccttcccccggtggaaccccgtccccg

SEQ ID NO: 413530 - DNA, 570 bp, Homo sapiens
  misc_feature: GZ8MTXP01EA847.25.28.C06.1.454.CMB.2.raw
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggagcgtggtccagcctgggaatccctgagactctcctgtgtggcgcctagactcaccttcagtagtatggcttcgtctgggtccgccagtgtccaggcaagggggctgggagtgggctggggagtttacgttggtctggacagaccaaatgacatatcacgcggagtccgtgaggggccgattcacatctcagggacaatcaaagacgaacctctatctgacaaataggaaacaacttgagagtacgaggagtacggtccgtttattacgtgtgcgtaccttcgaggagttagggacgttagggaaaagttcgtaaggtctctacgttcccgttacgtaacccgttcgtccggggg

SEQ ID NO: 413531 - DNA, 592 bp, Homo sapiens
  misc_feature: GZ8MTXP01DGIOH.25.28.C06.1.454.CMB.2.raw
  modified_base (273)..(273): a, c, t, g, unknown or other
  modified_base (381)..(381): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaatccctgagctctctgtgtgcgcctagactcaccttnagtagtatggcttcgtctcgggtcccgccaggtcgtcccgagggccgaagggggctgggagtgggctgggggtagtttacgttggtctgacagaaccaaatgacatancacgcggagtccgtggacggggcctattcaccatctcgaggacaacttccaaagacgaaccctctactctagacaaatacggaaactaacttgaagagtcgaggtacgtacggtacgtttattacgtgtcgcgtacccttgaggaggtaggtacgttaaggaaaacgttcggtaatactctacttcccgcgtaacccgttcggtaacgggg

SEQ ID NO: 413532 - DNA, 586 bp, Homo sapiens
  misc_feature: GZ8MTXP01A71F9.25.28.C06.1.454.CMB.2.raw
  modified_base (297)..(297): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagactctcctgtgtggcgcctagactcaccttcagtagtatggcttcgtctgggtccnccagtgtccaggcaagggggctggagtggcgtgggagtttactgggtctggacagaaccaaatgaacatatacacgcggagtccgtggacggggccattcacatctccgagggacaattccaaagacgaacctctatctgacaaataggaaactaacttagagagtcgaggtagtaccggtccgtttagttacgtgtgccgaccgttcgaagggttagtagggtacgttaagggaaaacgttcggtaagtactctacgttcccggttcgtaaccgttcggtaaccgggg

SEQ ID NO: 413533 - DNA, 572 bp, Homo sapiens
  misc_feature: GZ8MTXP01C5O3H.25.28.C06.1.454.CMB.2.raw
  modified_base (271)..(271): a, c, t, g, unknown or other
  modified_base (278)..(278): a, c, t, g, unknown or other
  modified_base (295)..(295): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggagcgtggtccagcctgggaatccctgagactctcctgtgtggcgcctagctcacttnagtgtanggcttcgtctgggtccncagtcgtccaggcaagggggctgggagtggctggggtattcttggtctgacagaccaaatgactatatcacggcggagtcccgtgggacggggcctattccgacatctcgaggacaacttacaagacgaaccctctactctagacaaatacggaaactaacgttagagagtcgaggacgtacggtccgtttattacgtgtgccgacttcgaggacggtggtcgttagggttaaaacgttcgtaagtctctacttccgttcgtaaccgttcgtcgggg

SEQ ID NO: 413534 - DNA, 545 bp, Homo sapiens
  misc_feature: GZ8MTXP01CHY6S.25.28.C06.1.454.CMB.2.raw
  modified_base (298)..(298): a, c, t, g, unknown or other
  modified_base (384)..(384): a, c, t, g, unknown or other
  modified_base (401)..(401): a, c, t, g, unknown or other
  modified_base (422)..(422): a, c, t, g, unknown or other
  modified_base (425)..(425): a, c, t, g, unknown or other
  modified_base (429)..(429): a, c, t, g, unknown or other
  modified_base (431)..(431): a, c, t, g, unknown or other
  modified_base (434)..(434): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctggggaatccctgagactctcctgtgtggcgcctagactcaccttcagtagtatggcttcgtctgggtccnccagtgtccagggcaagggggctgggagtggctggggagttacttggtctggacagaccaaatgacatatcacgcggagtccgggnggacgggcatcacatcncgaggacatacaagacacctntanctananaanagaactaactagagagagagagtacgtcgttatactgtgcgtcgttcgaggaggtaggtagttaggttaaagttacgtaagtcgtcgtcgtccgttcgtccgttcgtcggg

SEQ ID NO: 413535 - DNA, 669 bp, Homo sapiens
  misc_feature: GZ8MTXP01EA3OD.25.28.C06.1.454.CMB.2.raw
  modified_base (302)..(302): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctgggtggagtcgtgggggagcgtggtccagcctgggaactccctgagactctcctgtgtggcgcctagactcaccttcagtagtatggcttcgtctgggtccnccagtgccagggcgaagggggctaggaggtgggcgttgggggtatttacgttggtctgaacagaaccaaatgaactatactaccgacggcgggacgtcccgggtgggacgggggcctattccaaccactctaccgaagggactaacgttaccaaacgacgtaaccctctactctagactaaatacggaaactaacgttagaagtacgtacggaaggtaacgttaccgggtaccgtttactttaacgttacgtcggtaaccgtaccgttaccgtacggttagggtacggtacggttaacggttaaaagggttaacgttaacgttacgttcctaccttcccggttacccgtaaccgttccggtccgggg

SEQ ID NO: 413536 - DNA, 679 bp, Homo sapiens
  misc_feature: GZ8MTXP01DQ16J.25.28.C06.1.454.CMB.2.raw
  modified_base (214)..(214): a, c, t, g, unknown or other
  modified_base (285)..(285): a, c, t, g, unknown or other
tcagactgtacagtcacgaccggtgctcgatttagagctcacgtattgggtttgggctgagctgggttttcctcgttgctcttttaagaggtgtccagtgtcaggtgcagctggtgcagtctgggggaggcgtggtccaccctgggaggtccctgagactctcctgtgcagcctctggattcatcttcaacacctatgcaatgcactgggtccnccaggctccaggcgaaggggctgggagtggggtgctagtttattcatatgataggaaactaaataaaagtntgtagactcggtggcggcatcaccgtctccagacgacagactacgaaagaagacgtgtactacccaccaaaatccaaactaaccctaagaacgaacgtacccggaagggtaaccgacggtctagggttacgttaacttacgtggtaggacggaagacggtacggtcggggcggtacacgggtaccgtaccccgaaggaaaccggttaccggaccttacgttaacgtttaccccgaatacgtacggaactaggtaccgggtgggggaaccggaaacgggtaccgacgggtcctaacgttccggttaccttccgtcctccggccccttacccgaacccggtaaccgggtcccctaacgttcccgggtcccctttccccggccgggttccctccccg

SEQ ID NO: 413537 - DNA, 575 bp, Homo sapiens
  misc_feature: GZ8MTXP01DDQGU.25.28.C06.1.454.CMB.2.raw
  modified_base (260)..(260): a, c, t, g, unknown or other
  modified_base (301)..(301): a, c, t, g, unknown or other
  modified_base (368)..(368): a, c, t, g, unknown or other
  modified_base (376)..(376): a, c, t, g, unknown or other
  modified_base (382)..(382): a, c, t, g, unknown or other
tcagactgtacagtcacgaccggtgctcgatttagagctcacgtattgggtttgggggggagaggagcccagcactagaagtcggcggtgtttccactcggtgatcggcactgaacgcagcggactcaccatggagtttgggctgaactgggttttcctcgttgctcttttaagaggtgtccagtgtcaggcgcatctggtggagtcgtggggggaggcgtggtccagcctgggaatccctgagactctcctgtgtggcncctagactcaccttcagtagttatggcttcgtctgggtccnccagtgtccaggcaaggggctgggagtggctggggagtttacgtggtctgacagacaaatgacatancaacgcgngtccgngaggggccatcacatctcaggacaatcaagacgaaccctctactctagacaaatacgaaactaacgttagaagaggtacgaggacgttacggtaccgtttataccgtgtcgcgtaacctcgaggtagttggtacgtaagggaaaacgttcgttagtctactaacttcccgtcgaccgtcgttcggggaacccg

SEQ ID NO: 413538 - DNA, 584 bp, Homo sapiens
  misc_feature: GZ8MTXP01CGZJQ.25.28.C06.1.454.CMB.2.raw
  modified_base (273)..(273): a, c, t, g, unknown or other
  modified_base (298)..(298): a, c, t, g, unknown or other
  modified_base (523)..(523): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggagcgtggtccagcctgggaatccctgagactctctgtgtggcgcctagactcaccttnagtagtatggcttcgtctgggtccnccagtcgtccgagggcgaagggggctgggagtggcgtggggtagtttacgttggtctagacagaaccaaatgaactatatacgacggcggagtcccggtgggacggggcctattcaccatctcgaggacaacttacaaagacgaaccctctactctagacaaatagaaactaacgttagagagtcgagtacgtacggtcgttattacgtgtgcgtacttcgaggngtaggcgttaaggaaacgttcgtaagtctctacttcccgttacgtaaccgttcgtccgggg

SEQ ID NO: 413539 - DNA, 551 bp, Homo sapiens
  misc_feature: GZ8MTXP01DSSVU.25.28.C06.1.454.CMB.2.raw
  modified_base (297)..(297): a, c, t, g, unknown or other
  modified_base (344)..(344): a, c, t, g, unknown or other
  modified_base (487)..(487): a, c, t, g, unknown or other
tcagactgtacagtcacgaccggtgctcgatttagagctcacgtattgggtttgggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctgggtggagtcgtgggggagcgtggtccagcctgggaatccctgagactctcctgtgtggcgcctagactcacttcagtagtatggcttcgtctgggtcccnccagtgtccaggcaagggggctgggagtggctgggagttactggtcngacagacaaatgacatatacacggcggagtccggtggacgggggcccattcgaaccatctccagggacaattaccaaagagaaccctctaactctagacaaataggaaacaacttgagagtcgagagtacgccgttatactgngcgacttcaggagtggcttaggaaaagttcgtaagtctcagtcccgttcgaaccgttcgtcggg

SEQ ID NO: 413540 - DNA, 626 bp, Homo sapiens
  misc_feature: GZ8MTXP01DS99G.25.28.C06.1.454.CMB.2.raw
  modified_base (261)..(261): a, c, t, g, unknown or other
  modified_base (300)..(300): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtggggggagcgtggtccagcctgggaagtccctgagactctcctgtgtggcncctagactcacttcagtagtatggcttcgtctgggtccnccagtgtccaggcaagggggctggagtggcgtggggattacgttggtctgacagaaccaaatgacatactacgacgcgggagtcccgggtagggacgggggtcccaagtttccaaaccctactccgtaccgaacgggactaaacgttaccgaaacgtaacgaacccttctaactactagaacctaaatacggaaactaacgttagaagagtacggaggtacgtacggtccgtttattacgtgtcgcgtaccttgaggttagtggtacgttaagggttaaaacgttcgtaagtctctacgttcccgttcgtaaccgttcggtcgggg

SEQ ID NO: 413541 - DNA, 549 bp, Homo sapiens
  misc_feature: GZ8MTXP01AG592.25.28.C06.1.454.CMB.2.raw
  modified_base (260)..(260): a, c, t, g, unknown or other
  modified_base (370)..(370): a, c, t, g, unknown or other
  modified_base (383)..(383): a, c, t, g, unknown or other
  modified_base (399)..(399): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaatccctgagactctcctgtgtggcncctagactcaccttcagtagtatggcttcgtctgggtccgccagtgtccagggcaagggggctgggagtgggcgtggggagttacttggctgacagaccaaatgacatancacgcgagtccgngacggggcatcaccanctcaggacaattccaaagacgaaccctcatctgacaaataggaaacaacttgaagagtcgagagtacggtccgtttatactgtgcgacttcaggagtggcttaggaaaagttcgtaagtctcacttcccgttcgtaaccgttcgtcgggg

SEQ ID NO: 413542 - DNA, 755 bp, Homo sapiens
  misc_feature: GZ8MTXP01E0VSP.25.28.C06.1.454.CMB.2.raw
  modified_base (271)..(271): a, c, t, g, unknown or other
  modified_base (299)..(299): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgctcttttaagaggtgtccagtgtcaggcgcatctggtggagtcgtgggggagcgtggtccagcctgggaatccctgagactctctgtgtgcgcctagactcacttnagttagtatggcttcgtcgtgggtcccncctagtgtcccgagggcaagggggctggaggtggcgtggggtagtttcgtggtctggaacagaaccaaaatgaactatagtcccgaacgggcgggtaacgtcccgggtagggaacggggggtcccctaaactttcccaaacccgtacgttaccgttacccggaaacggggtaaacctaaaccgtttacccgaaaacggtaaccgtaaacccccttacgtaacttaccgttaacggaacctaaaagttaacggggaaacctaaacgtttaggaaacggtaaggtaccggaagggtaacgttaaccgggtaacccgttttaagttaaccgtggttcggtaaccgtaaccgttacggaacgggttaggtacgggtaacgttaacgggttaaaaaggttaccggttaaggttaccttccgtaccgttccccggttaccgtaacccgttcggtcccggggg

SEQ ID NO: 413543 - DNA, 614 bp, Homo sapiens
  misc_feature: GZ8MTXP01EH4T1.25.28.C06.1.454.CMB.2.raw
  modified_base (264)..(264): a, c, t, g, unknown or other
  modified_base (359)..(359): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgtgagacagatcaccatcacgttggccgggcgagtcgagggctagttaggaaatttgttggacctggtancgagacgaagaaaaccgaggggtaaactttccctaaacctcctacagttactatcgctgcctattcctatttcgacgtagtttcggggtcccctntaccgattcgagtcggcaggtgggtcagggacagtactcactctcacatcacgcacgctacgcgacgaccgtagtaagtagttaggttacgtactaacctttaactttaacttacgtaaattaaaactttaagtaacgtaacggttacggttacccggtagggttacgttacggttaccgggttacccggttacgggaaccggtaacggttacggaacgtaacgtaacgaaacgtaaccgttaaggttaaccggg

SEQ ID NO: 413544 - DNA, 726 bp, Homo sapiens
  misc_feature: GZ8MTXP01DJ0UN.25.28.C06.1.454.CMB.2.raw
  modified_base (259)..(259): a, c, t, g, unknown or other
  modified_base (273)..(273): a, c, t, g, unknown or other
  modified_base (280)..(280): a, c, t, g, unknown or other
  modified_base (301)..(301): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaatccctgagactctctgtgtgcncctagactcacttnagtagtntggtcttcgtcgtcgggtccnccagtcgtccgaggcgaagggggctgggagtggcgtggggtactttacgttgggtctaggacaggaacccaaaatgaactatacgtaaccgacggtcgggacgttcccgggtagggacgggggtcccctaagttcccaaacccgtacttacccgtaccggaacggggaacctaaacgttacccgaaaacggtaaccgtaaaccccttactaactaccgtagaacctaaaagtacgggaaactaaacgttagaaaggtaggtaaccggaagggtaacgttaaccgggttacccgttttaattaccggtgttcggaaccgtaaccgttacgaagggttacggtagggtaacgttaaggttaaaacggttcgttaacgtcttaaccgtaccgttaccccggttcgtaaccccgttcggtaacccgggg

SEQ ID NO: 413545 - DNA, 692 bp, Homo sapiens
  misc_feature: GZ8MTXP01BMMAV.25.28.C06.1.454.CMB.2.raw
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagactctcctgtgtgcgcctagactcaccttcagtagtatggtcttcgtcgtgggtccgccagtgtccgaggcgaagggggctgggagtgggcgtggggtagtttacgttggtctgacagaaccaaatgaactatactacgacggcgggacgtcccgggtggacgggggtcccgtaattccgaaccctactccgtaccgaacgggaactaaacttacccgaaacgaccgtaaccctactactctacgacaaagtacggaaactaaacgtttaggaaggtaacggtacggaacgggtaacgtaaccgggttacccgttttaagttaccgttggttcggaaccgtaccgttacggaaggttacgggtagggtaccgttaagggttaaaacggttcggttaagttccgtaaccgttacgttcccggttaccgtaacccgttcgggtaacccgggg

SEQ ID NO: 413546 - DNA, 561 bp, Homo sapiens
  misc_feature: GZ8MTXP01A1GKX.25.28.C06.1.454.CMB.2.raw
  modified_base (299)..(299): a, c, t, g, unknown or other
  modified_base (437)..(437): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagactctcctgtgtggcgcctagacctcaccttcagtagtatggcttcgtctgggtccnccagtgtccaggcaagggggctgggagtgggctgggggtagtttacgttggtctgacagaaccaaagtgacatatacacgtcggagtccgtagggacggggccattccacatctacgaggacaattccaagacacctntatctagacaatgaactacgtagacgagtcgagtagtacggtctttatcgtgtcgcgtacttcgaggcgtggacgttaggaaacgttcgtaagtctctcgttccgcgtaaccgttcggtcgggg

SEQ ID NO: 413547 - DNA, 620 bp, Homo sapiens
  misc_feature: GZ8MTXP01BD3DW.25.28.C06.1.454.CMB.2.raw
  modified_base (275)..(275): a, c, t, g, unknown or other
  modified_base (301)..(301): a, c, t, g, unknown or other
  modified_base (378)..(378): a, c, t, g, unknown or other
  modified_base (558)..(558): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaactccctgagactctcctgtgtggcgcctagactcacttnagtatatggcttcgtcgtgggtcccnccgtagtcgtcccgagggcgaagggggctgggagtggcgtgggatttacgtggtctgacagaaccaaatgacatacncacggcggagtcccgggtagggacggggtcctatccgaccctactcctaccgacgggaacaacttaccgaaacgacgtaacccttactactaccgtagaacaaatacgggaaactaacgttaggaagagtacggaaggtacgtacgggtcctttagttactggtcgcgaccgttcgaggnggtcggtacgttaaggaaagttcgtaagtctctacgttcccgacgtaaccgttcggtccggg

SEQ ID NO: 413548 - DNA, 718 bp, Homo sapiens
  misc_feature: GZ8MTXP01D496P.25.28.C06.1.454.CMB.2.raw
  modified_base (162)..(162): a, c, t, g, unknown or other
  modified_base (169)..(169): a, c, t, g, unknown or other
  modified_base (268)..(268): a, c, t, g, unknown or other
  modified_base (272)..(272): a, c, t, g, unknown or other
  modified_base (295)..(295): a, c, t, g, unknown or other
tcagactgtacagtcacgaccggtgctcgatttagagctcacgtattgggtttggggaggagaggagcccagcactagaagtcggcggtgtttccactcggtgatcagcactgaacgcagcggactcaccatggagttggctgactggtttcctcgttgctntttaagnggtgtccagtgtcaggcgcatcgtggtggagtcgtgggggaggcgtggtccagcctgggaagtccctgagctctcctgtgtggccgctagactcacctnagtntatggtcttcgtcgtcgggtccnccagtcgtcccgaggccgaaagggggtctgggggtggtcggtacggttaggggtacgtttacgttggtacagaacaacgaaactaaagtagactataactacgcggacgggtacggtaccgggtacgggacggggtacgtacgtacctacctactaccgtaccgaacggaacgtaactaaccgaaacgaacgtaacctactactactacgtaactaaacgtaacgtaaacgtaacgttaagtaaggtaaggtacggtaacggtaacgttaaccggtttaccgtttaacgtttacgttacggtaacgtaccgttaccgtacggaagggtaacgggtacgggttacggttaaacggttaaaacggttaacggttacgttaaccgttaccgttaccgttacccggttaacccggttcccggtccgg

SEQ ID NO: 413549 - DNA, 605 bp, Homo sapiens
  misc_feature: GZ8MTXP01ANO21.25.28.C06.1.454.CMB.2.raw
  modified_base (301)..(301): a, c, t, g, unknown or other
  modified_base (366)..(366): a, c, t, g, unknown or other
  modified_base (377)..(377): a, c, t, g, unknown or other
  modified_base (450)..(450): a, c, t, g, unknown or other
  modified_base (510)..(510): a, c, t, g, unknown or other
tcagactgtacagtcacgaccggtgctcgatttagagctcacgtattgggtttgggggggagaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggagtcgggggagcgtggtccaggccggggaatccctgagactctcctgtgcagtgtcccgcgtcccaccttccgtcgttttggcattcactgggtcccnccaggcctccgaggcaaggggactgggagtggggtggcggtcagtagtggtgggatggaagtaanggctattttanggacagctccggtgaaacggggcccactcaccatcctccgagacggcagctaccaaagaacctacccttttanctagactaagtacgggaaacgtgacgacgtcgacgacgacggtctcgtacttagttacgngggcggtcggggttcaaggaacggaacggtcggggttcccgggcttccggaacgggctaacggtcgggccgccgggtaacggggaaccgaacggg

SEQ ID NO: 413550 - DNA, 633 bp, Homo sapiens
  misc_feature: GZ8MTXP01B7VOS.25.28.C06.1.454.CMB.2.raw
  modified_base (264)..(264): a, c, t, g, unknown or other
  modified_base (277)..(277): a, c, t, g, unknown or other
  modified_base (306)..(306): a, c, t, g, unknown or other
  modified_base (393)..(393): a, c, t, g, unknown or other
  modified_base (478)..(478): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcgtgggggagcgtggtccagccgtgggaacgtccctgacgactctcctgtgtggcnctagactcacttnagtagtatggtcttcgtcgtcgggtcccncctaggtcgtccgaggggcgaaggggggctggggagtgggcttagggggtatttacgttggtactggacagaaccaaagtgacatanccgacgcgggtagtcccggtggacgggggcctattcaacctatctaccgaggacaacttaccaaagacgtaaccctctactacanaactaagtaacgtaactagtagagtacgaggtacgtacggtacgttacttagtacgtcgcgaaccgtacgaggaggttggtacgtacggttaaaacggttacgttacgtaacgttctaacgttaccgtccgttaccgtaaccgttcgggaaccgg

SEQ ID NO: 413551 - DNA, 737 bp, Homo sapiens
  misc_feature: GZ8MTXP01DNW95.25.28.C06.1.454.CMB.2.raw
  modified_base (271)..(271): a, c, t, g, unknown or other
  modified_base (279)..(279): a, c, t, g, unknown or other
  modified_base (297)..(297): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagactctctgtgtggcgcctagactcacttnagtagtanggcttcgtctgggtcccncagtcgccgaggcgaggggctggagtggcgtgggtattcgttggtctagacagaaccaaagtgaactatacgtaccgacgggcgggtacgttcccgggtagggacgggggccctaattccaaccctactccgtaccgaacgggtaactaaacgttaacccgaaacgtaaccgtaacccttactaacttacgtaacgaaactaaaacgtaacgggtaaaaccgttaaacgttaggaaacggtaacggtaaccgggtaacggtaacgttaaccgggttacccgttttaaacgtttaaccgttacggttcggtaacccggtaaccgttacggtaacgggttacggttacgggtaacggttaaaggggttaaaacggttacggttaacgttaccgttaaccgttaccgttaccccggttaccggtaacccgttccgggtcgggg

SEQ ID NO: 413552 - DNA, 672 bp, Homo sapiens
  misc_feature: GZ8MTXP01B4HUA.25.28.C06.1.454.CMB.2.raw
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagactctcctgtgtggcgcctagactcaccttcagtagtatggcttcgtctcgggtccgccagtgtccaggcgaagggggctgggagtggctgggatttacgtggtctgacagaaccaaatgacatatcgacgcggagtccggtggacggggccagttcaacctatctccgaagggacaaacttaccgaaacgaacgtaacccctctaactctacgactaaactacggaaaacctaaacgtttaggaagtacgggttaccggaagggtaacgttaacccggggttaccgttttaaagtttaaccgtggttacggtaaccggtaacccgttacgtaaggggttacgtagggtaacgttaaagggttaaaaacgttacggttaacggtcttaaccgtaacgttccccggttaccgtaaccgttcggtccggggg

SEQ ID NO: 413553 - DNA, 727 bp, Homo sapiens
  misc_feature: GZ8MTXP01E0WCZ.25.28.C06.1.454.CMB.2.raw
  modified_base (201)..(201): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgaaccaagtctccatcctcctgtctgcatctgttgganacagatcaccatcacgttggccgggcgagtcgagggctagttaggaaattgttcggcctggtatcagacaaggaaaccagggtaacttcctaacctctacatctatcgctgactacttcctactttcgacgttaagtttccgggggtcccttctaacggtattcgacggtcggtacgtgggtcggggttacgtacggggaacctaggttaaactttccgaacctttccctaccaaacccttacgtaccaacgggcctaaccggtacccgtaccgtaccgtaccgtaccgggtaacggtaacggttaacgttacgttaacgttaaccgtttaaaccgtttaaacgtttaaacgtttaaacgttaaaacgttaaaacgtttaacgtaacggtaacggttaaccggttaccgggttacggttacggttaccgggttacccgggttaacccgggttaaccgggttaaccgggtaacgggtaacggtaaccgtaacgtaaccgttaaaccggtaacggttaacggtaacgg

SEQ ID NO: 413554 - DNA, 563 bp, Homo sapiens
  misc_feature: GZ8MTXP01CZPQI.25.28.C06.1.454.CMB.2.raw
  modified_base (301)..(301): a, c, t, g, unknown or other
tcagactgtacagtcacgaccggtgctcgatttagagctcacgtattggggtttggggggagaggagcccagcactagaagtcggcggtgtttccactcggtgatcagcactgaacgcagcggactcaccatggagtttgggctgaacttgggttttcctcgttgctcttttaagaggtgtccagtgtcaggcgcatctggtggagtcgtgggggagcgtggtccagcctgggaatccctgagactctcctgtgtggcgcctagactcaccttcagtagtatggcttcgtcgtgggtcccnccagtgtccaggcaagggggctgggagtgggctgggggagttacttggtctggacagaccaaatgacatatcacgcggagtccgtgggacggggccattcacatctccgaggacaataccaagacgacctctatctgacaaatacggaaacaacttagagagtcgaggtagtacggtccgtttattactgtgcgacttcgaggagtggcgttaaggaaaagttcgtaagtactctacttccgttcgtaaccgttcgtcgggg

SEQ ID NO: 413555 - DNA, 582 bp, Homo sapiens
  misc_feature: GZ8MTXP01DG2HH.25.28.C06.1.454.CMB.2.raw
  modified_base (301)..(301): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtggggggagcgtggtccagcctgggaatccctgagctctcctgtgtggcgcctagactcaccttcagtagtatggcttcgtctgggtcccnccagtcgtccagggcaagggggctgggagtgggctgggggtattacgttggtctgacagaaccaaatgaacatatcacgcggagtccgtggacggggccattccaccatctacgaggacaacttaccaaagacgaaccctctatctagacaaatacggaaactaacgttagagagtacgaggtagtaccggtcttattacgtgtgcgtacttcgaggagtggacgttaggaaaacgttcgtaagtctcgtacgttcccgttacgtaaccgttcgtccgggg

SEQ ID NO: 413556 - DNA, 636 bp, Homo sapiens
  misc_feature: GZ8MTXP01ARU2L.25.28.C06.1.454.CMB.2.raw
  modified_base (260)..(260): a, c, t, g, unknown or other
  modified_base (273)..(273): a, c, t, g, unknown or other
  modified_base (279)..(279): a, c, t, g, unknown or other
  modified_base (296)..(296): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcgtgggggagcgtggtccagcctgggaactccctgagactctctgtgtgcncctagctcacttnagtatnggcttcgtctgggtccnccagtgtccaggcgaagggggctgggagtggcgtggggtagtttcgtggtctgacagaaccaaatgacatatcacggcggagtcccggtagggacggggcctattccaccactctaccgagggactaacttaccaaagacgtaaccctctactctagacaaagtacggaaactaacgttagaagtacgtacggaaggtacgtaccggtaccgtttaattacgtggttcggaaccgtaccgttcggtaagggaggtaggtacgttaagggttaaaacggttcggttaacggtcctaaccgtaccgttccccggttaccgtaacccgttcgggtcccggggg

SEQ ID NO: 413557 - DNA, 652 bp, Homo sapiens
  misc_feature: GZ8MTXP01CRVSM.25.28.C06.1.454.CMB.2.raw
  modified_base (274)..(274): a, c, t, g, unknown or other
  modified_base (299)..(299): a, c, t, g, unknown or other
tcagactgtacagtcacgaccggtgctcgatttagagctcacgtattgggtttgggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcgtgggggagcgtggtccagccgtgggaatccctgagactctcctgtgtggcgcctagctcaccttnagtagtatggcttcgtctgggtccnccagtgtccgaggcaaggggctggagtggctggggattacttggctgacagaaccaaatgaactatataccacggcggagtcccggtgggacgggggccctattccaaccatcctaccgaacgggactaaacgttacccgaaagacgaaccctctatctagacaaactaggaaactaacgttagaagagtacggaaggtaacgttaaccggtaccgttttaagttaaccgtggttacgaaccgtaacccgttcgtaagggttaggtagggtaccgttaaagggttaaaaacgttacggttaacgtaccttcgtaacccgtttcccggttaccgtaacccgttcggttccgggg

SEQ ID NO: 413558 - DNA, 655 bp, Homo sapiens
  misc_feature: GZ8MTXP01AURES.25.28.C06.1.454.CMB.2.raw
  modified_base (297)..(297): a, c, t, g, unknown or other
tcagactgtacagtcacgaccggtgctcgatttagagctcacgtattgggtttgggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaagtccctgagactctcctgtgtggcgcctagactcaccttcagtgtatggcttcgtctgggtcccnccagtcgtccaggcgaagggggctgggagtgggctggggagtttacgtggtctggacagaaccaaatgaacatactacgaacggcgggaagtcccgggtagggacgggggccctaattccgaaccactcgtacccgaagggaacctaaacgttacccgaaacgacgtaaccccttactaactactacgaactaaacttacgggaaactaaccgttagacggtagtacgaaggtaacgtacggtaccgtttaagttaccgtggtcgtccgtaccgttacgtagggagtacgggtacgttaagggttaaaagttcgtaagtcgtaactcgttacccgttccgtaaccgttcggtccgggg

SEQ ID NO: 413559 - DNA, 574 bp, Homo sapiens
  misc_feature: GZ8MTXP01BTLAY.25.28.C06.1.454.CMB.2.raw
  modified_base (259)..(259): a, c, t, g, unknown or other
  modified_base (274)..(274): a, c, t, g, unknown or other
  modified_base (299)..(299): a, c, t, g, unknown or other
  modified_base (369)..(369): a, c, t, g, unknown or other
  modified_base (383)..(383): a, c, t, g, unknown or other
  modified_base (402)..(402): a, c, t, g, unknown or other
  modified_base (435)..(435): a, c, t, g, unknown or other
  modified_base (440)..(440): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcncctagactcaccttnagtagtatggcttcgtctgggtccnccagtgtccaggcgaagggggctgggagtggctggggatttacgtggtctgacagaccaaatgaacatancacgcggagtccgnggacggggcattcacatcncgagggacaattccaaagagaaacctctatctnacaanacggaacaacgtagtagagtacgaggagtacgtccgttattactagtcgcgtccgttcgaggagtacggtcgttaggttaaaacgttacggtaacgtactcgtacgttacccgttccgtaaccgttcgtcgggg

SEQ ID NO: 413560 - DNA, 573 bp, Homo sapiens
  misc_feature: GZ8MTXP01D7DKZ.25.28.C06.1.454.CMB.2.raw
  modified_base (201)..(201): a, c, t, g, unknown or other
  modified_base (226)..(226): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgaccaagtctccatccctcctgtctgcatctgttgganacagatcaccatcacttggccgggngagtcgagggctagttaggaaattattggcctggtatcagacaagaaaccgaggggaaacttcctaacctcctacatctatgctgctactcctactttcgctaagtttcggggtccctctcgattcgagcggctaggtgggtctgggacagattcactctcacatcagcagctgacacgccgtagaagtattgttagtactaactttacttaacgtacgttaaactaaaagtttcgaaacgtaacggtcggttacccggttaggttacgttcgggttacccgggaccggttacggggaacccgtaagggtacggaactaacgtaacgaaacgtaacgttggtaacgg

SEQ ID NO: 413561 - DNA, 588 bp, Homo sapiens
  misc_feature: GZ8MTXP01AQSLG.25.28.C06.1.454.CMB.2.raw
  modified_base (200)..(200): a, c, t, g, unknown or other
  modified_base (225)..(225): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctcctgtctgcatctgttgganacagatcacatcacgttggccgggnagtcgagggctagttaggaaatttagttggccttaggtatcagacaagaaaccgagggtaaacttccaacctctactatctatgctgctatctacgtttcgactaggtttcgggtccctgtacgtattcgagcggtactagggtcgggtctagggactagtacttcactctaccactacgtcagcacgcctgacgtacgtacgtagaagtgttacgtacgtaacttaacgttattaacctacgttaaattaaaagttccgagtaacgtacggttacccggttaggttacgttccggttaaccggaccgttaacgggaaccgtaagggtacgaacgtaactaacgaaacgtaacgttggtaacg

SEQ ID NO: 413562 - DNA, 554 bp, Homo sapiens
  misc_feature: GZ8MTXP01D4GEV.25.28.C06.1.454.CMB.2.raw
  modified_base (280)..(280): a, c, t, g, unknown or other
  modified_base (297)..(297): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaactccctgagactctcctgtgtgcgcctagactcacttcagtagtanggcttcgtctgggtccnccagtgtccaggcaagggggctggagtggctggggattactggtctgacagaccaaatgacatatcacgcggagtccgtgacggggccattcacatctccagggacaattaccaaagacgtaaccctctactctagacaaataggaaactaacttagagagtcgagagtaacggtccgtttatactgtgcacttcgaggagtggacgttaggaaaagttcgtaagtctctacttcccgcgtaaccgttcgtccgggg

SEQ ID NO: 413563 - DNA, 533 bp, Homo sapiens
  misc_feature: GZ8MTXP01C0B6P.25.28.C06.1.454.CMB.2.raw
  modified_base (296)..(296): a, c, t, g, unknown or other
  modified_base (483)..(483): a, c, t, g, unknown or other
tcagactgtacagtcacgaccggtgctcgatttagagctcacgtattgggtttgggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagactctcctgtgtggcgcctagactcaccttcagtagtatggcttcgtctgggtccncagtgtccaggcaagggggctggagtggctgggattacttggtctgacagaccaaatgacatatcacgcggagtccgtgaggggccattcacatctcaggacaattaccaagacgaacctcatctgacaaataggaaacacgttagagagtcgaggatacggtccgttatactgtgcgacttcgagngtggcgttaggaaagttcgtaatctcacttccgcgtaaccgttcgtcggg

SEQ ID NO: 413564 - DNA, 657 bp, Homo sapiens
  misc_feature: GZ8MTXP01A3W93.25.28.C06.1.454.CMB.2.raw
  modified_base (271)..(271): a, c, t, g, unknown or other
  modified_base (278)..(278): a, c, t, g, unknown or other
  modified_base (296)..(296): a, c, t, g, unknown or other
  modified_base (373)..(373): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttggctgaactgggttttcctcgttgctcttttaagaggtgtccagtgtcaggcgcatctgggtggagtcgtggggagcggtgtcgagacgtcgggactcctagagctctctgtgtggcgcctagctcaccttnagtagtnggtcttcgtctgggtccnccagtcgtccgaggccgaagggggctgggagttcgggctggggtacttacgttggtctaggacagaacccgtaaatnacatatacgacgcggacggtccgtcggtacgggacggacgtcgtacctactacgtacgacgggacgtaacgttaccaacgaacgtaacctactacttacgtacgtacgaaagtaacgaactaacgttaagtaacggtaggtaccgaggtacgtacggttacggtttacttaccgttgtcggtaacgtaacccgttcgtacggacggtacggtacgttaacggttaaggttacgttaacggtccttaacgtaccgttaccgttaccgtccgttccggttccgggg

SEQ ID NO: 413565 - DNA, 610 bp, Homo sapiens
  misc_feature: GZ8MTXP01ADLNE.25.28.C06.1.454.CMB.2.raw
  modified_base (302)..(302): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaatccctgagctctcctgtgtggcgcctagactcaccttcagttagtatggcttcggtctgggtcccncagtcgtccgaggcgaagggggctgggagtgggctgggggtatttacgtggtctgacagaaccaaatgaactatactacgacgcggacgtcccggtgggacggggcctatccaccactctccgaggacaattaccaagacgaaccctctatctagacaaactaggaaactaacgttagacgtagtcgaggtacgttacggtaccgtttattacgtgtgcgacgttcgaggagtaggacgttaagggttaaaacgttcggtaacgtcctaacgtaccgttcccgttaccgtaacccgttcggtccgggg

SEQ ID NO: 413566 - DNA, 571 bp, Homo sapiens
  misc_feature: GZ8MTXP01BD29J.25.28.C06.1.454.CMB.2.raw
  modified_base (275)..(275): a, c, t, g, unknown or other
  modified_base (301)..(301): a, c, t, g, unknown or other
  modified_base (508)..(508): a, c, t, g, unknown or other
  modified_base (515)..(515): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttnagtagtatggcttcgtctgggtcccnccagtgtccagggcaagggggctggagtggctggggatttactggtctagacagaccaaatgacatatacacggcggagtcccgtgggacgggggcccattcaaccatctccgagggacaacttacgaaagacgaacctctattacagacaaagtaggaactaacgttgagagtacgagagtacggtcgtttagtactgtgcgaccngaggagnggtagttaggaaaagttcgtaagtctcgtactccgttacgtaaccgttcgtcgggg

SEQ ID NO: 413567 - DNA, 692 bp, Homo sapiens
  misc_feature: GZ8MTXP01CQM6H.25.28.C06.1.454.CMB.2.raw
  modified_base (257)..(257): a, c, t, g, unknown or other
  modified_base (271)..(271): a, c, t, g, unknown or other
  modified_base (279)..(279): a, c, t, g, unknown or other
  modified_base (296)..(296): a, c, t, g, unknown or other
  modified_base (375)..(375): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggatcctgagctctctgtgtggcnctagactcaccttnagtagtanggcttcgtctgggtccnccagtgtccgaggcgaagggggctgggagtggcgtggggtattacgtggtctgacagacaaatgactatactcgacggnggagtcccggtaggacggggcccattccaacctactccgtaccgaagggaacctaaacgttacccgaagtaaccgtaacccttactaactccgttagaactaaaagtacgtaaaaccgtaacgttaagaacgtaacggtacgaacggtaacgttaacccggtaccgttttaacgttaaccgtggttacgaaccggtaacccgttacggtaacggttacgggttacggtaccggttaaagggttaaaacgttacggttaacgtaccgttccgtaccggttacccggttacccgttaaccgttccgggtaacccggggg

SEQ ID NO: 413568 - DNA, 736 bp, Homo sapiens
  misc_feature: GZ8MTXP01AJ08F.25.28.C06.1.454.CMB.2.raw
  modified_base (259)..(259): a, c, t, g, unknown or other
  modified_base (300)..(300): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttggctgaacttgggttttcctcgttgcttcttttaagaggtgtccagtgtcaggcgcatctgggtggagtcgtgggggagcgtggtccagcctggtaacgtccctgagctctctgtgtgcncctagctcacttcagtagtatggtcttcgtcgtgggtcccncgtagtcgtccgagggcgaagggggctgggaggtgggcgtgggtagtttacgttggtctagaacacgaaccaaagtgaactatacgtaccgacggcgggtacgtcccgggtagggaccgggggtaccctacgttccgaaccctacgtacccgtacccggaacgggtaacctaaacgttaacccgaaacggtaacccgtaaaccccttactaacttaccgtacgaacctaaacgtaacggtaaaccgttaaacgttaggaacggtaacggtacggaacggtaacgtttaaccgggttaccgttttaacgttaccgttcggtccgtccggtaacccgttacggtagggttacggtacggtacggttaagggttaaaacgttcgtaacgttcctaacgttacccgttcccgttaccgtcccgttaaccgggtcccgggg

SEQ ID NO: 413569 - DNA, 542 bp, Homo sapiens
  misc_feature: GZ8MTXP01B15H5.25.28.C06.1.454.CMB.2.raw
  modified_base (225)..(225): a, c, t, g, unknown or other
  modified_base (292)..(292): a, c, t, g, unknown or other
  modified_base (332)..(332): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctcctgtctgcatctgttggagacagatcaccatcacttggccgggnagtcgagggcattggaaattgttggcctggtatcagcaagaaaccagggaaacttcctaacctctanatctatgctgcatccactttgactagtttcggggtccctntcattcgagcgcagtgggctgggacagtattcactctacacgatcagcagctagctacgcgtagaagtattcggtacacttaactttacttactagttaaacctaaaagttttcgaactaacggtcggttacccggtaggttacgtcggttcccggacccgttaggggaaccctaagggtcgaactacgacaacgtaacgttggtaacgg

SEQ ID NO: 413570 - DNA, 529 bp, Homo sapiens
  misc_feature: GZ8MTXP01EUXAC.25.28.C06.1.454.CMB.2.raw
  modified_base (225)..(225): a, c, t, g, unknown or other
  modified_base (336)..(336): a, c, t, g, unknown or other
  modified_base (364)..(364): a, c, t, g, unknown or other
  modified_base (398)..(398): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagatcaccatcacttgccgggnagtcagggcattggaaattattggctggtatcagcaagaaaccaggggtaaactttcctaaacctcctacatctatgctgcatcctatttcgctaagtttcggggaccctntacgatttccgagcgggcaggtcgggtntaggggacagaattcactctcacatcagcagctncagcctagaagtatgtagactaacttatactagtactaaaattgaactaagtcgaccgtggagtcggttcggaccgttacggggacctaaggggtaggaacctaagtacgaaacggtaacgttcggtaagg

SEQ ID NO: 413571 - DNA, 545 bp, Homo sapiens
  misc_feature: GZ8MTXP01DAAZW.25.28.C06.1.454.CMB.2.raw
  modified_base (275)..(275): a, c, t, g, unknown or other
  modified_base (300)..(300): a, c, t, g, unknown or other
  modified_base (397)..(397): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaatccctgagactctcctgtgtggcgcctagactcaccttnagtagtatggcttcgtctgggtccnccagtgtccaggcaagggggctggagtggctggggattacttggtctgacagaccaaatgacatatcacgcgagtccgtgacggggccatcacatcncaggacaattccaaagacgaacctctatctgacaaataggaaacaacttgagagtcgagatacggtcgtttatactgtgcgacttcgaggagtggcttaggaaaagttcgtaagtactctacttcccgttcgtaaccgttcgtcgggg

SEQ ID NO: 413572 - DNA, 583 bp, Homo sapiens
  misc_feature: GZ8MTXP01B4RC2.25.28.C06.1.454.CMB.2.raw
  modified_base (261)..(261): a, c, t, g, unknown or other
  modified_base (276)..(276): a, c, t, g, unknown or other
  modified_base (301)..(301): a, c, t, g, unknown or other
  modified_base (395)..(395): a, c, t, g, unknown or other
  modified_base (409)..(410): a, c, t, g, unknown or other
  modified_base (412)..(412): a, c, t, g, unknown or other
  modified_base (432)..(432): a, c, t, g, unknown or other
  modified_base (435)..(435): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaatccctgagactctcctgtgtggcncctagactcaccttnagtagtatggcttcgtctgggtccnccagtgtccgaggccgaagggggctgggagtgggcgtgggggtagtttacgttggcctagaccagaaccaaatgacatatcacgcggagtccgnggacgggcatcacnncncaggacatccaagacacctntanctagacaaatggaaactaacgttagaagagtacgaaggtactaaccgggtcctttatacgtgtcgaacgaccttgaggaggtacggacgttaaggttaaaagttcgtaagtctctacgttcccgttacgtaaccgttcgtaaccgggg

SEQ ID NO: 413573 - DNA, 644 bp, Homo sapiens
  misc_feature: GZ8MTXP01BJ5NO.25.28.C06.1.454.CMB.2.raw
  modified_base (174)..(174): a, c, t, g, unknown or other
  modified_base (259)..(259): a, c, t, g, unknown or other
  modified_base (273)..(273): a, c, t, g, unknown or other
  modified_base (280)..(280): a, c, t, g, unknown or other
  modified_base (299)..(299): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttggctgaactgggttttcctcgttgctcttttaagnggtgtccagtgtcaggcgcatctgggtggagtcgtgggggagcgtggtccagccgtgggaactccctgagactctctgtgtggcncctagctcaccttnagtagtntggcttcgtctgggtcccnccaggtcgtaccgagggccgaagggggctggggagtgggcgtggggtatttcgttggtctagactagaaccaaagtgaacatactacgacggcggacgtccgtgggacggggcctattccactactcgtaccgaacgggactaacgttacgaaacgaacgtaaccctctaactctagaactaaatacgggtaaacctaagttagaagacgtacgtaaggtacgtaaccggttccggtttaattaccgtgtcgtccgtaccgttacggacgggttagtagggacgttaagggaaaacggttcgtaagttcctctacgttcccgttacgtaaccgttccgtccgggg

SEQ ID NO: 413574 - DNA, 700 bp, Homo sapiens
  misc_feature: GZ8MTXP01CTWX4.25.28.C06.1.454.CMB.2.raw
  modified_base (308)..(308): a, c, t, g, unknown or other
  modified_base (418)..(418): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggtttttcctcgttgcttcttttaagaggtgtccagtgtcaggcgcatctggtggagtcgtgggggagcgtggtccagccgtgggaacgtccctgacgactctccgtgtgtggcgcctagactcaccttcagtagtatggtcttcgtcgtgggtccnccgtagtgtcccgagggccgaagggggctgggagtgggcttgggggtatttacgttggtctagacaagaaccaaatgactaatacgtacgacggcgggtagttcccgggngggacgggggcctattccacctactccgtaccgaacgggactaaacgttacccgaaagtaccgtaaaccccttacgtacttacgtacgaactaaaatacggtaaactaacgtttaggaacggtaacggttacggaaggtaacgttaccggttacgtttacgttaacgtcgtcggtaacgtaccgttcggtaaggttaggtacggacgttaaagggaaaacgttcggtaacgttcgtaaccgttaccgttccccggttaccgtaacccgttcggtaaccgggg

SEQ ID NO: 413575 - DNA, 633 bp, Homo sapiens
  misc_feature: GZ8MTXP01CNTHQ.25.28.C06.1.454.CMB.2.raw
  modified_base (378)..(378): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtggggggagcgtggtccggctgggaagtcctgagactctcctgtgtggcgcctagactcaccttcagtagttatggcttcgtcgtcgggtccgccagtgtccaggcgaaggggctggagtggcgtgggtagtttacgtgggtctgacagacaaatgacagtatcgaacgngggaacgtccggtggagggggtcccattccgaccatccgtaccgaggaacaattaccaagacgaaaccctctatctacgacaaatagaaactaacttagaagaggtacgaggaacgttacggtacccggtttattaacgtcggtgccgaaccttacgagggtaggttcggtaagtaacgggttaaaaagttcggttaacggttcctacgtaaccgtttcccggtaccgacccgttccggttcgggggaaccccgg

SEQ ID NO: 413576 - DNA, 584 bp, Homo sapiens
  misc_feature: GZ8MTXP01BYUOP.25.28.C06.1.454.CMB.2.raw
  modified_base (261)..(261): a, c, t, g, unknown or other
  modified_base (276)..(276): a, c, t, g, unknown or other
  modified_base (303)..(303): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaatccctgagactctcctgtgtggcncctagactcaccttnagtagtatggcttcgtcgtgggtcccnccagtgtccgagggccgaagggggctgggagtgggcttgggggatttacgtggtctgacagaccaaatgacatatcacgcggagtccgtggacggggccattcaccatctcgagggacaattaccaaacgacgaaccctctactctagacaaataggaaactaacgttagagagtacgaggacgttacggtaccgtttattacgtgtgcgtacgttcgaggaggtggacgttagggaaaagttcgtaagtctcgtacttcccgttcgtccgttcgtcgggg

SEQ ID NO: 413577 - DNA, 648 bp, Homo sapiens
  misc_feature: GZ8MTXP01APKQK.25.28.C06.1.454.CMB.2.raw
  modified_base (264)..(264): a, c, t, g, unknown or other
  modified_base (278)..(278): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcgtgggggaggcgtggtccaggccgtgggaacgtccctgagactctcctgtgtgcncctagactcacttnagtagtatggtcttcgtcgtcgggtcccgcctaggtcgtcccgagggcgaagggggctgggagtgggcgtgggtagttacgtggtctgacagaaccaaatgaacatatacgacgcggagtcccgggtgggacggggcctattccaacctactcctaccgagggaacctaacttacccgaaacgacgtaacccctgtaactctagaacctaaagtacggaaactaacgttgaaggtacgtacggagtacgtacggtaccgtttaattacgtgcgtaaccgtacttcggagttaggtcggtaacgttaacggttaaaggttccgtaagttcctcgtaccgttccccggacgtaacccgttcggtaaccgggg

SEQ ID NO: 413578 - DNA, 550 bp, Homo sapiens
  misc_feature: GZ8MTXP01BOPVK.25.28.C06.1.454.CMB.2.raw
  modified_base (280)..(280): a, c, t, g, unknown or other
  modified_base (297)..(297): a, c, t, g, unknown or other
  modified_base (396)..(396): a, c, t, g, unknown or other
  modified_base (491)..(491): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagactctcctgtgtggcgcctagctcaccttcagtagtanggcttcgtctgggtccncagtgtccaggcaagggggctggagtggctgggggatttactggtctgacagaccaaatgacatatcacgcggagtcccgtggacggggccattcaccntctcgaggacaattcaagacgaccctctatctgacaaatggaacaacttgagagtcgagagtacggtcctttatacgtgtgcgaccttcgagggngtggcgttaaggaaagttcgtaagtctctacttcccggttcgtaaccgttcgtccgggg

SEQ ID NO: 413579 - DNA, 553 bp, Homo sapiens
  misc_feature: GZ8MTXP01AF5K6.25.28.C06.1.454.CMB.2.raw
  modified_base (297)..(297): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagactctcctgtgtggcgcctagactcaccttcagtagtatggcttcgctgggtccncagtgtccaggcaagggggctgggagtggctggggattacgtggtctgacagaccaaatgacatatcacgcggagtccggtggacggggccattcaccatctccgagggacaattaccaagacgaaccctctatctgacaaatacggaactaacgttgagagtcgaggagtacggtcgtttatactgtgcgcttcgaggagtggcgttaggaaaagttcgtaagtctcgtactcccgcgtaaccgttcgtccgggg

SEQ ID NO: 413580 - DNA, 743 bp, Homo sapiens
  misc_feature: GZ8MTXP01DM2ZV.25.28.C06.1.454.CMB.2.raw
  modified_base (260)..(260): a, c, t, g, unknown or other
  modified_base (275)..(275): a, c, t, g, unknown or other
  modified_base (300)..(300): a, c, t, g, unknown or other
tcagactgtacagtcacgaccggtgctcgatttagagctcacgtattgggtttgggggggagaggagcccagcactagaagtcggcggtgtttccactcggtgatcagcactgaaacgcagcggactcaccatggagtttgggctgaactgggttttcctcgttgctcttttaagaggtgtccagtgtcaggcgcatctggtggagtcgtgggggagcgtggtccagcctgggaacgtccctgagctctcctgtgtggcncctagactcaccttnagtgtatggcttcgtctgggtcccncagtgtcccgaggcgaagggggctgggagtgggcgtggggagtttacgtggtctgacagaccaaatgacatatcacggtcggagtccgggtaggacgggggtccctagttccacccgtactccgtaccgaggggaacctaaacgttacccgaaacgtaaccgtaaaccccttacttaacctaacctaaactaaaacttacggtaaactaaacgtttaggaaacggtaaggtaccggtaagggtacgtttaaccggtaaccggtttttaacttaacgttcgttacgggtacccggtaacccgttcgaacggggtacggggttaggtaaccgggttaaagggttaaaaaacgggttccggtttaacgggtttaaccttacccgttaaccgttttccccgggtacccgttaaccccggtttccgggttccggggggtaaccccggg

SEQ ID NO: 413581 - DNA, 588 bp, Homo sapiens
  misc_feature: GZ8MTXP01EY5KO.25.28.C06.1.454.CMB.2.raw
  modified_base (329)..(329): a, c, t, g, unknown or other
tcagactgtacagtcacgaccggtgctcgatttagagctcacgtattgggtttttgggggaagaggaagactgacggtcctcccaggagttcaggtgctgggcaccttgggcacgggggaggcgtggtccagcctgggaagtccctgagactctcctgtgtggcgcctagactcaccttcagtagttatggcttcgtctgggtccgccagtgtccaggcaaggggctgggagtggctgggagttacttggtctgacagacaaatgacatatcacgcggagtccgtgagggcgattcacatctccagggacaaattccaagagaaccctntaatctgacaaatgaaacaacttgagagtccgaggatacggcctttataactgtgcgactcaggagtggctaggaaaagtcgtaaggtctacattcccgtacgacctcgtcggggccacggggccacccgtcggtccgaccgtctacctcacgccttcccgaccgaaacgggccctacgtccggtccttcccccgtggccgcccgtcgcctccgacggacgcacccgtcgcgggggcacgcgccggtcccgttgggccg

SEQ ID NO: 413582 - DNA, 630 bp, Homo sapiens
  misc_feature: GZ8MTXP01DCGZ7.25.28.C06.1.454.CMB.2.raw
  modified_base (304)..(304): a, c, t, g, unknown or other
  modified_base (325)..(325): a, c, t, g, unknown or other
  modified_base (328)..(328): a, c, t, g, unknown or other
tcagactgtacagtcacgaccggtgctcgatttagagctcacgtattgggtttttggggggaagaggaagactgacggtcctcccaggagttcaggtgctgggcaccttgggcacgggggaggcgtggtccagcctgggaagtccctgagactctcctgtgtggcgcccctagactcaccttcagtagttatggcttcgtctgggtccgccagtgtccaggcaaggggctgggagtggctgggagttacttggtctgacagacaaatgaacatatcacgcggagtccgtgagggcatcacatcncaggacaatcaagagaacctntanctagacaaatgaacaacttgagagtccgaggatacggccgtttataactgtgcgtaaactcgaggagtaggacgtaaggaaaaagtcgtaagtctacacttcccgtacgtaccttcgcggggaccacgggcctacccgtggtccgaccgttcctcctcacgtccttccgaacccgaaacggggccccaacgtcccgggttcccttcccccgtgggtcccccgcccgtccgccgtacccgacggccgccgttacccgtcgggtccggggccgaccggccgggcccggtcccggttcgggtccg

SEQ ID NO: 413583 - DNA, 658 bp, Homo sapiens
  misc_feature: GZ8MTXP01BGQWR.25.28.C06.1.454.CMB.2.raw
  modified_base (262)..(262): a, c, t, g, unknown or other
  modified_base (303)..(303): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaatccctgacgactctcctgtgtggcncctagactcaccttcagtagtatggcttcgtcgtgggtccnccagtcgtccgagggcgaagggggctgggaggtgggcgtgggggtatttcgttggtctgacagaccaaatgaacatatcgacggcggagtcccggtaggacgggggcctattccaccatcctaccgaagggactaattaccaaagacgtaacctctatctagacaaatacggaaactaacgttagaaggtagtaccggaaggtacgttaaccgggttaccgttttaattacgtggtcggtaaccgtaccgttacggaagggttaggtagggtaacgttaaaggggttaaaacggttcggttaacgttcctaacgtaccgttccccggttaccgtaacccgttcggtaaccggggg

SEQ ID NO: 413584 - DNA, 594 bp, Homo sapiens
  misc_feature: GZ8MTXP01BL9C7.25.28.C06.1.454.CMB.2.raw
  modified_base (261)..(261): a, c, t, g, unknown or other
  modified_base (276)..(276): a, c, t, g, unknown or other
  modified_base (302)..(302): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgctcttttaagaggtgtccagtgtcaggcgcatctgggtggagtcgtgggggaggcgtggtccagcctgggaatccctgagactctcctgtgtggcncctagactcaccttnagtagtatggcttcgtctgggtcccnccagtgtccagggcgaagggggctgggaggtggggcgggggtatttacgttgggtctgacagacaaatgactatatcaacggcggaagtccggtggacgggggccattccactatctcgaggacaataccaagacgaaccctctactctagacaaatagaaactaacttaggaagagtacgaggtagtacggtaccgtttattacgtgtcgcgaacctcgaggtagttggacgtaaggaaaacgttcgttacgtcctacgttcccgtcgtaccgttcgtcgggccgaacggg

SEQ ID NO: 413585 - DNA, 599 bp, Homo sapiens
  misc_feature: GZ8MTXP01ADZJC.25.28.C06.1.454.CMB.2.raw
  modified_base (335)..(335): a, c, t, g, unknown or other
  modified_base (353)..(353): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctcctgtctgcatctgttggagacagatcaccatcacgtggccgggcgagtcagggcagttaggaatttagttggcctggtatcagacaagaaacgagggaaacttccaactctacatctatgctgcagtcctatttcgctagtttcggggtccctntaacgtattcgaggcggntaggtgggtcaggggactagtacttcactctacactatcagcacgcctggactacggccttaggaagtacgttcgttacgtaacctaactttattaaccttagtaaaccttaaaagtttcgaactaacgggtacgttacccggttaggttacgttaccgggttaccgggacccggttaacgggttaacccgggtaagggtacggtaacctaaggttaaccgaaacgttaaccggttggttaaccgg

SEQ ID NO: 413586 - DNA, 561 bp, Homo sapiens
  misc_feature: GZ8MTXP01BMQA0.25.28.C06.1.454.CMB.2.raw
  modified_base (258)..(258): a, c, t, g, unknown or other
  modified_base (272)..(272): a, c, t, g, unknown or other
  modified_base (296)..(296): a, c, t, g, unknown or other
  modified_base (366)..(366): a, c, t, g, unknown or other
  modified_base (509)..(509): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggagcgtggtccagcctgggaatccctgagactctctgtgtggcncctagactcacttnagtagtatggcttcgctgggtccncagtgccaggcaagggggctgggagtgggcgtggggatttacgttgggtctgacagaccaaatgacatancacgcggagtccggtggacggggccattccgaccatctccgagggacaacgttacaaacgacgaaccctctatactagacaaataggaaactaacgttagagagtcgaggtatacggtcgttattacgtgtgcgtcttgaggngtggtcgttaggaaagttcgtaagtctctcttccgttcgtccgttcgtcggg

SEQ ID NO: 413587 - DNA, 635 bp, Homo sapiens
  misc_feature: GZ8MTXP01AGYP4.25.28.C06.1.454.CMB.2.raw
  modified_base (387)..(387): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcagatgcaactgggcggaggtcggggggagcggtggtccgaggccggggaagtccctgagactctcctgtgcagtcgtccgccgtcctaccttccgttcgtttggctatcacgtcgggtcccgcgaggcctccgaggcaaagggctggaggtggggtggcgtcagtagtggtgggatagggaaatatgcttatttangacagaacgtccgtggaacgggcccgaactccgaacctatcctaccgagacggcacgcctaaccaaagtaacccttaccttttagctagactaaagttacgaaaaccgtgaacgtacgtcgaacgacgacggtctagtactattacgtcggcggtcggggttaacaggaaacggacgacggggtccggggccttcggttcggctaaggtcggaaccgtccgggtgggggaccctaaggggcctaacgg

SEQ ID NO: 413588 - DNA, 643 bp, Homo sapiens
  misc_feature: GZ8MTXP01BLXUV.25.28.C06.1.454.CMB.2.raw
  modified_base (256)..(256): a, c, t, g, unknown or other
  modified_base (296)..(296): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagctctcctgtgtggcncctagactcaccttcagtagtatggcttcgtctgggtccnccagtgtccaggcaagggggctgggagtggctggggatttacgttggtctgacagaccaaatgacatatcacgcggagtccgtggacggggccattcaccatctaccgagggacaacttaccaaagacgaaccctctaactctagactaaatacggaaactaaacgttagaaggtaagtaccggaaggtaacgttaaccgggttaccgttttaagttaccgtgttcgaaccgtaaccgttcggaagggttacggtagggtaccgttaagggttaaaaacggttcggttaacgttaccgtaacgttaaccgttccccggttaccgtaacccgttccggtaaccggggg

SEQ ID NO: 413589 - DNA, 581 bp, Homo sapiens
  misc_feature: GZ8MTXP01CRAYC.25.28.C06.1.454.CMB.2.raw
  modified_base (302)..(302): a, c, t, g, unknown or other
  modified_base (519)..(519): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtggggggagcgtggtccagcctgggaagtccctgagactctcctgtgtggcgcctagactcaccttcagtagtatggcttcgtcgtgggtcccnccagtcgtccagggcgaagggggctgggagtgggctgggggtattacgttggtctgacagaaccaaatgacatatcgacgcggagtccggtggacggggccattcaccatctccgaggacaattaccaagacgaaccctctactctgacaaatacggaactaacgttagagagtacgaggtacgtacggtcgtttattacgtcgtgcgcttcgaggngtaggcgttaggaaacgttcgtaagtctcgtacttcccgttacgtaaccgttcggtccgggg

SEQ ID NO: 413590 - DNA, 616 bp, Homo sapiens
  misc_feature: GZ8MTXP01EXPZG.25.28.C06.1.454.CMB.2.raw
  modified_base (274)..(274): a, c, t, g, unknown or other
  modified_base (301)..(301): a, c, t, g, unknown or other
  modified_base (393)..(393): a, c, t, g, unknown or other
tcagactgtacagtcacgaccggtgctcgatttagagctcacgtattgggtttggggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaactccctgagactctctgtgtgcgcctagctcaccttnagtagtatggtcttcgtcgtgggtccnccagtcgtccgaggcgaagggggctggaggtggcgtaggggtatttacgttggtctgacagaccaaagtgacatatacacgcggagtccggnggacggggcctattccactactctacgaggtacaattaccaaagacgtaacctctatctagacaaataggaaactaacgttgaagtacgcggagtacgtaccggtcctttaattcgtgtcgtcgaccttggaaggttgtacgggtacgttaaagggttaaaacgttcggttaaggtccttccgtaaccgttccccggttacgtaacccgttcgggtccggggg

SEQ ID NO: 413591 - DNA, 620 bp, Homo sapiens
  misc_feature: GZ8MTXP01A20SN.25.28.C06.1.454.CMB.2.raw
  modified_base (201)..(201): a, c, t, g, unknown or other
  modified_base (230)..(230): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtctccatcctcctgtctgcatctgttgganacagtagtccacatcacgttcggccgggngagtcgagggctagttaggaaattgttcggctaggtatcgagacaaggaaaaccgaggggtaaacttcctaacctcctatatctatgactgactacttcctacgtttcgacttacggtttcggggtcccttcgtacgtattcgacggccgggtacgtagggtcgggtacgtacggggaactagtaacttcacttctaccactactcaacgctacgccctggactacggtactaggtaacgtagtttcggtacttaacttaacttttattaaccgttaagttaaacttaaaacttcggacgtaacgtcggttacccggttgacgtttcggtaccgggcccgaagggttaccgtaagggagaacctagtaacgttaacgtcgttcggtaacg

SEQ ID NO: 413592 - DNA, 614 bp, Homo sapiens
  misc_feature: GZ8MTXP01BSUSM.25.28.C06.1.454.CMB.2.raw
  modified_base (258)..(258): a, c, t, g, unknown or other
  modified_base (299)..(299): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggagcgtggtccagcctgggaatccctgagctctcctgtgtggcncctagactcaccttcagtagtatggcttcgtctgggtcccncagtcgtccaggcaaggggctgggagtggctgggacgtttacttggtctgacagaaccaaatgacatatacacgcggagtcccggtggacggggccagttcacatctcgaggacaacttcaaagacgtaacctctatcgtgacaaatacggaaactaacgttgaagtagtcgaggtacgttaccggtaccgtttattaacgtgtcgccgtaaccgttcgagggaggtacgggacgttaagggttaaaacggttcggttaacggttactccgttaaccgttcccggttaccgtaacccgttcgggtaacccggggg

SEQ ID NO: 413593 - DNA, 650 bp, Homo sapiens
  misc_feature: GZ8MTXP01A0AN3.25.28.C06.1.454.CMB.2.raw
  modified_base (262)..(262): a, c, t, g, unknown or other
  modified_base (277)..(277): a, c, t, g, unknown or other
  modified_base (284)..(284): a, c, t, g, unknown or other
  modified_base (303)..(303): a, c, t, g, unknown or other
  modified_base (368)..(368): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcgtgggggagcgtggtccagcctgggaactccctgacgctctcctgtgtgcncctagactcaccttnagtagtntggcttcgcgtgggtcccncagtgccgaggcgaaggggctggagtggcgtgggtatttcgtggtctagacagaacaatgacatnacgacgcgagtccggtaggacggggcctattccgacctactccgtaccgaacgggtaacctaaacgttacccgaaacgtaccgtaacccttcgtaactctaacgaactaaagtacggtaaactaacgttaggaacgtacggtacgaaggtacgttaaccgggttccgtttattaccgtggttacgccgtaaccgttgaagggttacgtacggtaacgttaaggttaaaacgttcgtaatcctaacgtaccgttcccggttaccgtaaccgttccggtcgggg

SEQ ID NO: 413594 - DNA, 647 bp, Homo sapiens
  misc_feature: GZ8MTXP01DUKSK.25.28.C06.1.454.CMB.2.raw
  modified_base (261)..(261): a, c, t, g, unknown or other
  modified_base (302)..(302): a, c, t, g, unknown or other
  modified_base (327)..(327): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctgggtggagtcgtgggggagcgtggtccagcctgggaactccctgagactctctgtgtggcncctagactcacttcagtagtatggcttcgtctgggtccccncgtagtcgcgaggcgaggggctggngtggcgtagggtatttcgtgtcagacaagaacaatgaactatacgtaccgacggcggtacgtccgggagggacggggtcctattcccacctactccgtaccgaacggtaactaacgttaccgaaacgtaacctaaccctactactctacgaactaaacgtacggtaaactaacgttagaacgtacgtacggaggtaacgttaccggttacgtttagtacgtcgtcgtaaccgtacgttcggaggttaggtacggtaacgttaaggttaaacgttcgtaactcgtaaccttaccgtcccgttaccgtcccgttcggtcggg

SEQ ID NO: 413595 - DNA, 568 bp, Homo sapiens
  misc_feature: GZ8MTXP01CBQ4F.25.28.C06.1.454.CMB.2.raw
  modified_base (297)..(297): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagctctcctgtgtggcgcctagactcaccttcagtagtatggcttcgtctgggtccnccagtgtccagggcaagggggctgggagtgggctggggagttacttggtctgacagaccaaatgacatatcgacgcggagtccgtggaggggccattcacatctcagggacaattaccaagacgaacctctatctagacaaatacggaaactaacttagacgagtacgaggagtacggtaccgtttattacgtgtgcgtaaccttcgaggagtggcgttaggaaaacgttcgtaagtctctacgttcccgttcgtaaccgttcgtccgggg

SEQ ID NO: 413596 - DNA, 715 bp, Homo sapiens
  misc_feature: GZ8MTXP01A0BCU.25.28.C06.1.454.CMB.2.raw
  modified_base (301)..(301): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggagcgtggtccagccgtgggaagtccctgagactctcctgtgtgcgcctagactcaccttcagtagtatggcttcgcgtgggtccncagtgtccagggcgaagggggctgggagtggcgtggggtagtttacgtggtctgacagaaccaaatgactatataccgacggcgggacgtccggtagggacgggggtccctattcccgaacctacttccgtacccggaacgggaacctaaacgttacccgaaacggtaaccgtaaaccccttaccttaacgtactacgaactaaaacgtacggtaaacctaaacgtttacggaacgtaacggtaccggtaaggtaacgttaacccgggttaccgttttaacgtttaacgtacggttcggtaaccgtaaccgttcgaagggttacggtagggtacgttaacgggttaaaaagttccgttaagttccgtaaccgttaacgttcccggttacccgtaaccgttcggtaacccggggg

SEQ ID NO: 413597 - DNA, 671 bp, Homo sapiens
  misc_feature: GZ8MTXP01AZBIF.25.28.C06.1.454.CMB.2.raw
  modified_base (215)..(215): a, c, t, g, unknown or other
  modified_base (285)..(285): a, c, t, g, unknown or other
  modified_base (531)..(531): a, c, t, g, unknown or other
  modified_base (566)..(566): a, c, t, g, unknown or other
  modified_base (605)..(605): a, c, t, g, unknown or other
tcagactgtacagtcacgaccggtgctcgatttagagctcacgtattgggtttgggctgagctgggttttcctcgttgctcttttaagaggtgtccagtgtcaggtgcagctggtgcagtctgggggaggcgtggtccaccctgggaggtccctgagactctcctgtgcagcctctggattcatcttcaacacctatgcaatgcacgtgggtccnccaggcctccgaggcgaagggctgggagtgggtgctagttattcatatgataggaaactaaataaaagtntgtagactcggtgcggcatcaccgtctaccagagacagactacgaaagaacgtggtatataccctaaccaaaactaccaaaaccgtaaccctaagaacgtaacgtacccgaaagggacctaaccgggtgttacgttaagttaacttagttcggaggacggaggaaacgccgggtcggggaccgtacgtaccgggttccccgaaccccgaaaggaacgttccggacttaaccgtagttaccccgaanaggtcgaactaggtcggaggggacgaaacggaccncggtaacacgttcggtcccttcgtcctacggttaccccnccgaaaaccgggccgggcccttaacgttcccgggttcccccttacccccgggtgcccccggttccg

SEQ ID NO: 413598 - DNA, 740 bp, Homo sapiens
  misc_feature: GZ8MTXP01EH25G.25.28.C06.1.454.CMB.2.raw
  modified_base (278)..(278): a, c, t, g, unknown or other
  modified_base (286)..(286): a, c, t, g, unknown or other
  modified_base (305)..(305): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggtttttcctcgttgcttctttttaagaggtgtccagtgtcaggcgcatctgggtggagtcgtgggggagcgtggtccagccgtgggaatccctgagctctcctgtgtggcgcctagactcaccttnagttagtntggcttcgtctcgggtccnccagtgccgagggccgaagggggctgggagtgggcgtggggtatttacgtggtctagaacagaaccaaaagtgaactatactaccgaacggtcgggacggtttcccggaggggacgggggaccctaattccgaaaccctactaccgtaccgaacgggaacctaaacgttacccgaaaacggtaccgtaaaccccttactaactaccgtacgaactaaaacgtacgggtaaaacctaaacgttacgaaggtaacggtaacggtaacggtaacggttaacccggttaccgttttaacgtttacgtcgtcggtaaccgtaccttcggtaagggttaggtacgggtaacgttaacgggttaaaaaggttaccggttaacgttccgttaaccgttacccgttaccccggttaccgtaacccggttcgggtaacccggggg

SEQ ID NO: 413599 - DNA, 560 bp, Homo sapiens
  misc_feature: GZ8MTXP01B7NJP.25.28.C06.1.454.CMB.2.raw
  modified_base (276)..(276): a, c, t, g, unknown or other
  modified_base (291)..(291): a, c, t, g, unknown or other
  modified_base (335)..(335): a, c, t, g, unknown or other
  modified_base (355)..(355): a, c, t, g, unknown or other
  modified_base (369)..(369): a, c, t, g, unknown or other
  modified_base (420)..(420): a, c, t, g, unknown or other
  modified_base (492)..(492): a, c, t, g, unknown or other
  modified_base (499)..(499): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaatccctgagactctctgtgtgcgctagctcacttcagtatngcttcgctgggtccncagtcgccaggcgaaggggctggagtggctgggattcgtggtcngacagaacaaatgaacatancacgcggagtccgngggacggggctatccactatcacgaggacaacttccaaagacctaaccctntactcagacaaattcgaaactacgttagagtagtcgaagacgttacgttctttaattcctgtcgcgtaaccnggaaggngtacggtattaaagggaaattccgtaagtctcctacgtcccgttactcccgttggtccggg

SEQ ID NO: 413600 - DNA, 623 bp, Homo sapiens
  misc_feature: GZ8MTXP01DRSU2.25.28.C06.1.454.CMB.2.raw
  modified_base (336)..(336): a, c, t, g, unknown or other
  modified_base (436)..(436): a, c, t, g, unknown or other
tcagactgtacagtcacgaccggtgctcgatttagagctcacgtattggggtttgggggcagaagtctctctcagtcaggacacagcatggacatgagggtccctgctcagctcctgggacctcctgctgctctggcctcccagctatcagatgtggcatccagatcgacccagtcctccactcctccctgtctgctatctgtggagacagatcacatcacgtggccgggcgagtcgagggtctaagttaggtaaattgttcggccttaggtactacgagacgaaacggaaaaccgaggggtaaacctttaccctaaccctctactatctatgctnactacttctactttgacgtacggtttcgggtaccctctaacgattcgagtcggactgggtcggcgtaggaactagtacttcactactccactaactcacncgacgccgtgacgacgtacggtaagtaaggtattaggttacgtaccttaaactttaactttaaaccgttaattaaactaaaagtttcgaaaccgtaaggttaccgttacggtacggttacgttcgggtacccgacccggttagggaaccgtaaggtagaacgtacgtaccgaaagtcgttggtaacg

SEQ ID NO: 413601 - DNA, 618 bp, Homo sapiens
  misc_feature: GZ8MTXP01A1LML.25.28.C06.1.454.CMB.2.raw
  modified_base (264)..(264): a, c, t, g, unknown or other
  modified_base (279)..(279): a, c, t, g, unknown or other
  modified_base (285)..(285): a, c, t, g, unknown or other
  modified_base (413)..(413): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtgggtggagtcgtggggggagcgtggtccagccgtgggaatccctgagactctctgtgtggcncctagactcaccttnagtatntgcttcgctgggtccccagtgtccaggcgagggggctgggagtggcgtggggtatttacgtggtctgacaagaacaaatgaactatatcgacggcgggagtcccgggtagggacggggcctattcacnctcacgaggacaatacaaagacgtaaccctctactctagactaaacgtagtaaactaacgttagaagtacggtaccgaggtaacgttaccggtccgttttaatacgttcgtcgaaccgtacgttacgaggttagtacggacgttaaaggaaaacgttcggtaatcgtaacctacgttcccgttacgtaacccgttcggtcccggg

SEQ ID NO: 413602 - DNA, 596 bp, Homo sapiens
  misc_feature: GZ8MTXP01EMUB8.25.28.C06.1.454.CMB.2.raw
  modified_base (276)..(276): a, c, t, g, unknown or other
  modified_base (283)..(283): a, c, t, g, unknown or other
  modified_base (300)..(300): a, c, t, g, unknown or other
  modified_base (407)..(408): a, c, t, g, unknown or other
  modified_base (437)..(437): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctgggtggagtcgtgggggagcgtggtccagcctgggaactccctgacgctctccgtgtgtgcgctagctcaccttnagtatanggcttcgtctgggtccnccagtcgtccagggcaagggggctgggagtgggcgtggggtatttacgtggtctagacagaaccaaatgaactatatcgacggcggagtccgtgacggggcatcacnnctacaggacaattacaaagacgaaccctntactctagaacaaatacggaaactaacgttagagagtacgagtagtacggtactttattactcgtgaaccgtcttacggaggttaggtggtacgttaagggttaaacgttcgtaagtctaactacgttcccgttacgtaacccgttcggtaacccgggg

SEQ ID NO: 413603 - DNA, 763 bp, Homo sapiens
  misc_feature: GZ8MTXP01DOJML.25.28.C06.1.454.CMB.2.raw
  modified_base (262)..(262): a, c, t, g, unknown or other
  modified_base (275)..(275): a, c, t, g, unknown or other
  modified_base (300)..(300): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtggggggagcgtggtccagccgtgggaatccctgagactctcctgtgtgcncctagctcacttnagtagtatggcttcgtctgggtccncagtcgccagggcaagggggctgggagtgggcgtggggtagtttacgttgggtctaggacaggtaaccaaaagtgaactataagtccgaacggtcgggaacgttcccggtaggggaaccggggggtcccctaatttcccaaacccgtaacgttcccgttacccggaaacggggtaaccctaaacgtttaccccgaaaacggtaacccgtaaacccccttactaacttactacggaaacctaaaacgtaacggggtaaaacctaaaccgtttaggaaacgggtaacggtaacggtaaacgggtaacggtttaaaccgggttacccggttttaaagttaaccgtggttacggaaccgtaccgttacggtaagggttacggtagggtacgttaaagggttaaaacgttcggttaaggttacctaacgttaccgttcccgaccggtaaccgttcgggtaaccggggg

SEQ ID NO: 413604 - DNA, 592 bp, Homo sapiens
  misc_feature: GZ8MTXP01ELZHV.25.28.C06.1.454.CMB.2.raw
  modified_base (260)..(260): a, c, t, g, unknown or other
  modified_base (299)..(299): a, c, t, g, unknown or other
  modified_base (382)..(382): a, c, t, g, unknown or other
  modified_base (443)..(443): a, c, t, g, unknown or other
  modified_base (507)..(507): a, c, t, g, unknown or other
  modified_base (519)..(519): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtggggggagcgtggtccagcctgggaagtccctgagactctcctgtgtggcncctagactcacttcagtagtatggcttcgtctgggtccncagtgccaggcaaggggctggagtggctgggatttacgtggctgacagaaccaaatgaacatactcacggcgggagtcccggnggaacgggggtcccattcaacccatcctccgaagggactaaattaccgaaagacaaccctntaactacaacaaatcgaaactaacttaggaagagtacgaggatacggtaccgtttatactgtcncgaacctgaggngttaggctaagggaaaaagttcgttaagttctactaacgtttccccggtcgaccgttcgttcggggaacccgg

SEQ ID NO: 413605 - DNA, 613 bp, Homo sapiens
  misc_feature: GZ8MTXP01CZSKO.25.28.C06.1.454.CMB.2.raw
  modified_base (177)..(177): a, c, t, g, unknown or other
  modified_base (262)..(262): a, c, t, g, unknown or other
  modified_base (277)..(277): a, c, t, g, unknown or other
  modified_base (302)..(302): a, c, t, g, unknown or other
  modified_base (383)..(383): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttggctgaacttgggttttcctcgttgcttcttttaagnggtgtccagtgtcaggcgcatcgtggtggagtcgtgggggagcgtggtccagcctgggaatccctgacgctctccgtgtgtggcncctagactcaccttnagtatatggcttcgtctgggtcccnccagtcgtccgaggcgaagggggctgggagtggcttgggggtattacgtggtctgacagaaccaaatgacatagtacacgnggtacgtccggtagggacggggccattcacactctacgaggacaacttaccaagacgtaaccctctatcctagaacaaattacggaaactaacgttagagagtacgaggtacgtaacggtcgtttaattacgtgtcggaaccgtacccgttgacgggttagtaggacgttaaaggaaaacgttcgtaagtctaacgtacgttcccgttacgtaacccgttcggtccgggg

SEQ ID NO: 413606 - DNA, 602 bp, Homo sapiens
  misc_feature: GZ8MTXP01EUVUJ.25.28.C06.1.454.CMB.2.raw
  modified_base (263)..(263): a, c, t, g, unknown or other
  modified_base (278)..(278): a, c, t, g, unknown or other
  modified_base (302)..(302): a, c, t, g, unknown or other
  modified_base (391)..(391): a, c, t, g, unknown or other
  modified_base (537)..(537): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgcttctttaagaggtgtccagtgtcaggcgcatctggtggagtcgtggggggaggcgtgggtccagcctgggaacgtccctgagactctcctgtgtggcncctagactcaccttnagtagtatggcttcgctgggtccncagtgtccagggcaagggggctggaggtggcgtgggggagtttactggtctggacagaaccaaatgaacatatcacgcggagtcccggnggacggggcctattccacatctccgagggacaattacaaacgcgaaccctctatcagtacaaatacggaactaacgttagaagagtacggaaggtagtaccggtacgtttattacgtgttgcgtaccttcgagggagtacggggtnaaaggttaaacggttacggtaagtcgtaactccgttaccggttaccggtaaccgttcgggtcggg

SEQ ID NO: 413607 - DNA, 631 bp, Homo sapiens
  misc_feature: GZ8MTXP01BLDP8.25.28.C06.1.454.CMB.2.raw
  modified_base (226)..(226): a, c, t, g, unknown or other
  modified_base (434)..(434): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgaccaagtcctccatcctcctgtctgctatctgtgagacagactcacatcacgttggccgggngagtcgagggtctagttaggtaaattgttcggcctggtatcgagacaacgaaacgagggtaaacttccctaacctctactattctatcgctagctactccttacgtttcgaccgtttacggtttccgggggtcccttacgtaccgttaattccgaggtcggtcgtagggttgggtacgtagggactagtactcactctaccacgtacncagcgacgccgtagacgtacgtaccggtagtaacgtacgtttacggttacctacttaaacgttttactttaaccgttaagttaaaccttaaaagtttcgaacgtaacggttcggttaccggttaggttacgttacggtacccggttaccggagggttaccgtaaggtacgaactacggtacaacgtgttcggtaacg

SEQ ID NO: 413608 - DNA, 660 bp, Homo sapiens
  misc_feature: GZ8MTXP01BBMG4.25.28.C06.1.454.CMB.2.raw
  modified_base (205)..(205): a, c, t, g, unknown or other
  modified_base (485)..(485): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtcctccactccctccctgtctgcatctgttgganacagactcaccatccacgttcgggcccgggacgagtcgaggggtctaagttaggtaaatttgttcgggccttaggtactcgacgacgaaacgtaaaaccgaggggtaaaacctttccctaaaccctcctactacttccgtagtcgtctcgacctactcctacgttttgaccgttaaggtttccgggggtacccttctaacggtaacttcggaggccgggttcgagggtttcggggtaccgtggggaaactaggttacttccactacctacacatcagccncgcacgacgacgtacggtagtagtacgttacgtacgtaacgttaacttaacttacgttaacgttaaacttaaacgttacgtacgtaacgtacgttacggtacgttacgtacggtacggttaccggacggacggtaacggtacgtaacgtaacgtacgttaacgtaacgttcgtcg

SEQ ID NO: 413609 - DNA, 571 bp, Homo sapiens
  misc_feature: GZ8MTXP01A71KZ.25.28.C06.1.454.CMB.2.raw
  modified_base (257)..(257): a, c, t, g, unknown or other
  modified_base (272)..(272): a, c, t, g, unknown or other
  modified_base (517)..(517): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagactctctgtgtggcncctagactcaccttnagtagtatggcttcgtcgtgggtcccgccagtgtccagggcaagggggctgggagtgggcgtggggtagtttacgtggctgacagaaccaaatgaacatatccgaacgcggagtcccggtgacgggggcctattcacatctacgaggacaacttcaagacgaccctctaatctagacaaataggaaactaacgttagaagtagtacgaggactacggtccgttatacgtgtgcgtaaccttgagngtggcttaggaaacgttcgtaagtctctagtcccgacgtaaccgttcgtcgggg

SEQ ID NO: 413610 - DNA, 550 bp, Homo sapiens
  misc_feature: GZ8MTXP01CXS77.25.28.C06.1.454.CMB.2.raw
  modified_base (298)..(298): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaagtccctgagactctcctgtgtggcgcctagactcacttcagtagtatggcttcgtctgggtcccnccagtcgtccaggcaagggggctggagtggctggggtattacgttggtctgacagaccaaatgacatatcacgcggagtccgtggaggggccattcacatctcaggacaatacaagacgacctctatcagacaaatggaaactaacttgagagtacgaggactacggtcttatacgtgtgcgaccgttgaggagtaggcgttaggaaaagttcgtaagtctcgactcccgttacgtaaccgttcgtccgggg

SEQ ID NO: 413611 - DNA, 657 bp, Homo sapiens
  misc_feature: GZ8MTXP01EXBIL.25.28.C06.1.454.CMB.2.raw
  modified_base (273)..(273): a, c, t, g, unknown or other
  modified_base (279)..(279): a, c, t, g, unknown or other
  modified_base (296)..(296): a, c, t, g, unknown or other
  modified_base (371)..(371): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaactccctgagctctcctgtgtgcgcctagctcacttnagtgtntggcttcgctgggtccncagtcgccaggcaagggggctgggagtggcgtggggtatttcgtggtctagaacagaaccaaagtgaactatacncgaacggtcggacgtccgggtggacgggggtccctattcccaacctacgtccgtaccgaacgggtaactaaacttacccgaaagtaaccgtaacccttactaactcctaacgaaacctaaaagttacgggtaaaacctaaacgttacgaaggtaacggtaccgaagggtaacgttaccgggtaccgtttattacgtgtcgcgtaccgttggaggttaggtaggtacgttaagggttaaacgttcggtaagtctctacgttcccgttacgtaaccgttcggtcgggg

SEQ ID NO: 413612 - DNA, 637 bp, Homo sapiens
  misc_feature: GZ8MTXP01ALDTX.25.28.C06.1.454.CMB.2.raw
  modified_base (261)..(261): a, c, t, g, unknown or other
  modified_base (282)..(282): a, c, t, g, unknown or other
  modified_base (302)..(302): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaagtccctgagtctctctgtgtggcncctagactcacttcagtagtntggtcttcgtctcgggtccncagtcgtccgaggcgaagggggctggagtggcgtggggatttcgtggctgacagaccaaatgacatatacgacgcggagtccgtaggacgggggcattcaccatctacgaggacaactaccaagacgtaccctctactctagactaaatacggtaaactaacgttagaagtacgtacggaaggtaacgttaccggttaccgtttagttaaccgtcggttcgaaccgtaccgttacggagggttagggtacgggtacgttaagggttaaaaacggttcggttaagttccgtaaccgtaccgttcccggttaccggtaaccgttcggtaaccggggg

SEQ ID NO: 413613 - DNA, 687 bp, Homo sapiens
  misc_feature: GZ8MTXP01A2W71.25.28.C06.1.454.CMB.2.raw
  modified_base (260)..(260): a, c, t, g, unknown or other
  modified_base (274)..(274): a, c, t, g, unknown or other
  modified_base (281)..(281): a, c, t, g, unknown or other
  modified_base (299)..(299): a, c, t, g, unknown or other
  modified_base (507)..(507): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagccgtgggaactcctgagactctctgtgtgcnctagactcaccttnagtagtnggtcttcgctcgggtccnccaggtgtccgagggcgaagggggtctagggggagtcgggcgtagggggtatttacgttgggttccaggaacctaaggaacccctaaaagtcgaaccagttactaaccgaacgggtcgggaggttcccgggagggaccgggggcctacttaccaaccctactccgtaccgaacgggactaaacttaccgaaacgtaccgtaacccctntatcctagaacaaatcggaaactaacgttaggaacgtagtacggaagtacgttaccggtacctttaagtacgttcggtacgtccgtacgttcgagggttacgtaggtacggttaaggaaaacggttcggtaacgtcgttcctacgttccccgttaccggtaacccgttcggtaaccgggg

SEQ ID NO: 413614 - DNA, 585 bp, Homo sapiens
  misc_feature: GZ8MTXP01DSHY7.25.28.C06.1.454.CMB.2.raw
  modified_base (214)..(214): a, c, t, g, unknown or other
  modified_base (286)..(286): a, c, t, g, unknown or other
  modified_base (340)..(340): a, c, t, g, unknown or other
  modified_base (366)..(366): a, c, t, g, unknown or other
  modified_base (495)..(495): a, c, t, g, unknown or other
  modified_base (572)..(572): a, c, t, g, unknown or other
tcagactgtacagtcacgaccggtgctcgatttagagctcacgtattgggtttgggctgagctgggttttcctcgttgctcttttaagaggtgtccagtgtcaggtgcagctggtgcagtctgggggaggcgtggtccaccctgggaggtccctgagactctcctgtgcagcctctggattcatcttcaacacctatgcaatgcactgggtccnccaggcctccgaggcgaaggggctgggagtgggtgctagtttattcatatgataggaaactaaataaaagtntgttgactccgtggcggcatcacgtctcagagacagatccgaaagaagacggtntactcctacaaatcaaacacctagantcgagacacgctgtgtatactgtgacgagagacgtcggggcgcgacggtccgaccccgaaggaacgtccggacttacgtacgttaccggaacagtcggactagtccggtagggggaccgaacgggaccncgggtaacacgttccggttccttccgtcgtcgcccttaccgaccgaacgggtcccaagttcccggtcccttccccgnggttcccgtcccg

SEQ ID NO: 413615 - DNA, 745 bp, Homo sapiens
  misc_feature: GZ8MTXP01B76S4.25.28.C06.1.454.CMB.2.raw
  modified_base (262)..(262): a, c, t, g, unknown or other
  modified_base (275)..(275): a, c, t, g, unknown or other
  modified_base (282)..(282): a, c, t, g, unknown or other
  modified_base (303)..(303): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttacttttaagaggtgtccagtgtcaggcgcatcgtggtggagtcgtgggggagcgtggtccagccgtgggaactcctgatctctctgtgtggcnctagctcaccttnagtagtntggtcttcggtctcgggtccnccgtagtcgtccgagggacgagggggtctaggggagtgggtcgtagggggtacgtttacgttgggtacctaggaaacaaggtaaacccaaagtgaaactagtactacccgaacgggcgggtaacgtcccgggtaggggacgggggtccctaatttacccaccctacttaccgtacccggaagggaacctaaacttacccgaaacggtaaccgtaaaccctactaacttacctacgaacctaaaagttacggaaaactaacgttagaaaggtacggtacggaacggtaacgttaaccgggttaccgtttaacgttactcggtcgtaacccgtaaccgttcgtaagggttaggtacggtaagttaaacgggttaaaaggttccgtaacgttaccgttaaccgtaccgttccccggttaccgtaacccgttcgggtaacccgggg

SEQ ID NO: 413616 - DNA, 716 bp, Homo sapiens
  misc_feature: GZ8MTXP01B0U14.25.28.C06.1.454.CMB.2.raw
  modified_base (201)..(201): a, c, t, g, unknown or other
tcagactgtacagtcacgaccggtgctcgatttagagctcacgtattggggtttgggggcagaagtctctctcagtcaggacacagcatggacatgagggtccctgctcagctcctgggactcctgctgctctggctcccagctatcagatgtggcatccagatgaccaagtctccatcctcctgtctgcatctgttgganacagatcaccatcacttggccgggcgagtcgagggcattggaaattattggctggtatcagacaagaaaccgaggggtaaacttcctaaacctcctacattaccgtattcggcttcgactaactcccgtaactttttcggaccttaaacggttttcgggggtacccccttgttacccggaatttcccgaaagggtcccgggtaccgtagggttcggggtccgttagggggaaacctaggtaaacttccgtaacctctaccaaccctaattccgaacggccacggccttcggacacgaccggtacgtaaggtaagttacggttagtaactaaaccgtttaactttaacgttaacgttaaacgttaaaactttaacgtaaagtaacgttacggttaaccccgggttacggttaggttacggtttaccgggttacccgggttaacggggttaaacccgggaacgggttaaggggtaaccaaaggttaaccaaacgtaaaccgttaacggttaacgggg

SEQ ID NO: 413617 - DNA, 615 bp, Homo sapiens
  misc_feature: GZ8MTXP01DDOOP.25.28.C06.1.454.CMB.2.raw
  modified_base (259)..(259): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatcgtggtggagtcgtgggggagcgtggtccagccgtgggactccctgagctctctgtgtgcncctagctcacttcagtagtatggcttcgtcgtgggtcccgccaggtgtcccgagggcgaagggggctgggagtgggcgtggggtattcgttggtctagacagaaccaaatgacatactcgacggcggagtcccggtgggacggggcccattccactactctccgagggactaattaccaaagacgaacctctactactgacaaatacggaaactaacttagaagagtacgaggtacgttacggtacgtttattacgtggtcgtaacgtaccttacggaggttaggtgggtacgttaagggttaaaacgttcggtaacgtctctacgttcccggttacgtaaccgttcggtccgggg

SEQ ID NO: 413618 - DNA, 603 bp, Homo sapiens
  misc_feature: GZ8MTXP01C2KYV.25.28.C06.1.454.CMB.2.raw
  modified_base (299)..(299): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcgtgggggagcgtggtcagcctgggaatccctgagctctctgtgtggcgcctagactcaccttcagtagtatggcttcgtctgggtccnccagtgtccgaggcaagggggctgggagtgggcgtggggtagttacgttggtctgacaagaccaaatgactatatcacgcggagtccgtggacggggccattcacatctcaaggacaattaccgaaagacgaaccctctatctagaacctaaatacggaaactaacgttgaacgagtacgaggtacgttaacggtccgtttaagttacgtgtcgtaaccgtacttcgagggagtagggtacgttaagggttaaaagttcgtaagtctctacgttcccgttaccgtaaccgttcggtaaccgggg

SEQ ID NO: 413619 - DNA, 681 bp, Homo sapiens
  misc_feature: GZ8MTXP01CO4ON.25.28.C06.1.454.CMB.2.raw
  modified_base (267)..(267): a, c, t, g, unknown or other
  modified_base (280)..(280): a, c, t, g, unknown or other
  modified_base (288)..(288): a, c, t, g, unknown or other
  modified_base (306)..(306): a, c, t, g, unknown or other
tcagactgtacagtcacgaccggtgctcgatttagagctcacgtattggggtttggggggggagaggagcccagcactagaagtcggcggtgtttccactcggtgatcagcactgaacgcagcggactcaccatggagtttgggctgaacttggggttttcctcgttgcttcttttaagaggttgtccagtgtcaggcgcatcgtggtggagtcgtgggggagcgtggtccagccgtagggaacgtccccgagactctctgtgtgcnctagctcaccttnagtagtanggcttcgtcgtcggtccncagtcgtccgaggcgaaggggctggaggtggcgtgggtagtttcgtggtctgacagaactaaagtgaactatactcaaacgggcgggtaagtccgggtagggaacgggggtccctattaccgacctataccgtaccgaacgggtaactaaacttacccgaaagtaaccgtaaaccccttactaactactagtaaccaaaagttacgaaactaacgtttaggaagagtacggaaggtacgttacggtacgtttacttacgtcggtacgccggtaacctaggagggtaggttacggtaacggtaaggttaaaaacggttgttacgttctacgttaaccgttcccggacgttacccgtcgggttaacggggaacccgg

SEQ ID NO: 413620 - DNA, 632 bp, Homo sapiens
  misc_feature: GZ8MTXP01A9X5I.25.28.C06.1.454.CMB.2.raw
  modified_base (231)..(231): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtcctccactccctccctgtctgcatctgtgagacagacgtcaccatcacgttggccgggngagtcgagggctagttaggaaattagttggctggtatcagacaagaaaccgagggtaaacttcctaacctcctacatctatgctgactactccgtactttcgtacgttaacgttttcgggggtacccctcgttaccgtaagttccgaagggccgggtactacggggttcggggtacgtaggggtacctaagttaacttccacttcctaccaacacgtacacgaccacggtctacgacgtacgaccggtaagagtaagttggttacacttaaactttattaccgtaattaaaccgtaaatttacgacgtaacggtcggttaccggtagttaccgtacggttcccgggaacccgttgggaaccgaagggttagaacacgtaacgaaacgtaagttcgtaacgg

SEQ ID NO: 413621 - DNA, 667 bp, Homo sapiens
  misc_feature: GZ8MTXP01A2ERW.25.28.C06.1.454.CMB.2.raw
  modified_base (284)..(284): a, c, t, g, unknown or other
  modified_base (302)..(302): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagttgggctgaacttgggttttcctcgttgcttcttttaagaggtgtccagtgtcaggcgcatcgtggtggagtcgtgggggagcgtggtccagccgtgggaactccctgagactctctgtgtggctcctagactcaccttcagtagtanggcttcgtctgggtcccnccgagtcgtccagggtcaagggggctgggagtggcgtggggattcgtggtctgacagaccaaatgacatcacgacgcggagtccggtggacgggggccaattccgacctatccgtaccgagggacaacttaccaaagacgaaccctcatctagacaaatacggaaactaacgttagacgtaagtacggaacgtaacgtacggttaccgtttagttaaccgttcggtcgtaaccgtaaacccgttgtaaacgggttacgtacgggtaaccgttaaaggggttaaaaaacgttccggttaacggtacccttaaccgttacccgttaccccggttacccggtaaccccgttcggggtaaccccggggg

SEQ ID NO: 413622 - DNA, 700 bp, Homo sapiens
  misc_feature: GZ8MTXP01B9184.25.28.C06.1.454.CMB.2.raw
  modified_base (285)..(285): a, c, t, g, unknown or other
  modified_base (292)..(292): a, c, t, g, unknown or other
  modified_base (308)..(308): a, c, t, g, unknown or other
  modified_base (395)..(395): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggtttttcctcgttgcttcttttaagaggtgtccagtgtcaggcgcatcgtgggtggagtcggtggggggagcgtggtccaggccgtgggaactccctgacgtacctctccgtgtgtggcgcctagctcacttnagtagtnggcttcgctgggtccncagtgccgagggcgaagggggctgggagtggcgtggggtatttcgtggtctagaacagaaaccaaatgaactatacgtacgacgggnggacgtccggagggacggggcctattaccacctactcctaccggaagggaactaaacgttaccgaaaacgtaccgtaaccccttactacttaccgtagaactaaaacgttacggaaacgtaacgttaggaacggtagttacggaaacggttaacgttaccggttacgttttaacttaccgtaggttccgaaccggtaaccgttacggaaaggggttggtacggtacggttaaaagggttaaaacgttcgtaacgttcgtaaccgttacgttcccggttacgtaacccggttcgggtaacccgggg

SEQ ID NO: 413623 - DNA, 612 bp, Homo sapiens
  misc_feature: GZ8MTXP01A0QWB.25.28.C06.1.454.CMB.2.raw
  modified_base (261)..(261): a, c, t, g, unknown or other
  modified_base (275)..(275): a, c, t, g, unknown or other
  modified_base (282)..(282): a, c, t, g, unknown or other
  modified_base (299)..(299): a, c, t, g, unknown or other
  modified_base (301)..(301): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaactccctgacgactctctgtgtggcncctagctcaccttnagtagtnggcttcgcgtgggtccncngtcgccaggcgaggggctgggagtgggcgtggggtatttacgtggtctgacagaaccaatgacatctcgacgcggagtccgtaggacggggctatcacatctcgaggacatacgaagacgtacctctatctagacaaatggaaactaagttacgaaggtagtacggaaggtacgtaccggtacctttagtacgtggtcgccgtaccgttcggagggttaggtacggacgttaaagggttaaaacggttcgttaacgtaccgttaaccgttaccggttccccggttaccgtaacccgttccggtcccggggg

SEQ ID NO: 413624 - DNA, 608 bp, Homo sapiens
  misc_feature: GZ8MTXP01A4KOT.25.28.C06.1.454.CMB.2.raw
  modified_base (261)..(261): a, c, t, g, unknown or other
  modified_base (303)..(303): a, c, t, g, unknown or other
  modified_base (369)..(369): a, c, t, g, unknown or other
  modified_base (409)..(409): a, c, t, g, unknown or other
  modified_base (529)..(529): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctgggtggagtcgtgggggagcgtggtccagcctgggaatccctgagacttctcctgtgtggcncctagactcaccttcagtagtatggctttcgtctgggtcccncctaggtgtcccaggggtcaaaggggggtctagggggagttcgggctggggtagtttactgggtcngacagaaccaaatgaactagtatcacggtggattcccggngacggggcccagttccaccatctcagggacaagttccaaagacgtaaccctctatcctagactaaataggaaactaattgacgagtcgaagtacgtaacggtccgttaattacctgttcncggacccttggaggagtgggacttaaggttaaaagttcgtaagtctcacgttcccgttacggtaaccttcggtccgggg

SEQ ID NO: 413625 - DNA, 560 bp, Homo sapiens
  misc_feature: GZ8MTXP01BC2Z1.25.28.C06.1.454.CMB.2.raw
  modified_base (256)..(256): a, c, t, g, unknown or other
  modified_base (296)..(296): a, c, t, g, unknown or other
  modified_base (359)..(359): a, c, t, g, unknown or other
  modified_base (499)..(499): a, c, t, g, unknown or other
tcagactgtacagtcacgaccggtgctcgatttagagctcacgtattggggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagctctctgtgtggcncctagactcaccttcagtagtatggcttcgtctgggtccncagtgccaggcaagggggctggagtggctgggatttactggctgacagaccaaatgacatacncgacgcggagtcccgtggacggggccattcaccatctaccgagggacaacttaccaagacgtaaccctctactctacgacaaataggaaacacgttagagagtcgaggactacggtcgttatacgtgtgcgcttcgaggngtcggtacgttaggaaaacgttcgtaagtctcacgttcccgttcgtaaccgttcgtcgggg

SEQ ID NO: 413626 - DNA, 543 bp, Homo sapiens
  misc_feature: GZ8MTXP01AKS68.25.28.C06.1.454.CMB.2.raw
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtctgggggagcgtggtccagcctgggaagtccctgagactctcctgtgtggcgcctagactcaccttcagtagtatggcttcgtctgggtccgccagtgtccaggcaagggggctggagtggctggggattactggtctgacagaccaaatgacatatcacgcggagtccgtgagggggccattcaccatctcagggacaattccaagagaaccctctatctgcaaatcggaacaacttgagagtcgaggatacggtccgttatactgtgcgccttcgaggagtggcttaggaaaaagttcgtaagtctcattcccgttcgtaaccgttcgtcggggg

SEQ ID NO: 413627 - DNA, 566 bp, Homo sapiens
  misc_feature: GZ8MTXP01AVIVL.25.28.C06.1.454.CMB.2.raw
  modified_base (216)..(216): a, c, t, g, unknown or other
  modified_base (284)..(284): a, c, t, g, unknown or other
  modified_base (311)..(311): a, c, t, g, unknown or other
  modified_base (316)..(316): a, c, t, g, unknown or other
  modified_base (334)..(334): a, c, t, g, unknown or other
  modified_base (478)..(478): a, c, t, g, unknown or other
  modified_base (509)..(509): a, c, t, g, unknown or other
  modified_base (558)..(558): a, c, t, g, unknown or other
tcagactgtacagtcacgaccggtgctcgatttagagctcacgtattgggtttgggctgagctgggttttcctcgttgctcttttaagaggtgtccagtgtcaggtgcagctggtgcagtcgtgggggaggcgtggtccaccctgggaggtccctgagactctcctgtgcagcctctggattcatcttcaacacctatgcaatgcacgtgggtccnccaggctccgaggcgaaggggctggagtgggtgctagttattcatatgatggaaactaaataaaagtntgtgactcggtggcggcatcaccgtcncaganacagatacaagagacgtntactcctacaaatcaacaacctgacgaatccgaagacacggctagtagttatactgcgacgagacgacgtcggggcgcgacgggtcccgaccccgaagggtacgtaccggacttactacgttccggactagtcggacagtcggngggggacaacgggccaggtcacgttccgtcnccgtctcgacccttcgaccgaacggccctaagtcccggtccttccccgngcccgtcc

SEQ ID NO: 413628 - DNA, 523 bp, Homo sapiens
  misc_feature: GZ8MTXP01A6IHT.25.28.C06.1.454.CMB.2.raw
  modified_base (227)..(227): a, c, t, g, unknown or other
  modified_base (247)..(247): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgaccaagtctccatcctccctgtctgcatctgttggagacagagtcaccatcacttggccgggnagtcagggcattggaaattnttggcctggtatcagcaagaaaccagggaaacttcctaacctcctacatctatgctgcatccactttcgctaagtttcggggtccctctcgtattcgaggtcggcgtaggtggggtctaggggacagtaacttcaactctacactatcagcagcctgcacgccgtagagtatggtacactaacttatactgtaactaaaatttgactaagtcgaccgtgcgtggtcgacccgttgggacctaagggtgaactataccgaaagtaacgttggtaacg

SEQ ID NO: 413629 - DNA, 715 bp, Homo sapiens
  misc_feature: GZ8MTXP01DI096.25.28.C06.1.454.CMB.2.raw
  modified_base (177)..(177): a, c, t, g, unknown or other
  modified_base (259)..(259): a, c, t, g, unknown or other
  modified_base (273)..(273): a, c, t, g, unknown or other
  modified_base (280)..(280): a, c, t, g, unknown or other
  modified_base (300)..(300): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaactgggttttcctcgttgcttcttttaagnggtgtccagtgtcaggcgcatcgtggtggagtcgtgggggagcgtggtccagccgtgggactcctgagctctcctgtgtgcncctagctcaccttnagtagtntggcttcgtcgtgggtcccncagtgtccgagggcgaagggggctggaggtgggctggggtatttacgttggtctggacagaaccaaatgactatactacgacggcgggtagtcccgggtagggacgggggtccctaacgttcgaaccctattccgtacccggaagggaacctaaacgttacccgaaaggtaaccgtaaccccttactaacttactacggaactaaacgtacgggtaaaacctaaacgttaggaacgggtaacggtacggtacgggtacgttaaccgggttaccgttttacgttacgtcggttacggtccggtaacgttcgggtaggttacggtacgggtacggttaaagggttaaaacggttcgttaacggtccttaaccgttaccgttccccggttaccgtaacccgttcgggtaacccggggg

SEQ ID NO: 413630 - DNA, 643 bp, Homo sapiens
  misc_feature: GZ8MTXP01CYXA4.25.28.C06.1.454.CMB.2.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtcctccactcctccctgtctgcatcgtgtggagacagatcaccatcacgttggccgggcgagtcgagggctagttggaaattgttggcctggtatcagacaagaaaccgagggtaaacttccaaacctctacatctatgactgactactcctactttcgactaagttttcggggtaccctcgtacgtattcgacggtcggtacgtagggtggggtctacggggactagtacttacactctaccaccatccaagccacggtcctacgacgacgtaccggtacgtaagtagttacgttacgtaaccgttaaaccgtttaatttaaccttaagttaaacttaaaacgtttaacgtaacgtaacgtacggttaccggttacggttacgttacggttacccggacccgggttaaccgggttacggtaacggttacggaacgtaacgttaacgaaaccgtaaccgttaaggttccggg

SEQ ID NO: 413631 - DNA, 635 bp, Homo sapiens
  misc_feature: GZ8MTXP01ER0TX.25.28.C06.1.454.CMB.2.raw
  modified_base (192)..(192): a, c, t, g, unknown or other
  modified_base (208)..(208): a, c, t, g, unknown or other
  modified_base (237)..(237): a, c, t, g, unknown or other
  modified_base (394)..(394): a, c, t, g, unknown or other
  modified_base (441)..(441): a, c, t, g, unknown or other
tcagactgtacagtcacgaccggtgctcgatttagagctcacgtattggggtttgggggcagaagtctctctcagtcaggacacagcatggacatggagggtccctgctcagctcctgggactcctgctgctctggctccagctatcagatgtggcatccagatcgacccagtcctccatccctccctgtcngctatctggttagganacagagtcacctatcacgttcggccgggngagtcgagggtactagttaggaaatttagttcggtccgtaggtatacaagacgaaaggaaaacccgtaggggtaaacctttccctaacctctactactctatcgctgctactcctacttcgacttagttcggggtccctcgtacgacttcgagcggngtacggtgggtcgagggactataactcactcacacatcagcatccgngacgtacgccgtaagtagtgttacgtactaacctaaactttagttaccgtagttaaactaaaagttcgaacgaagttcggttacccggtggttacgtcccggggtacccggttaaccgggttacggggttaacccggtaaggggttcaaaccgttaaacggtaacccgttaaaggtaaccggtttgggtcccgg

SEQ ID NO: 413632 - DNA, 642 bp, Homo sapiens
  misc_feature: GZ8MTXP01BHVHJ.25.28.C06.1.454.CMB.2.raw
  modified_base (258)..(258): a, c, t, g, unknown or other
  modified_base (272)..(272): a, c, t, g, unknown or other
  modified_base (280)..(280): a, c, t, g, unknown or other
  modified_base (297)..(297): a, c, t, g, unknown or other
  modified_base (372)..(372): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggatcctgagctctcctgtgtggcncctagctcaccttnagtagtanggcttcgtctgggtccnccagtcgccgagggcaagggggctgggagtgggctgggggtatttacgtggtctgacagaaccaaatgaacatanccgacgcggagtcccggtggacgggggccctattccaaccgtactctaccgaagggaactaacttaccgaaacgacgtaaccctctactctagacaaatacggaaactaacgttagaagtaacgtacggaaggtaacgttaccggtaccgttttagttaaccgttgtcgtcgtaacccttcggaacgggttaggtaggtacgttaagggttaaaacgttcgtaacgttcctaacgtacgttcccggttcgtaacccgttcggtaacgggg

SEQ ID NO: 413633 - DNA, 743 bp, Homo sapiens
  misc_feature: GZ8MTXP01ARY1Z.25.28.C06.1.454.CMB.2.raw
  modified_base (261)..(261): a, c, t, g, unknown or other
  modified_base (275)..(275): a, c, t, g, unknown or other
  modified_base (301)..(301): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcgtgggggagcgtggtccagcctagggaactccctgagactctctgtgtgcncctagctcaccttnagtagtatggtcttcgcgtgggtccnccaggtcgtccagggcaagggggctggagtggctggggatttacgtggctagacagaaccaaagtgactatactcgacggcggtagtccgggtagggacggggtcctaattccaaacctacgtacctaccggaacgggaacctaaacgttaaccgaaacggaaccgtaaaccccttactaacttaccgttaacgtaaacgtaaaacgtaacgggtaaaacttaaacgttaaggtaaacggtaacggtaacgggaacggtaaaccggttaaccgggtttaccgttttaaacgtttaaccggttacggtacggtaaccgtaccggttacggtaaacgggttacggtacgggtaaacggttaaagggttaaaacggttcggtaacgttaccgttaaccgttacccgttaccccggttacccgtaacccgttccgggtaaccgggg

SEQ ID NO: 413634 - DNA, 698 bp, Homo sapiens
  misc_feature: GZ8MTXP01C8GYL.25.28.C06.1.454.CMB.2.raw
  modified_base (302)..(302): a, c, t, g, unknown or other
tcagactgtacagtcacgaccggtgctcgatttagagctcacgtattgggtttgggggggagaggagcccagcactagaagtcggcggtgtttccactaggtgatcagcactgaacgcagcggactcaccatggagtttggctgaacttgggttttcctcgttgcttcttttaagaggtgtccagtgtcaggcgcatcgtggtggagtcgtgggggagcgtgtccagccgtgggaactcctgagactctccgtgtgtggcgcctagactcacttcagttatatggtcttcgtctgggtcccncagtgtccaggcaagggggctggagtgggctggggtacttacgttggtctagaacaaggaacctaaaatgaacaattacgtaccgaacggcgggtaacgtcccgggtaggaaccgggggccctaattcccgaacctactccgtaccggaagggaacctaaacgttacccgaaaacgtaaccgtaaaccccttacttaacgttactacaactaaaactacggggaaactaaacgttagaaggacgtacgaacggtacgttaaccggtaccgtttaagttaccgtggtcgtaaccgtaccgttacgtacgggaggtacggtacgttaaaggttaaaacgttccggtaagtacctaaccgtacgtttccccggaccgtaacccgttcgggtcccggggg

SEQ ID NO: 413635 - DNA, 603 bp, Homo sapiens
  misc_feature: GZ8MTXP01BP8RP.25.28.C06.1.454.CMB.2.raw
  modified_base (205)..(205): a, c, t, g, unknown or other
  modified_base (233)..(233): a, c, t, g, unknown or other
  modified_base (312)..(312): a, c, t, g, unknown or other
  modified_base (393)..(393): a, c, t, g, unknown or other
  modified_base (396)..(396): a, c, t, g, unknown or other
  modified_base (403)..(403): a, c, t, g, unknown or other
  modified_base (420)..(420): a, c, t, g, unknown or other
tcagactgtacagtcacgaccggtgctcgatttagagctcacgtattgggtttgggggcagaagtctctctcagtcaggacacagcatggacatgagggtccctgctcagctcctgggacctcctgctgctctggctcccagctatcagatgtggcatccagatgaccaagtcctccatccctccctgtctgctatctgttgganacagagtcaccatcacgttggcccgggnagtcgagggtctaagttaggaaatttgttcggcttggtatcagacaacgaaaccgagggtaaacttccctaacctcctnattctatgactgactactcctacgtttcgacgttaggtttccgggtccctactcgtattcgagtcggctaggtgggtacgnganatactcnctcacactatcgctacncgcgtcgacgacgtacggtagtagtagttagttactacttaacttaactttaacttaagttaaacgttaaacgttacgtaacgtaacgttacgttaccggtacggttacgtacggtaccggttaccggttacggttacggtaacggtacgtaacgtaacgtaacgttaacgtaacgttcgtcg

SEQ ID NO: 413636 - DNA, 699 bp, Homo sapiens
  misc_feature: GZ8MTXP01AFIGI.25.28.C06.1.454.CMB.2.raw
  modified_base (257)..(257): a, c, t, g, unknown or other
  modified_base (295)..(295): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaactcctgagactctctgtgtgcnctagactcacttcagtagtatggcttcgtctgggtccnccagtcgtccagggcgaagggggctgggagtggcgtgggtagtttacgtggtctgacagaaccaaatgacatacgtaccgacgcgggtacgtcccggtgggacgggggtcctattaccaacctacgtacctaccggaacggggtaactaaacgttacccgaaaacgtaaccgtaaaccccttactaacttaccgttaacggaacctaaaactaacggggtaaaactaaaccgtttaggaaacggtaaggtaccgggtaaacggtaacggttaaccgggttaccgttttaacgttaccgttaggtcggaaccgtaccgttacggacggttaggtcgggtacgttaaggttaaaacgttcgtaagtctcgttacgttcccgttacgtaaccgttcggtaaccgggg

SEQ ID NO: 413637 - DNA, 697 bp, Homo sapiens
  misc_feature: GZ8MTXP01CGG11.25.28.C06.1.454.CMB.2.raw
  modified_base (270)..(270): a, c, t, g, unknown or other
  modified_base (284)..(284): a, c, t, g, unknown or other
  modified_base (307)..(307): a, c, t, g, unknown or other
  modified_base (392)..(392): a, c, t, g, unknown or other
tcagactgtacagtcacgaccggtgctcgatttagagctcacgtattggggtttggggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtgggtggagtcgtgggggagcgtggtccaggccgtgggaacgtccctgacgtactctcctgtgtggcncctagactcacttnagtgtatgcttcgtctgggtccnccaggtcgtccagggcgaagggggctgggagtgggctgggggtattacgttggtctagacagaaccaaatgacatatcgaacggnggagtccggtggacgggggcctattcaccactcgtccgaagggacaacttaccaaagtaaccgtaacccttctactactacgactaaaagtacggaaactaacgttagaacggtacgtacggaaggtaacgttaccgggtacgttttaacgtaacgttcggttacgaacccggtaaccgttcggaagggttaaccgggttagggtaacggttaaaaggggttaaaaacggttccggttaacgttacccgttccgtaacccgtttccccgggttacccgtaacccggttccgggtaacccgggggg

SEQ ID NO: 413638 - DNA, 741 bp, Homo sapiens
  misc_feature: GZ8MTXP01CGYYT.25.28.C06.1.454.CMB.2.raw
  modified_base (206)..(206): a, c, t, g, unknown or other
  modified_base (235)..(235): a, c, t, g, unknown or other
  modified_base (315)..(315): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggcctcccagctatcagatgtggcatccagatcgacccagtcctccatccctccctgtctgctatctgttgganacagactcacctatcacgttcggccgggnaggtccgagggctagttaggaaatttgttcggccttaggtatcagacaagaaaaccgagggtaaacttcccaacctctanatctatcgctgactactcctacttttacgaccgttaaggttttccgggggtccccttagtaccgtaactttcggaacgggtccgggtacgtaggggttcggggtaccgttaggggaaaccctaaggttaaacttccaccttctaccctaaaccagttaccgaacggccaacggcccgttacgacgtaaccggtacccggttaggaaaacgtttgttacgggtttataacccgttaaaccgttttaatttaaacccggttagttaaaaacctttaaaaagtttcggaaacggttaaaccggttccgggttaaaccccgggttgggttacgttaacccgggttcccgggaaacccggttaacgggttacccgaaaggggttaacgaacgtaaacgtaaaccgaaaacgtaaccggttggttaaccggg

SEQ ID NO: 413639 - DNA, 597 bp, Homo sapiens
  misc_feature: GZ8MTXP01CNXEE.25.28.C06.1.454.CMB.2.raw
  modified_base (330)..(330): a, c, t, g, unknown or other
tcagactgtacagtcacgaccggtgctcgatttagagctcacgtattgggtttttggggggaagaggaagactgacggtcctcccaggagttcaggtgctgggcaccttgggcacgggggaggcgtggtccagcctgggaagtccctgagactctcctgtgtggcgcctagactcaccttcagtagttatggcttcgtctgggtccgccagtgtccaggcaaggggctgggagtggctgggattacttggtctgacagacaaatgacatatcacgcggagtccgtgaggggcgattcacatctccagggacaattccaagagaacccctntatctgacaaatgaacaacttgagagtaccgaggatacggtctttattaactgtgcactcaggagtgggactaggaaaagtcgtaagtctcacttcccgtcgtacctcgtcggggccagggccaccgtcggcgtaccgtcgtcctcacgtcctaccgaccgaacgggcccacgtccggtccttcccccgtcgggtcccgccccgttcgccgtcccgacggacgccgacccgtcgtcgggggccacgcggccggtcccgttgggcccg

SEQ ID NO: 413640 - DNA, 663 bp, Homo sapiens
  misc_feature: GZ8MTXP01DG5VT.25.28.C06.1.454.CMB.2.raw
  modified_base (273)..(273): a, c, t, g, unknown or other
  modified_base (277)..(277): a, c, t, g, unknown or other
  modified_base (298)..(298): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcgtgggggaggcgtggtccagcctgggaactccctgagctctctgtgtgcgcctagctcacttnagtntatggtcttcgtctgggtccnccaggtgtcccgagggcaagggggctgggaggtggcgttggggtattacgttggtactggacagaaccaaatgaactatagtccaacggcgggaagtcccggtgggaacggggcctagtcaccatcctacgagggacaacttaccaaagacgtaacctactactctagactaaagtaggaacctaagttagaagtaggtaccggaaggtacgtacggttacccgtttaagttaccgtggtcggaacgtaccgttacggagggttacgtaggggtaacgttaaaggggttaaaagttcggttaacggttaccttccgttaacccgtttccccggttaccgtaaccccgttccgggtaacccggggg

SEQ ID NO: 413641 - DNA, 688 bp, Homo sapiens
  misc_feature: GZ8MTXP01BGUP8.25.28.C06.1.454.CMB.2.raw
  modified_base (303)..(303): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcgtgggggagcgtggtccagccgtgggaactccctgagctctctgtgtggcgcctagctcacttcagtagtatggtcttcgtctcggggtccncctaggtcgtccgagggcgaagggggctgggagtggcgtggggtagtttacgttggtctgacagaaccaaatgacatactcgaacggcggacgtcccgggtgggacgggggcctacttcaacctatccgtaccgaaggggaacctaaacgttacccgaaaggaaccgtaaccccttactaactcctagaactaaaacttacggggaaaccttaaacgttagaaaggtacggtacgggaacggtaacgttaaccgggttacccgttttaagttaaccgtggttcgaaccgtaaccgttcggaagggttagtacgggtacgttaaagggttaaaacgttcgtaacgtctccgtacgttccccgcgtaacccgttcgggtaaccgggg

SEQ ID NO: 413642 - DNA, 588 bp, Homo sapiens
  misc_feature: GZ8MTXP01D2YF9.25.28.C06.1.454.CMB.2.raw
  modified_base (301)..(301): a, c, t, g, unknown or other
  modified_base (369)..(369): a, c, t, g, unknown or other
  modified_base (396)..(396): a, c, t, g, unknown or other
  modified_base (424)..(424): a, c, t, g, unknown or other
  modified_base (460)..(460): a, c, t, g, unknown or other
  modified_base (464)..(464): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcagatgcaacgtggcggagtcggggggagcgtggtccaggccgggaatccctgagactctcctgtgcagtcgtccgccgtccaccttccgtcgttttggctatcacgtggtccncaggctccgaggcaaagggctggagtggggtgcggtcagtagtggtgggatggaagtatgctatttangcagaactcgtgaggccactcacatcnccagcgcagctacaagtaactcctttancagactaatacgaaacgtgaacgtcgtacgacgacncgtnttgtactagtcgtggccggtcgggtaactaggaacggtacggttcggggtaccgggtccgttacggttacggacgtaacggtcgggaaccggtccgggtacggggaccgtaacgggccgtaacg

SEQ ID NO: 413643 - DNA, 659 bp, Homo sapiens
  misc_feature: GZ8MTXP01D3COM.25.28.C06.1.454.CMB.2.raw
  modified_base (220)..(220): a, c, t, g, unknown or other
  modified_base (295)..(295): a, c, t, g, unknown or other
  modified_base (366)..(366): a, c, t, g, unknown or other
  modified_base (544)..(544): a, c, t, g, unknown or other
tcagactgtacagtcacgaccggtgctcgatttagagctcacgtattgggtttgggctgagctgggttttcctcgttgctcttttaagaggtgtccagtgtcaggtgcagctggtgcagtcgtgggggaggcgtggtccacccgtgggaggtccctgagactctcctgtgcagcctctggattcattcttacaacacctatgcaatgcacgtcgggtccnccaggcctcgaggcgaaggggctgggagtgggtgctagtttattcgatagtgaataggaaactaaataaaagttntgttagacgtccggtggcggccgattccaccgttcaccagacaacgagaactaccgaaagaacgtacggtntactacctaaccaaaatccaaaccaaccgtaagaacgaacgtaccgaagaccacggtctaggtagttatacgtgtgacgtaggacgacgtcggggcgacgtaccgggtcccgaccccgaaggtaaccgtccggtactaacgttacgttaccgaaccagtcggggactaggttaccggngggtaaccggaacgggaccctcgggtaacacgttccgtccttccgtaccgtcgaccccttcgaacccggtaaccgaccctcgtcccggtcccttcccccgtggaaccccgtcccg

SEQ ID NO: 413644 - DNA, 620 bp, Homo sapiens
  misc_feature: GZ8MTXP01B32TS.25.28.C06.1.454.CMB.2.raw
  modified_base (274)..(274): a, c, t, g, unknown or other
  modified_base (282)..(282): a, c, t, g, unknown or other
  modified_base (300)..(300): a, c, t, g, unknown or other
tcagactgtacagtcacgaccggtgctcgatttagagctcacgtattgggtttggggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtctggggggagcgtggtccagcctgggaatccctgagactctcctgtgtggcgcctagactcaccttnagtagtanggtcttcgtcgtgggccncagtgtccgaggcgaagggggctgggagtggcgtggggtagtttacgttggtctagaacagaaacaaatgaacatacgtacgaacggcgggtagtccgggtagggacgggggccctattaccaaacctactcctaccgaagggaactaaacttaccgaaagaacgtaaccctctactcgtagaactaaataacgaaactaaacgtagagagtacgaggacgtacggtacgttattactcgtgcgacgttacgtaggaggtaggtagttaaggaaaagttaacgtaagttactctacttccgttaccgtccgttcgtcggg

SEQ ID NO: 413645 - DNA, 697 bp, Homo sapiens
  misc_feature: GZ8MTXP01C5IDY.25.28.C06.1.454.CMB.2.raw
  modified_base (260)..(260): a, c, t, g, unknown or other
  modified_base (274)..(274): a, c, t, g, unknown or other
  modified_base (280)..(280): a, c, t, g, unknown or other
  modified_base (299)..(299): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcgtgggggagcgtggtccagccgtgggaactcctgagctctctgtgtgcncctagactcacttnagtatntggcttcgtcgtgggtccncagtcgccgagggcgaagggggctggagtggcgttgggtattacgttggtctagacaagaaacctaaagtgaactatactaccgaacggcgggtacgtcccgggtagggacgggggtcccatttcccgaaccctactaccgtaccggaagggtaacctaaacgttaacccgaaagtaccgtaacccctctaactcctagaaacctaaatacgggaaaactaacgttaggaacgtacggtacggaaggtaacgttaccgggttaccgttttaagttacgtcgtacggtaaccgtacccgttaggagggttagtacgggtacgttaaaagggttaaaacgttcggttaacgttaccgtcgtaccgttccccggttacgtaacccgttcgggtaaccgggg

SEQ ID NO: 413646 - DNA, 768 bp, Homo sapiens
  misc_feature: GZ8MTXP01DNV7X.25.28.C06.1.454.CMB.2.raw
  modified_base (264)..(264): a, c, t, g, unknown or other
  modified_base (277)..(277): a, c, t, g, unknown or other
  modified_base (302)..(302): a, c, t, g, unknown or other
tcagactgtacagtcacgaccggtgctcgatttagagctcacgtattggggtttggggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcggtgggggagcgtggtccagccgtgggaactcctgagtactctctgtgtgcncctagctcacttnagtagtatgcttcgtctcgggtccncagtcgtccgagggcgaagggggctggagtggcgttgggtagtttacgttggtctggaacaagaaccaaagtgaactaattactccgaacggcgggtacggttcccgggtaggggacgggggccctaatttccccgaaaccctacttacccgtaacccggaaacggggtaaacctaaaacgtttaaccccgaaaacggtaacccgtaaacccccttacttaactaccgttaacggaaacctaaaacgttaacggggtaaaaccttaaaaccggtttaggaaacgggtaacggtaaccggggtaacggttaaacgttaaccggggtttacccgttttaagttaaccgttcggtacggaaccgtaaccgttacggagggttaggtacgggtaacgttaaaggttaaaacgttcgttaacgtcttaaccgtacgttccccggttacgtaacccgttcgggtaaccgggg

SEQ ID NO: 413647 - DNA, 651 bp, Homo sapiens
  misc_feature: GZ8MTXP01A8HG0.25.28.C06.1.454.CMB.2.raw
  modified_base (259)..(259): a, c, t, g, unknown or other
  modified_base (274)..(274): a, c, t, g, unknown or other
  modified_base (302)..(302): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaatccctgagactctctgtgtggcncctagactcaccttnagtagtatggtcttcgtcgtcgggtccnccgtagtcgtccgagggcgaagggggctgggagtggcgtggggtagtttacgtggtctgacagaaccaaatgaactatactcgacggcggacgtcccggtagggacggggcctattccacactcgtaccgagggacaattaccgaaacgacgtaaccctctactctagaactaaatacggaaactaacgttagaagacggtacggaaggtacgtaaccggtaccgtttaagttaccgttggtcgaaccgtaccgttcgagggttaggtagggtacgttaaagggttaaaacgttcggtaacgtcgtaacgtaccgttcccggttaccgtaacccgttcggtaaccgggg

SEQ ID NO: 413648 - DNA, 625 bp, Homo sapiens
  misc_feature: GZ8MTXP01DNQR1.25.28.C06.1.454.CMB.2.raw
  modified_base (200)..(200): a, c, t, g, unknown or other
  modified_base (225)..(225): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgtgganacagagtcacatcacttggccgggnagtcgagggctaagttaggaaatttagttggcctaggtatcagtacaaggaaaccgagggtaaacttcctaacctcctacatctatgctgctactcctactttcgacgtacggtttcggggtaccctcgtacgtattcgacgtccgggtacgtaggtcggggtacgtaggggaacctaagtaacttaccaaccttcctaccaaccctataccagaccgacgtccctgaccgtacgtaccgtaggtaaaggtacttaggttactaacttaaacgtttacttaacgtacgttaaataaaagtttcgaacgtaacgtcggttaccggtggttaacgtcggttccggaccgacgggttaacgtaaggtacggaactaacgtacgaaacgtaacgttcgtaacgg

SEQ ID NO: 413649 - DNA, 750 bp, Homo sapiens
  misc_feature: GZ8MTXP01AOK6Q.25.28.C06.1.454.CMB.2.raw
  modified_base (264)..(264): a, c, t, g, unknown or other
  modified_base (306)..(306): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggtttttcctcgttgcttcttttaagaggtgtccagtgtcaggcgcatctggtggagtcgtgggggagcgtggtccagccgtgggaactccctgagactctcctgtgtcggcncctagactcaccttcagtagtatggtcttcgtcgtgggtccnccagtgtccgagggcgaagggggctgggaggtgggcgtggggtagtttacgttggtctagacaggaacccaaatgaactatataccgacggcgggtacgtcccgggtagggacgggggtccgtattccaccctacgtccctaccgaaggggtaactaaacgttacccgaaagaccgaaaccccttctaacttcctaggaacctaaaagtacggggtaaactaaacgtttaggaacggtaacggttaccggaaggggtaacgttaaacccgggggttacccttttaaagttaaccgttcggttaccggaaccggtaacccgttacgggaacggggttagggttacgggtaacggttaaaggggaaaaacggtttccggttaacggttccttccgttaaccgtttcccccggttaccgtaacccgttcccgggttaacccgggggg

SEQ ID NO: 413650 - DNA, 583 bp, Homo sapiens
  misc_feature: GZ8MTXP01EGJXL.25.28.C06.1.454.CMB.2.raw
  modified_base (332)..(332): a, c, t, g, unknown or other
tcagactgtacagtcacgaccggtgctcgatttagagctcacgtattgggtttttggggggaagaggaagactgacggtcctcccaggagttcaggtgctgggcaccttgggcacgggggaggcgtggtccagcctgggaagtccctgagactctcctgtgtggcgcctagactcaccttcagtagttatggcttcgtctgggtccgccagtgtccaggcaaggggctgggagtggctggggagttacttggtctgacagacaaatgacatatcacgcggagtccgtgaggggccgattcacatctccagggacaattccaagagaaccctntatctgcaaatgaacaacttgagagtccgaggatacggccgtttataactgtgcgacctcgaggagtggctaggaaaagtcgtagtctcattcccgtcgacctcgtcggggccacgggcacccgtggtccaccgtctcctcacgtcttccaccgaacgggccctacgtccggtcccttcccccgtggcccgcccgtcgccgtccgacggacgccaccgtcgtcgggggccacgcgccggcccgttgggccg

SEQ ID NO: 413651 - DNA, 608 bp, Homo sapiens
  misc_feature: GZ8MTXP01EFOKC.25.28.C06.1.454.CMB.2.raw
  modified_base (262)..(262): a, c, t, g, unknown or other
  modified_base (300)..(300): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagttgtcaggcgcatcgtgggtggagtcgtgggggagcgtggtccagcctgggaatccctgagactctcctgtgtgcnctagctcacttcagtagtatggcttcgtcgtgggtccnccagtgtccagggcaagggggtctgggagtggcgtgggtagttacgttggtctgacagtaaccaaatgactatactacacggcggagtccggtaggacggggccattcacactcacgagggactaactaccaaagacaacctctactcagaactaaataggaaactaacttggaacgtagtacgaggtacttacggttcctttaagttacgtcgtgaaccgtaccttaggacgggttagtagggtaacgttaaggaaaagttcgtaacgtctctacgttcccggttaccgtaaccgttcggtcggggg

SEQ ID NO: 413652 - DNA, 648 bp, Homo sapiens
  misc_feature: GZ8MTXP01AT5N7.25.28.C06.1.454.CMB.2.raw
  modified_base (177)..(177): a, c, t, g, unknown or other
  modified_base (266)..(266): a, c, t, g, unknown or other
  modified_base (281)..(281): a, c, t, g, unknown or other
  modified_base (287)..(287): a, c, t, g, unknown or other
  modified_base (305)..(305): a, c, t, g, unknown or other
  modified_base (466)..(466): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagnggtgtccagtgtcaggcgcatctggtggagtcggtgggggaggcgtggtccagccgtgggaacgtccctgacgctctcctgtgtcggcncctagactcaccttnagtatntggcttcgcgtggtcccncagtcgtccagggcgaagggggctgggagtgggctgggggtatttacgttggtctgacaggaacctaaatgactatactacgacggcggtagtcccgtagggacggggtccattccaacctctcgccgaagggactaaacgttccaaagtcgaaccccttntaactcctagaactaaagtacggtaaactaacgtttgaacgttaggaccggtaggtacgttacgggtcctttagtaccgtagtcgaacgtaccgttggaaggttgtaggtacgttaacgggttaaaagttcgggtaatctaacgttaccgttccccggacgtcccgttcggtaacccggggg

SEQ ID NO: 413653 - DNA, 559 bp, Homo sapiens
  misc_feature: GZ8MTXP01BMAJ1.25.28.C06.1.454.CMB.2.raw
  modified_base (256)..(256): a, c, t, g, unknown or other
  modified_base (295)..(295): a, c, t, g, unknown or other
  modified_base (365)..(365): a, c, t, g, unknown or other
  modified_base (502)..(502): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggatccctgagctctcctgtgtggcncctagactcaccttcagtgtatggcttcgtctgggtccnccagtgtccaggcaagggggctgggagtgggctagggagtttacttggtctgacagaccaaatgacatancacgcggagtccggtggacggggccattccaccatctacgagggacaacttcaacgacgaaccctctactctgacaaataggaaactaacttgagagtacgagatacggtcgtttattactgtgcgtacttcgaggngtaggcgttaggaaagttcgtaagtctctacgttccgttcgtaaccgttcgtcgggg

SEQ ID NO: 413654 - DNA, 679 bp, Homo sapiens
  misc_feature: GZ8MTXP01AQ828.25.28.C06.1.454.CMB.2.raw
  modified_base (178)..(178): a, c, t, g, unknown or other
  modified_base (244)..(244): a, c, t, g, unknown or other
  modified_base (262)..(262): a, c, t, g, unknown or other
  modified_base (275)..(275): a, c, t, g, unknown or other
  modified_base (281)..(281): a, c, t, g, unknown or other
  modified_base (298)..(298): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagnggtgtccagtgtcaggcgcatcgtggtggagtcgtgggggagcgtggtccagccgtgggaactccngacgactctctgtgtgcncctagctcacttnagtatngcttcgcgtcgggtccnctagtcgaccgaggcgaagggggctgggagtgggcgtgggtaactttcgtggtctagaacagtaacctaaatcgaactatacgtaccggaacggtcgggtaacgtcccgggtaggggaccggggtccctaactttacccgaaccctacgttacccgtaaccggaacgggtaacctaaacgttacccgaaacgtaccgtaaccctacgtaactctagaaactaaacgtacggaaacgttaacgttagaacggtaacgttacgacggttaacgttaccggttacgtttaacgtacgtcggtacgcgtaccgttggacgttcggtagtacgttaaggttaaacgttcgtaactcgtctaccgttccgcgtccgttcggtccggg

SEQ ID NO: 413655 - DNA, 590 bp, Homo sapiens
  misc_feature: GZ8MTXP01AH1TD.25.28.C06.1.454.CMB.2.raw
  modified_base (259)..(259): a, c, t, g, unknown or other
  modified_base (303)..(303): a, c, t, g, unknown or other
  modified_base (388)..(388): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgctcttttaagaggtgtccagtgtcaggcgcatctggtggagtcgtgggggagcgtggtccagcctgggaatccctgagactctcctgtgtggcncctagactcaccttcagttagtatggcttcgtcgtcgggtcccnccagtcgtccgagggcgaagggggctgggagtggctggggattacgttggctgacagacaaatgacatatcacggcggagtccgnggacggggcctattcaccactctacgacgggacaattaccgaacgacgaaccctactactctagactaaatacggaaactaacgttagagtagtacgaggtacgtacggtacgtttagttactgtgtcgacgttcgaggaggtcggacgttaggaaacgttcgtaagtctcctacgttcccgttaccgtccgttcggtcggg

SEQ ID NO: 413656 - DNA, 622 bp, Homo sapiens
  misc_feature: GZ8MTXP01BVZLH.25.28.C06.1.454.CMB.2.raw
  modified_base (203)..(203): a, c, t, g, unknown or other
  modified_base (224)..(224): a, c, t, g, unknown or other
  modified_base (245)..(245): a, c, t, g, unknown or other
  modified_base (292)..(292): a, c, t, g, unknown or other
  modified_base (304)..(304): a, c, t, g, unknown or other
tcagactgtacagtcacgaccggtgctcgatttagagctcacgtattggggtttgggggcagaagtctctctcagtcaggacacagcatggacatgagggtccctgctcagctcctgggactcctgctgctctggctcccagctatcagatgtggcatccagatcgacccagtcctccattcctcctgtctgcatctgttganacagatcacatcatgccgggnagtcgaggctagtggaaattnttggctggtatcgagcaagaaaccaggggtaaacttccaactcctanatcgtatgctanctatcgtattcgacttaggttccggtccctgtacgtatcgaggtcgggcgtagggtcgggtacgagggaactagtactactactctacgaactacgtacgacgacgacgcgtacgacgtacgacggtaagtaacgttagttacgttactaacgttaaacttaatttaacgttaacgttaaacgttaaaacgttacgtaaacgtaacggtacggttaccggttacggttacgtaccggttacccgggaacccggaacgggttaaccggtaagggtacgtaacgtaacgtaacgttaaaccggtaacgttaacggtaacg

SEQ ID NO: 413657 - DNA, 807 bp, Homo sapiens
  misc_feature: GZ8MTXP01B096U.25.28.C06.1.454.CMB.2.raw
  modified_base (201)..(201): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgaccaagtcctccatcctccctgtctgcatctgtganacagatcacctatcacgttggcccgggagaggtccgaggggctaagttgggaaatttagtttcgggcctgggttatcgaggacaacggaaaaccgaggggtaaactttcctaaacctcctactagttcctatcgcttagactactcctacgttttaccgaccttaaacggtttttcggggggtcccccttacgtttaacccgggtaactttccgaacgggtacccgggtcccggtaagggggttcgggggttaccggtacgggggaaaccctaaaggtaacctttacctaaccgttacccttacccgaacccgtaacttaccgtaacgggtacctaacgtacccgtcgtaccgtaaccgggaccccggttaacgggtaaaacgggttaaagttttcgggggtttaacgttaaacccgttaaaacccgttttaacgttttaaacccgttaaagtttaaaccctttaaaaaaaagttttcggtaaacgttaaacgggttacggttaaccccgggttaggttaaacggttcgggttacccgggacccgttacggggaaccgtaaggggtacgaacgtaacgtacgaaaaccgtaacgttaaggttccgg

SEQ ID NO: 413658 - DNA, 642 bp, Homo sapiens
  misc_feature: GZ8MTXP01CZ5GU.25.28.C06.1.454.CMB.2.raw
  modified_base (199)..(199): a, c, t, g, unknown or other
  modified_base (218)..(218): a, c, t, g, unknown or other
  modified_base (248)..(248): a, c, t, g, unknown or other
  modified_base (257)..(257): a, c, t, g, unknown or other
  modified_base (282)..(282): a, c, t, g, unknown or other
  modified_base (340)..(340): a, c, t, g, unknown or other
  modified_base (358)..(358): a, c, t, g, unknown or other
  modified_base (412)..(412): a, c, t, g, unknown or other
tcagactgtacagtcacgaccggtgctcgatttagagctcacgtattgggtttgggctgagctgggttttcctcgttgctcttttaagaggtgtccagtgtcaggtgcagctggtgcaggtcgtgggggagcgtggtccacccgtgggaggtccctgagactctcctgtgcagcctctggattcatcttcaacacctangcaatgcacgtgggtcccncaggctccgaggcaaggggctggagtgggngcagttatnatatgatagaaactaaataaaagtntagttgactcggtgcggcattccacgtctcagagacagactacgaaagaacgcggttntatccctaaaccaaaatnaaaacccaacgtgaactcgtacccggaggaccacgggtctaggtactatactgngacgagacgtacgcggggcgacgtacggtcccgtaccccgaagggtaacgttacggcgttaaactacgttacccgaacgtagtcggaccgtaagttccggtagggggaacgaaccggggaccacgggtctaacttccggtccttcggtccgtcgacccttccgaaaccgtaaccggggtccctaacgttcccggggttccccttcccccggttaagggcccgtaaccccg

SEQ ID NO: 413659 - DNA, 644 bp, Homo sapiens
  misc_feature: GZ8MTXP01AGJ0R.25.28.C06.1.454.CMB.2.raw
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaatccctgagactctctgtgtggcgctagactcacttcagtagtatggtcttcgtcgtgggtcccgcctaggtgtcccgagggcgaagggggctgggaggtgggcgtggggagtttacgttggtctgacagaaccaaatgacatatacgacggcggagtcccgggtggacgggggcctattccaaccactctaccgagggacaacttaccaaacgacgaaccctactactctagactaaagtacggtaaactaacgttagaaggtagtacggaggtaacgttacgggtaccgtttaacgttacgttcgtcgaaccgtaccgttcgagggttaggtacggtacgttaagggttaaaacgttcggtaacgttctaacgtacgttcccgttaccgtaaccgttcggtccgggg

SEQ ID NO: 413660 - DNA, 582 bp, Homo sapiens
  misc_feature: GZ8MTXP01CO2KM.25.28.C06.1.454.CMB.2.raw
  modified_base (264)..(264): a, c, t, g, unknown or other
  modified_base (277)..(277): a, c, t, g, unknown or other
  modified_base (301)..(301): a, c, t, g, unknown or other
  modified_base (459)..(459): a, c, t, g, unknown or other
  modified_base (523)..(523): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggttgtccagtgtcaggcgcatcgtggtggagtcggtggggggagcgtggtccagccgtgggaactccctgagctctctgtgtgcncctagctcacttnagtatatgtcttcgtctgggtccncagtgtccaggcaagggggctggagtggcgtgggtattacgtggtctagacagaaccaaatgactatatcgaacgcggagtcccgggtagggacggggcccattccgactatccgtacgaacgggactaacttaccaaagtacaaccctctatactanaacaagtacgtaactaagtagagacgtcgagtacgtacgtcgttatcgtcgtcgcgtcgagagngtaggtagttaaggttaacgttcgtaagtactcgtcgtccgttacgtcgttcggtcggg

SEQ ID NO: 413661 - DNA, 664 bp, Homo sapiens
  misc_feature: GZ8MTXP01BOXN7.25.28.C06.1.454.CMB.2.raw
  modified_base (176)..(176): a, c, t, g, unknown or other
  modified_base (261)..(261): a, c, t, g, unknown or other
  modified_base (274)..(274): a, c, t, g, unknown or other
  modified_base (303)..(303): a, c, t, g, unknown or other
  modified_base (331)..(331): a, c, t, g, unknown or other
  modified_base (354)..(354): a, c, t, g, unknown or other
  modified_base (373)..(373): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgctcttttaagnggtgtccagtgtcaggcgcatctgggtggagtcgtgggggagcgtggtccagcctggggaactcctgagactctcctgtgtggcncctagctcacttnagtagtatggtcttcgtctggggtccccncgtagtcgccgaggcgaggggtctgggngtggtcgtgggtattcgtggtcngacagaacaatgacatacncgacggcggagtcgggagggacgggcctatccactactcgaccggaaggactaactacgaaacgtaccgtaaccctactactacgtacgaactaaacgtacggtaaactaacgttaggaacggtacggtacggtaaggtaacgttaccgggttaccgtttaagttacgtcggtaccggtaacgtaccgttacggtagggttacggtacgggtaacggttaaacgggttaaacgttcggtaacgttccgtaaccgttacccgttcccggttaccgtccggttcgggtcgggg

SEQ ID NO: 413662 - DNA, 634 bp, Homo sapiens
  misc_feature: GZ8MTXP01EJ4US.25.28.C06.1.454.CMB.2.raw
  modified_base (256)..(256): a, c, t, g, unknown or other
  modified_base (277)..(277): a, c, t, g, unknown or other
  modified_base (294)..(294): a, c, t, g, unknown or other
  modified_base (364)..(364): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaacttgggttttcctcgttgcttcttttaagaggtttccagtgtcaggcgcatcgtggtggagtcgtgggggagcgtggtccagcctgggactcctgagctctctgtgtgcnctagctcaccttcagtattanggcttcgtctgggtccncagtcgtccgaggcgaaggggctggagtggcgtggggtatttacgtggtctgacagaacaaatgacatanccgaaacggcgggtaacgtcccgggtagggacggggtcccgtattccgaacctatcctaccgaacgggaactaaacgttacccgaaagaaccgtaacccttctaactccgtagaactaaaatacgaaactaacgttgaacgtaggtacggaacgtacgtacggttaccgtttaattacgtgtcgcgtaactcgaggtacgttaggtacgtaaagaaacggttcgttacgtctacgtaaccttcccggtcgaccgtcggcggggtaacccg

SEQ ID NO: 413663 - DNA, 599 bp, Homo sapiens
  misc_feature: GZ8MTXP01EE2JL.25.28.C06.1.454.CMB.2.raw
  modified_base (262)..(262): a, c, t, g, unknown or other
  modified_base (276)..(276): a, c, t, g, unknown or other
  modified_base (302)..(302): a, c, t, g, unknown or other
  modified_base (376)..(376): a, c, t, g, unknown or other
  modified_base (515)..(515): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtgggtggagtcgtgggggagcgtggtccagccgtgggaactccctgagtctctctgtgtgcncctagactcacttnagtagtatggtcttcgtctgggtccncctagtcgtccgagggcaagggggctagggagtggcgtggggtagtttacgtggtctgacagaaccaaatgaanatatccgacgcgggtagtccggtggacggggcctattcaccatcctacgagggactaacttacaaacgacgtaaccctctatctagaacctaatacggaaactaacgttagaagagtacgaggtactacggtctttatntcgtgccgtacgttcgaggttagtggacgttaaggaaagttcgtaagtctctacgttcccgttacgtccgttcggtaaccgggg

SEQ ID NO: 413664 - DNA, 755 bp, Homo sapiens
  misc_feature: GZ8MTXP01EC99R.25.28.C06.1.454.CMB.2.raw
  modified_base (307)..(307): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcggtgggggagcgtggtccagccgtgggaactccctgacgactctctgtgtgcgcctagactcacttcagtagtatggcttcgtcgtggggtccccncgtagtcgtacgagggacggaaggggcgtagggaggtcggcgttaggggtagtttacgttggtctagaacaagaaccaaatgaatagtacgtacgacggcgggtacgtccgggtagggaccgggaccgtactaccgaacctacgtaccgtacggaacggtaactaaacgttaaccgaaacgtaaccgtaaaccctactacttacgtaacgtaaacgtaaacgtaaacggtaaacgtaaacgttaacggtaacggtaacggtaacggtaacggttaacggttaaccggttaccgttttaacgtttaacgttacgtacggtaaccggtaaccgttacggtaacgggttacggtacggtaacggttaaacggttaaaacggttaacgttaacgttacgttaaccgttacccgttacccggttacccgtaacccgttaaccgggtaaccggg

SEQ ID NO: 413665 - DNA, 557 bp, Homo sapiens
  misc_feature: GZ8MTXP01BIV6R.25.28.C06.1.454.CMB.2.raw
  modified_base (175)..(175): a, c, t, g, unknown or other
  modified_base (271)..(271): a, c, t, g, unknown or other
  modified_base (300)..(300): a, c, t, g, unknown or other
  modified_base (365)..(365): a, c, t, g, unknown or other
  modified_base (442)..(442): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgcttcttttaagnggtgtccagtgtcaggcgcatctggtggagtcgtgggggagcgtggtccagcctgggaatccctgagactctctgtgtggcgctagactcaccttnagtagtatggctttcggtactgggtcccnctagtgtccaggcaagggggctaggagtgctggggattactggctggacagaccaaatgacatanacacgcgagtcgtgacgggacggatcacactctccaggacaattacaacgaacgaacctactacttactcgaacaanacgaacaatagagagagagagtacgtacgttatactcgtgctcgcgagagtaggtagttaagttaaacgttacgtaacgtacgtaactacgtaccgttacgtaaccgttcgtcgg

SEQ ID NO: 413666 - DNA, 720 bp, Homo sapiens
  misc_feature: GZ8MTXP01EDRE0.25.28.C06.1.454.CMB.2.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgaccaagtctccatcctccctgtctgcatctgttggagacagagtcacatcacgttgccgggcgagtcgagggcattggctaattatttagcctggtatcaaacaagaaaccgagggagtagttcctaagctcctgattctatcgctcgcctaccgaccgttaccacgtcgacggggtccctaacgttccgttcgggttacgagtccgggacgtaggtacgaacgttcgttacggggactaacggtacgttctaccttacctacctacgttaactccgaacggacaaccggtccttacggccgtacggtcccgttaaggtaaacgtaagtttcggttacggtaacctttaaaaacgttttactttaaaccgttaacggttaaaacgtaaaagttttaaacctttaaaacttaaacccggtttcccgttaacccccctttcgtttaaccccggtttaaccggttttccgggggaacccgggggtaaccgggggttaaaacccgtaagggggttacgggaacggttaacgttaaacccggaaaacggtttaaaccgggg

SEQ ID NO: 413667 - DNA, 606 bp, Homo sapiens
  misc_feature: GZ8MTXP01B6RAK.25.28.C06.1.454.CMB.2.raw
  modified_base (222)..(222): a, c, t, g, unknown or other
  modified_base (346)..(346): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgaccaagtctccatcctcctgtctgcatctgttggagacagatcacatcatggccgggngagtcaggcagttggaaattgttgctggtatcagacagaaaccgaggggtaaacttcctaacctctacatctatgctgctactcctactttcgacttacggttttcggggtcccctgtaccgtntttcgaggtccggcgtaggttcggggttcgtggggactagtaactctactctaccaccgtatcgtaacgcacgtccgtgacacgtccggtagtaagtacttgttacgtacttaactttattaacgttacgttaaactaaaagtttcgaacgtaacggttacgttaccgggttaggttcgttacgggttccggaccccgggttacgggttaacccgtaagggcgtaaccgtaacgtaacgaaaccgtaacgttcggtcggg

SEQ ID NO: 413668 - DNA, 722 bp, Homo sapiens
  misc_feature: GZ8MTXP01ECUA4.25.28.C06.1.454.CMB.2.raw
  modified_base (179)..(179): a, c, t, g, unknown or other
  modified_base (259)..(259): a, c, t, g, unknown or other
  modified_base (280)..(280): a, c, t, g, unknown or other
  modified_base (293)..(293): a, c, t, g, unknown or other
  modified_base (316)..(316): a, c, t, g, unknown or other
tcagactgtacagtcacgaccggtgctcgatttagagctcacgtattggggtttggggggggagaggagcccagcactagaagtcggcggtgtttccactcggtgatcagcactgaacgcagcggactcaccatggagtttgggctgaacttgggttttcctcgttgcttcttttaagnggttgtccagtgtcaggcgcatcgtgggtggaggtcggtgggggggaggtcggtggtccaggccgtagggggaactcccngacgactctccgtgtgtggcncctagctcacttnagtatatggcttcgctgggtccncgagtcgccgagggcgaagggggctgggagtgggcgtgggtagtttacgtggtctagacaaggaaacctaaagtgaactataacgtccaacgggccgggtaagtcccgggtggggaaccgggggccctaacgtttaccgaacctaacgttcccgtaccggaacgggtaaacctaaacgttacccgaaaacgtaacccgtaaaccccttcttaactcctaaggtaaacctaaaagtaacgggtaaaacctaagttaggaacggtaggtaaccggaaaggttacggtttaccggttaccgttttaattacgtggtacgaaccgtacttaggaggttaagtacggtaacggttaaggttaaacgttcgttgtctaacctcgttcccgacgtaacccgttgggaaccggg

SEQ ID NO: 413669 - DNA, 574 bp, Homo sapiens
  misc_feature: GZ8MTXP01BMNN2.25.28.C06.1.454.CMB.2.raw
  modified_base (262)..(262): a, c, t, g, unknown or other
  modified_base (276)..(276): a, c, t, g, unknown or other
  modified_base (284)..(284): a, c, t, g, unknown or other
  modified_base (300)..(300): a, c, t, g, unknown or other
  modified_base (303)..(303): a, c, t, g, unknown or other
  modified_base (369)..(369): a, c, t, g, unknown or other
  modified_base (409)..(409): a, c, t, g, unknown or other
  modified_base (446)..(446): a, c, t, g, unknown or other
  modified_base (512)..(512): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccaggcctggggaactccctgagactctcctgtgtggcncctagactcacttnagtagtanggcttcgctgggtccnccngtgtccaggcgaagggggctgggagtggctggggattacgttggctggacagaccaaatgacatancacggcgagtccggtaggacggggccaattcaaccactcnccgagggacaacttaccgaaagacgaaccctctatcncgacaaactaggaaactaactagagtagcggagagtacggtccgttatactgtgcgacttcgaggnggtgacgttaggttaaaagttcggtaatcgtctcgttacccgttcgtaaccgttcgtcgggg

SEQ ID NO: 413670 - DNA, 572 bp, Homo sapiens
  misc_feature: GZ8MTXP01D2FMG.25.28.C06.1.454.CMB.2.raw
  modified_base (256)..(256): a, c, t, g, unknown or other
  modified_base (270)..(270): a, c, t, g, unknown or other
  modified_base (294)..(294): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagactctctgtgtgcncctagactcacttnagtatatggcttcgtctgggtccnccagtcgtccagggcaagggggctggagtggctggggagttacttggtctagacagaaccaaatgacatatcacgcggagtcccgtgacggggccatcaccatctcagggacaattacaaagacgaacctctatactagacaaatacggaaactaacgttagagtagtcgaggtacgtaacggtccgtttattacgtcgtgcgtacttcgaggttagtggtagttaaggaaaagttaggtaagtctctacgttcccgttacgtaaccgttcgtcgggg

SEQ ID NO: 413671 - DNA, 755 bp, Homo sapiens
  misc_feature: GZ8MTXP01BFQT7.25.28.C06.1.454.CMB.2.raw
  modified_base (272)..(272): a, c, t, g, unknown or other
  modified_base (318)..(318): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttggctgaacttgggttttcctcgttgcttcttttaagaggttgtccagtgtcaggcgcatcgtgggtggaggtcgtggggggagcgtggtccagccgtagggaactccctgacgtactctcctggtgtggccncctagactcaccttcagttagtatggtctttcgcgtcggggtcccnctaggtcaccgaggacgagggggctagggagtggcgtgggtatttcgtggctagacagaacaatgaacatactcacgggcgggatcccgggtagggaacgggggtccctaaatttcccgaaccctacgtcccgtaccggaagggaacttaaacgttacccgaaaacgaccgtaaccccttacttaacgacttaacgaaccttaaaagttacggggaaaaacccttaaacggtttacggaaacggttaaggtaccgggtaagggtaaccgtttaaccggggtttactttttaaaccgttagtcggttacggaaccgtacccgttacggaacgggttacggtaggggtaaccgttaaagggggttaaaactttccgggtaatttcccgtaacgttacccgttccccgggttacgaaccccggtttcgggtaacccgggg

SEQ ID NO: 413672 - DNA, 649 bp, Homo sapiens
  misc_feature: GZ8MTXP01CCIM6.25.28.C06.1.454.CMB.2.raw
tcagactgtacagtcacgaccggtgctcgatttagagctcacgtattgggtttttggggggaagaggaagactgacggtcctcccaggagttcaggtgctgggcaccttgggcacgggggaggcgtggtccagcctgggaagtccctgagactctcctgtgtggcgcctagactcaccttcagtagttatggcttcgtctgggtccgccagtgtccaggcaaggggctgggagtggcgtgggagttacttggtctgacagacaaatgacatatcacggcggagtccggtggacggggccgattccaaccagtcctccgaagggacaaattccaaagacgaaccctctatctagacaaaatgaaacaacttgaagacgtaccgaggagtaccggtcgtttataacgtgtcgacgtacctcgagggagtggacgtaaggaaaacgtcgtagtctacgtaccttcccgtcgtaccgtcgtcggggaccgacgggccaccgttcggtccgtaccgtcctcctcacgtcccttacccgaaccgaccggcccctacgtccggttccctccccgtcggtcccgcccgtcgccgtccgcggttaccgccgacccgttcgggcggggccaccggcggcccggtcccgttcgggtcccg

SEQ ID NO: 413673 - DNA, 713 bp, Homo sapiens
  misc_feature: GZ8MTXP01D1LCA.25.28.C06.1.454.CMB.2.raw
  modified_base (183)..(183): a, c, t, g, unknown or other
  modified_base (265)..(265): a, c, t, g, unknown or other
  modified_base (279)..(279): a, c, t, g, unknown or other
  modified_base (286)..(286): a, c, t, g, unknown or other
  modified_base (302)..(302): a, c, t, g, unknown or other
tcagactgtacagtcacgaccggtgctcgatttagagctcacgtattggggtttggggggggagaggagcccagcactagaagtcggcggtgtttccactcggtgatcagcactgaacgcagcggactcaccatggagtttgggctgaacttgggttttcctcgttgcttcttttaagaggtntccagtgtcaggcgcatctgggtggagtcgtggggggagcgtggtccagccgtgggaactccctgagactctctgtgtggcncctagactcacttnagtagtngcttcgtctgggtccnccagtgccgaggcgaagggggctgggagtgggcgtgggggtatttacgttggtctgacgaacgaacaaatgaaccattacaaccgacggcggggactacccgggtggggaacgggggtcccatttacccgacctactccgtaccgaagggaactaacgttaccaaacgtacgtaaaccccttctaactcctagaaacctaaataacgggaaacctaaacgttagaagggtaacgtacggaaacgggtaacgttaccgggttacccgttttaaagttaccgttggtacggtaacccgtaaccgttccggtaaaggttaggtaccgggtaacgttaaaggggttaaaaacgttccggttaagttccttaacgttaacccgttcccgttccgtaacccgtttcggtcccggggg

SEQ ID NO: 413674 - DNA, 717 bp, Homo sapiens
  misc_feature: GZ8MTXP01D749O.25.28.C06.1.454.CMB.2.raw
  modified_base (252)..(252): a, c, t, g, unknown or other
  modified_base (307)..(307): a, c, t, g, unknown or other
tcagactgtacagtcacgaccggtgctcgatttagagctcacgtattggggtttggggggggagaggagcccagcactagaagtcggcggtgtttccactcggtgatcagcactgaacgcagcggactcaccatggagtttaggctgaacttgggttttcctcgttgcttcttttaagaggtgtccagtgtcaggcgctatcgtgggtggagtcgtggggggagcgtggtccagccgtgggaactcctgacnctctctgtgtggcgcctagactcacttcagtagtatggcttcgtcgtcgggtccnccaggtcgtccgaggggcaaggggggtctgggagtgggtctgggggtagtttacgttggtctgaacagaaccaaatgaactatactccgaacggcgggtagtcccgggtagggacgggggtcctagttccacctacttccgtaccgaaggggaacctaaacgttacccgaaaaggtaaccgtaaccccttactaacttacgtacgaaacgtaaaactacggggtaaaactaacgttacggaagtacggtacggaaggtacgttaaccggttccgtttaattaccgtgtcgaacgtacccttaggacgggttagtcgggtaacgttaacgggttaaaaacggttcggtaacgttccgttaaccgtaccgtttccccggttaccggtaaccccgttcgggtaacccgggggg

SEQ ID NO: 413675 - DNA, 829 bp, Homo sapiens
  misc_feature: GZ8MTXP01BKLAG.25.28.C06.1.454.CMB.2.raw
tcagactgtacagtcacgaccggtgctcgatttagagctcacgtattggggtttggggggggagaggagcccagcactagaagtcggcggtgtttccactcggtgatcagcactgaacgcagcggactcaccatggagtttgggctgaacttgggttttcctcgttgcttcttttaaggaggtgtccagtgtcaggcgcatcgtgggtggagtcggtgggggagcgtggtccagccgtagggaacgtccctgacgtactctccgtgtggtggccgtacctagactccgtaccttcgagttagtagtggtcctttcggtcgtcgggtcccgaccgtagtcgtaccgagggacgaagggggtctgggaggtggtcgttggggtacgtttacgtggtctagaacaagaaccaaagtgaactatacgtaccgaaccggtcgggtaacggtcccggggtagggaccgggggtacccttaacgttacccaaccgtaacctccgtaacccggaaaggggtaacctaaaccgttaacccgaaacggtaaaccgtaaacccctttcgtaactaccgtaacgaaacgtaaacttaaccgggtaaaacttaacggttagaaaccgggtaggtaaccgggtaaacggttaaccggtttaaccggtttacgttttaaacgttaccggttcgggtaccggtaacccggtaaccgttacgggtaacgggttacggttaacggggtaaacggttaaaacgggttaaacggttaccggttaaccgtttaccttaacccgttacccgttacccgggttaccgtcccgggttaaccgggtaaccgggg

SEQ ID NO: 413676 - DNA, 676 bp, Homo sapiens
  misc_feature: GZ8MTXP01EEU3D.25.28.C06.1.454.CMB.2.raw
  modified_base (261)..(261): a, c, t, g, unknown or other
  modified_base (273)..(273): a, c, t, g, unknown or other
  modified_base (301)..(301): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggttgtccagtgtcaggcgcatcgtggtggagtcgtgggggagcgtggtccagcctgggaacgtcctgagctctctgtgtgcnctagactcactnagtagtatggtcttcgtcgtcgggtccncagtcgccgaggcgaagggggctggagtggcgtgggtatttacgtggtctggacagaaccaaagtgaactatactaccgacgggcgggtagtcccgggtagggacgggggtcctaattccgaacctacgtaccgtaccggaagggtaactaaacgttacccgaaacggtacctaaccccttataactaccgtagaacctaaagtacggggtaaactaacgtttacggaagtacggtaccggtaaggtacgttaaccggttcgtttaattaccgtgttcgaaccgtacgttggaggttacggtacggtacgttaaagggttaaacgttcgtaagtcctaacgtaccgttcccgacgtaacccgttcggtaaccggg

SEQ ID NO: 413677 - DNA, 708 bp, Homo sapiens
  misc_feature: GZ8MTXP01CQU6X.25.28.C06.1.454.CMB.2.raw
  modified_base (195)..(195): a, c, t, g, unknown or other
  modified_base (310)..(310): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcncatcgtggtggagtcgtgggggaggcggtggtccagccgtgggaacgtccctgacgtactctcctgtgtggcgcctagactcacttcagtagtatggcttcgtcgtcgggtcccnccagtcgtcccgagggtcgaagggggctgggagtgggcgttggggtattacgttggtctgactaagaaccaaatgactatactacgacggcggagtccggtagggacggggcctaattccaccctactcctaccgagggtacctaagttacccgaaacgactaaccctctaacttctagacctaaagtacggtaaactaacgttagacgtaaggtccggaaggtaacgttaccgggttccgttttaacgttaacgttcggttaacggtcccgtaaccgttacggtacgggttaacggttacgggtacggttaaacggggttaaaaacggttccggtttaacggtacccttcgtaacccgtttccccggttaccgtaacccgttccgggtaaccggggg

SEQ ID NO: 413678 - DNA, 883 bp, Homo sapiens
  misc_feature: GZ8MTXP01BQEXP.25.28.C06.1.454.CMB.2.raw
  modified_base (264)..(264): a, c, t, g, unknown or other
  modified_base (277)..(277): a, c, t, g, unknown or other
  modified_base (284)..(284): a, c, t, g, unknown or other
  modified_base (304)..(304): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaaggaggtgtccagtgtcaggcgcatcgtggtggagtcgtgggggagcgtggtccagcctagggaactcctgacgactctcctgtgtgcncctagctcacttnagtagtntggcttcggtctcgggtccncctagtcgccgagggtccgaagggggtctaggggaggtcggtcgttgggggtaacttttaccgtggggtacctaggaacctaaggaaaccaaaagttcgaaactattaacgtcccgacgggcgggtacgttcccgggaggggaccgggggtccctattacccaaccgtacgttaccgtaccggaaacggggtaaccttaaacgttacccgaaaacggtacccgttaaaaccccctttacgtaaaccgttacgtaaacgtaaaaccgttaaaacgttaaccggggtaaaaccgtttaaacgggttacgggaaacgggttaacgggttaacccggggtaaacggggtttaaacccggttttaaacccggggttttaaccgtttttaaacggtttaccggttacggggttaccgggtaaccccggttaacccggttacgggtaaacgggggttaacgggtaaccggggtaaacggttaaaaacgggggttaaaacgtttccgggttaaccgttacccttaacccggttacccggtttacccccggttaccggtaacccgggttaacccgggggtaaccgggg

SEQ ID NO: 413679 - DNA, 711 bp, Homo sapiens
  misc_feature: GZ8MTXP01A1W6P.25.28.C06.1.454.CMB.2.raw
  modified_base (280)..(280): a, c, t, g, unknown or other
  modified_base (301)..(301): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttggctgaacttgggttttcctcgttgcttcttttaagaggtgtccagtgtcaggcgcatcgtggtggagtcgtgggggagcgtggtccaggccgtagggaactccctgacgtactctcgtgtggtgcgctagctctacttnagtgtatggcttcgctggccncagtgccgaggcgaagggggctgggagtgggcgttaggggtactttacgttggtctaggacgtaacgaaccctaaatgaactaatacgtaaccgacgggcgggtaacggttccggaggggtacgggggtcccctaagtttccccaacgtacgttaccgacccggtaaggggtacctaaacgttacccaaacggacctaaccccttctaacgttcctaggtaaccctaaagtacggtaaactaaacgttaggaggtaacgacggtaacggtaacgttaccggttaccttttaagttaccgtagtcgaaccggtaccttacgaagggttgtacgggacgttaaacgggttaaacgttacgtcgttaccttaaccgaccgtttccccggacggtcccgttcgggtcccggggg

SEQ ID NO: 413680 - DNA, 599 bp, Homo sapiens
  misc_feature: GZ8MTXP01AZ119.25.28.C06.1.454.CMB.2.raw
  modified_base (262)..(262): a, c, t, g, unknown or other
  modified_base (277)..(277): a, c, t, g, unknown or other
  modified_base (462)..(462): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtggggggagcgtggtccagccgtgggaactccctgagctctcctgtgtggcncctagactcaccttnagtagtatggtcttcgtcgtgggtccgccagtgtccgagggcgaagggggctgggagtgggcgtgggtagtttacgttggtctgacagaaccaaatgacatatacgacggcggagtccggagggacggggcatccacctctctaccgaggacaattacaagaccgtacctcactctagactaaanagaactaacgttgagtaggtacgaggtacgttaccggtcgtttatacgtgtcgaacgaccttaggtaggaggtggtaacgttaacggaaaagttcgtaacgtctcgtacgttcccgacgtaaccgttcggtccgggg

SEQ ID NO: 413681 - DNA, 566 bp, Homo sapiens
  misc_feature: GZ8MTXP01DB3PZ.25.28.C06.1.454.CMB.2.raw
  modified_base (258)..(258): a, c, t, g, unknown or other
  modified_base (272)..(272): a, c, t, g, unknown or other
  modified_base (280)..(280): a, c, t, g, unknown or other
  modified_base (297)..(297): a, c, t, g, unknown or other
  modified_base (365)..(365): a, c, t, g, unknown or other
  modified_base (371)..(371): a, c, t, g, unknown or other
  modified_base (430)..(430): a, c, t, g, unknown or other
  modified_base (434)..(434): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctgggtggagtcgtgggggagcgtggtccagcctgggaactcctgagctctctgtgtggcncctagactcacttnagtagtanggcttcgcgtgggtccncagtctccgaggcagggggctgggagtgggctgggtattacgtggtctgacagaaccaaatgacatancgacgngggtatccgggagacggggccattcacatctccgagggacaatacaaagacgtaacctntacnctagactaaatggaaacacgttagagagtacgagagttacggtcgttattactgtgaacgtcttgtaggagtggacgttaaggaaaagttcgttaacgtctcgtacttccgttacgtccgttcggtccgggg

SEQ ID NO: 413682 - DNA, 611 bp, Homo sapiens
  misc_feature: GZ8MTXP01EHQLY.25.28.C06.1.454.CMB.2.raw
  modified_base (257)..(257): a, c, t, g, unknown or other
  modified_base (269)..(269): a, c, t, g, unknown or other
  modified_base (275)..(275): a, c, t, g, unknown or other
  modified_base (294)..(294): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcgtgggggagcgtggtccagcctgggatcctgagctctctgtgtgcnctagctcacttnagtgtntggcttcgcgtgggtcccnctagtgtccaggcagggggctggagtggctgggggtatttacgtggtctgacagaaccaaatgactagtactccgaacggccgggtagtcccgggtagggacgggggccctaattcccgaacctactcctaccgagggaactaaacttacccaaagacgtaaaccctctaactctagacaaatacgggaaactaacgttagacgtagtacgaacggtagttaccggtaccgtttattacgtgtcgcgtaccgttgacggagtggacgttaggaaagttcgtaagtctaactacgttcccgacgtccgttcgtccggg

SEQ ID NO: 413683 - DNA, 736 bp, Homo sapiens
  misc_feature: GZ8MTXP01CYT19.25.28.C06.1.454.CMB.2.raw
  modified_base (261)..(261): a, c, t, g, unknown or other
  modified_base (264)..(264): a, c, t, g, unknown or other
  modified_base (305)..(305): a, c, t, g, unknown or other
  modified_base (659)..(659): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttggctgaacttgggttttcctcgttgcttcttttaagaggttgtccagttgtcaggcgcatcgtggtggagtcgtgggggagcgtggtccagccgtgggaacgtccctgacgtctctctgtgngcncctagactctacctgagttatatggcttcgtcgtcgggccnccgagtcgtccgaggcgaagggggctaggagtgggtcgtgggggtacgtttacgttggtctagacgtagaaacctaaatgaactagtactcgaacggcggtaaggtccgggtacggggacggggtccctaattcccgaaccctagtacccgtaccggaacggggtaacctaaacgttacccgaaaagtacccggtaaaccccttagttaacctaccgtaaggtaaactaaaacgttcggaaaaacgttaaccgtttagggaaacgtacggtaaacgtaacgggtaacgttaaccggggttacctttaagttaaccggtgttacccgaaccgttaccggagtaggaggttacggngttaaaacgggttaaacttcgggtttaactcgttaaccgttcgttaccccgggacgttaaccccgttggggcccggg

SEQ ID NO: 413684 - DNA, 657 bp, Homo sapiens
  misc_feature: GZ8MTXP01BXB0U.25.28.C06.1.454.CMB.2.raw
  modified_base (268)..(268): a, c, t, g, unknown or other
  modified_base (282)..(282): a, c, t, g, unknown or other
  modified_base (290)..(290): a, c, t, g, unknown or other
  modified_base (311)..(311): a, c, t, g, unknown or other
  modified_base (324)..(324): a, c, t, g, unknown or other
  modified_base (485)..(485): a, c, t, g, unknown or other
  modified_base (562)..(562): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcggtgggggagcgtggtccagccgtagggaactcctgacgtacctctcgtgtgtggcncctagactcacttnagttagtntggtcttcgcgtcgggtcccncgtagtcgaccgngggacgaagggggctgggagtggcgtgggtatttcgtggtctagacagaaccaaatgaactattacgaccgacggcgggtacgttcccgggagggaccggggtcctacttccgaacctatcccgtacggaacggaactaacgtaccaaagaccgtaccctntactcacgacaaatacggaaactacgttaggaacgtacggtacgaacggttacgtaaccgggttcctttaattccgnggttcgaacgtaccgttggaggttagtacgggagttaaacgggttaaattcggtaactcgtaactccggtcccgttaccgtcgttcgggtccggg

SEQ ID NO: 413685 - DNA, 713 bp, Homo sapiens
  misc_feature: GZ8MTXP01AULJV.25.28.C06.1.454.CMB.2.raw
  modified_base (273)..(273): a, c, t, g, unknown or other
  modified_base (279)..(279): a, c, t, g, unknown or other
  modified_base (299)..(299): a, c, t, g, unknown or other
tcagactgtacagtcacgaccggtgctcgatttagagctcacgtattgggtttggggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggaggcgtggtccagccgtgggaacgtccctgagtctctctgtgtgcgctagctcactnagtatntggcttcgtcgtcgggtccnccgtagtcgtccgaggggcgaagggggctgggaggtggcgttgggggtactttacgttggtctggacagaacccaaatggactaatactacgacggcgggtacgtcccgggtagggaacgggggtcctaacttccgaccctacgtccgtacccggaagggtacctaaacgttacccgaaacggtaccgtaaaccccttacgttaactaccttaacgaacctaaaacgtacggtaaaacctaacggtttaggaacgggtacgtaaccgggaacggtaacgttacccggttacgttttaacgttacgtggtccggtcgtaaccgttacggtaggttaggtacggtacggttaaaggttaaacggttcgtaaggtccttcgtaaccgttcccgacgtcccgttcggtaacccggggg

SEQ ID NO: 413686 - DNA, 610 bp, Homo sapiens
  misc_feature: GZ8MTXP01CHWBY.25.28.C06.1.454.CMB.2.raw
  modified_base (262)..(262): a, c, t, g, unknown or other
  modified_base (276)..(276): a, c, t, g, unknown or other
  modified_base (282)..(282): a, c, t, g, unknown or other
  modified_base (303)..(303): a, c, t, g, unknown or other
  modified_base (376)..(376): a, c, t, g, unknown or other
  modified_base (393)..(393): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcgtgggggagcgtggtccagccgtgggaactccctgagctctctgtgtggcncctagctcaccttnagtatntggtcttcgtcgtgggtcccnccgtagtcgtcccgagggcaagggggctgggagtggcgtggggtattcttggctgacagaccaaatgacatancgacggcggagtccggnggcggggcattcacatctcgaggacaacttaccaagacgaacctctatctagacaaataggaaactaacgttagagagtacgaggtacgttacggtcgtttattaccgtgtcgtccgtacgttcggagggttaggtacgggtcgttaagggttaaaacgttcggttaacgtcgtaaccgtaccgttcccggttaccgtaacccgttcggtcccgggg

SEQ ID NO: 413687 - DNA, 572 bp, Homo sapiens
  misc_feature: GZ8MTXP01BY4CH.25.28.C06.1.454.CMB.2.raw
  modified_base (281)..(281): a, c, t, g, unknown or other
  modified_base (289)..(289): a, c, t, g, unknown or other
  modified_base (304)..(304): a, c, t, g, unknown or other
  modified_base (333)..(333): a, c, t, g, unknown or other
  modified_base (349)..(349): a, c, t, g, unknown or other
  modified_base (360)..(360): a, c, t, g, unknown or other
  modified_base (372)..(372): a, c, t, g, unknown or other
  modified_base (401)..(401): a, c, t, g, unknown or other
  modified_base (436)..(436): a, c, t, g, unknown or other
  modified_base (444)..(444): a, c, t, g, unknown or other
  modified_base (513)..(513): a, c, t, g, unknown or other
tcagactgtacagtcacgaccggtgctcgatttagagctcacgtattggggtttggggggggagaggagcccagcactagaagtcggcggtgtttccactcggtgatcagcactgaacgcagcggactcaccatggagtttgggctgaacttgggttttcctcgttgcttcttttaaggaggtgtccagtgtcaggcgcatctgggtggagtcgtggggggagcgtggtccaggccgtgggaactccctgacgtctctcctgtgtggcgcctagctcactnagtagtanggcttgcgtggtccnctgtcgccgaggcagggggctggagtggngtgggattcgtggtcngacagaccaangacatatcacgngacgtccgggtgacgggtcctatcaaccnctcgtccgaggacaacttaccaagacgtaaccctntactctanaccgaaatacgaaactacgtagacgagtcgagtagtaccgtcgtttatacgtgtgcgtacttcggaggngtagggacttaaggaaaagttcgtaagtctcgtctcccgttcgtaaccgttcgtcgggg

SEQ ID NO: 413688 - DNA, 631 bp, Homo sapiens
  misc_feature: GZ8MTXP01BJ9P0.25.28.C06.1.454.CMB.2.raw
  modified_base (299)..(299): a, c, t, g, unknown or other
  modified_base (380)..(380): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtctgggggagcgtggtccagcctgggaagtccctgagactctcctgtgtggcgcctagactcacttcagtagtatggcttcgtctggggtccccncagtcgccaggcgaagggggctgggagtggcgtggggtaagtttacgttggtctagaacagtaaaccaaaatgaactatanccgaacgcgggtacgtccggtgggaacggggcctaattccaacctataccgtaccgaagggaactaaacttaccgaaagaacgtaaaccctactaactctagacaaactaacgaaactaaacgtaagagaagtacgaacggtacgtaacggtaccgtttacttaactcgtgcgaccgttcgacggaggtaggtacgttaaggttaaaagttaacgtaagtctctacttcccgttaccgtccgttcgtcggg

SEQ ID NO: 413689 - DNA, 703 bp, Homo sapiens
  misc_feature: GZ8MTXP01BV5FP.25.28.C06.1.454.CMB.2.raw
  modified_base (181)..(181): a, c, t, g, unknown or other
  modified_base (313)..(313): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcactatggagtttgggctgaacttgggttttcctgttgcttcttttaagaggtntccagtgtcaggcgcatcgtggtggagtcggtgggggagcgtggtccagccgtgggaacgtccctgagtactctccgtgtgtggcgcctagactcacttcgagtagtagtggtctttcgtcgtcgggtcccnctaccccgtgtaccgagggcgaagggggctgggagtgggcgtgggtattacgtggtctaggaactagaacaaatgaactataacgtcaacgggcgggaacgtcccgggagggtaaccgggggcctaacgttaccaacctactacccgtaccgaacgggactaaacgttacgaaacgtaccgtaaaccctctactactacgaactaaacgtaaggaaaccgtaagttacggaaggtaacggtaccgaaggtaaccgttaccggttaccgtttaaagttacgtacggtcgaaccgtaacgttcgaaggttacgggtacggtagttaaacgggttaaaacgttcgtaacgtcctaactaccgtcccgttacgtaaccgttccggtaaccgggg

SEQ ID NO: 413690 - DNA, 789 bp, Homo sapiens
  misc_feature: GZ8MTXP01DR108.25.28.C06.1.454.CMB.2.raw
  modified_base (262)..(262): a, c, t, g, unknown or other
  modified_base (266)..(266): a, c, t, g, unknown or other
  modified_base (286)..(286): a, c, t, g, unknown or other
  modified_base (304)..(304): a, c, t, g, unknown or other
tcagactgtacagtcacgaccggtgctcgatttagagctcacgtattggggtttggggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcggtggggggagcgtggtccagccgtgggaactccctgagactctctgtgnggcncctagctcacttcagtgtangtcttcgtcgtcggtccncctagtcgtaccgagggacgaagggggctaggaggtgggtcgttaggggtacgtttacgttgggtctaggacaaggaaacccaaagtcgaactaactactaaccggaccgggtcggggtaacgtcccggggtaggggaaccgggggtaccctaacgtttacccgaaaccctacgttcccgtaaccggaaacggggtaaaccctaaacgttaacccgaaaacggtaacccgtaaaccccttacttaacttaccgtaacgaaacctaaaagttacggtaaaaccgtaaacggtttacggaaacgggtaggtaaccggtaaggttaaccggttaaccgggtttacccgttttaattaaccggtgttacggaaccggtaaccgttacggaacgggttaggtaacgggtacgttaaaagggttaaaacgttcggttaacgtccttaacgtaccgttacccggttaccgtaaccggttcggtaacccgggg

SEQ ID NO: 413691 - DNA, 676 bp, Homo sapiens
  misc_feature: GZ8MTXP01BK41R.25.28.C06.1.454.CMB.2.raw
tcagactgtacagtcacgaccggtgctcgatttagagctcacgtattggggtttggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtggggggagcgtggtccagcctgggaatccctgagctctcctgtgtgcgcctagactcaccttcagttagtatggctttcgtcgtgggtcccgcctagtcgccagggcaagggggctagggagtggcgtgggtagttactgggtctggacagtaaccaaatgaacatagtacacggcggagtcccggtgggacggggcctattccgacctatctaccgagggactaacgttaccaacgtacgtaaccctacgtactctacgactaaacgtacgggaaactaacgtacgtacggtagtacggacggtaacgttaaccgggtaccgtttaaacgttaccgtacggttacgtaaccggtacccgttacggtagggttaccggtagggtaacgttaaagggttaaaaaggttccggttaacgttcgtaaccgtaccgttcccgttaccggtaaccgttcggtaacccgggg

SEQ ID NO: 413692 - DNA, 691 bp, Homo sapiens
  misc_feature: GZ8MTXP01BKEH3.25.28.C06.1.454.CMB.2.raw
  modified_base (203)..(203): a, c, t, g, unknown or other
  modified_base (233)..(233): a, c, t, g, unknown or other
  modified_base (405)..(405): a, c, t, g, unknown or other
  modified_base (684)..(684): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctccagctatcagatgtggcatccagatgacccagtcctccactccctcctgtctgcattctgttgganacagatcacctatccacgttggcccgggtnaggtcgagggtctaagttaggaaatttgtcggaccttaggtactcgagacaaggaaaccaaggggtaaacctttccctaacccctaccctatcgtatcggctactcgattacccgtacgtttcgtacccgttaaaggttttccggggtcccgttcccgtgtaacgtttaccncgggcggtacgtggtcggggtaccgtaggggactaaacgtctaactctactcaacctataccgtaagtaccgcgtacccgtacggacacggttaccgtagggttaagaaacgtttcggttaaaccgtcttaaacgtttacgtttaaacctaaggtttaaactaaaaagtttccggaagttaccgttaacgtaacccgggttgtacgtttacggtccggtaaccgaagggaccgttaaagggtggaaccttaagaacccgaaacgttaggtaacgggttnaacccgg

SEQ ID NO: 413693 - DNA, 730 bp, Homo sapiens
  misc_feature: GZ8MTXP01AF9V5.25.28.C06.1.454.CMB.2.raw
  modified_base (208)..(208): a, c, t, g, unknown or other
  modified_base (337)..(337): a, c, t, g, unknown or other
  modified_base (704)..(704): a, c, t, g, unknown or other
tcagactgtacagtcacgaccggtgctcgatttagagctcacgtattggggtttttggggggaagaggaagactgacggtcctcccaggagttcaggtgctgggcaccttgggcacgggggaggcgtggtccagcctgggaagtccctgagattctcctgtgtggcgcctagactcaccttcagtagttatggcttcgtctgggtccnccagtgtccaggcaagggggctgggagtggcgtgggagttacgttggtctgacagacaaatgaacatatcgacgcggagtccgtggacggggcattcacatctccgaggacaactcaagacgaaccctntactctagactaaagtcgaaactaacgttgaagtacgtacccggaggtacgtaccggttaccgtttattaaacgcgggttcgaccgtaccgtacgtaagggaggtcgggtaactaaagggtaaaaacgttcggttaaaggtccttaccgttaaccgttacccggtaccgtaacccgtcgggtaccgggggacctacggggaccctacccgttcggggtcctaaccccggttccttacccgtaccgaccggttacccttacccggaaacccggtaaaccggggcccctacggttcccggtcccttccccggtcggcccgttcccgtgttccgaccggtacggcgttaccgccgtccgggtcggaaccncgacggttccggtcgttaacggtccg

SEQ ID NO: 413694 - DNA, 651 bp, Homo sapiens
  misc_feature: GZ8MTXP01AWWUJ.25.28.C06.1.454.CMB.2.raw
  modified_base (178)..(178): a, c, t, g, unknown or other
  modified_base (284)..(284): a, c, t, g, unknown or other
  modified_base (310)..(310): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagnggtgtccagtgtcaggcgcatcgtggtggagtcgtgggggagcgtggtccaggccgtgggaactccctgacgactctccgtgtggtggccgcctagactcaccttnagtagtatggtcttcgcgtgggtccncgagtcgtccgagggcgaagggggctgggagtcggcgtgggtagtttacgtggtctagacagaacccaaatcgaactatacgtacgaccggcggacggtcccgggtagggacgggggtcctattccaacccacttccgtaccggtagggaactaaacgttacccaaaggtaccgtaaccctctaactctagaactaaatacggaaactaacgttaggaacgtacgtcggacggtaacgtaccgggttaccgtttaagttacgtcgtgccgtaccttgaggcgtaggacgttaagggaaacttcgtaagtctaactacgttcccgactaaccgttcgcgggg

SEQ ID NO: 413695 - DNA, 620 bp, Homo sapiens
  misc_feature: GZ8MTXP01A0O88.25.28.C06.1.454.CMB.2.raw
  modified_base (201)..(201): a, c, t, g, unknown or other
  modified_base (307)..(307): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgaccaagtctccatcctccctgtctgcatctgttgganacagatcacatcacttggccgggcgagtcgagggctattaggaaattgttggcctaggtactcagacaagaaaccgtagggtaaacttcctaacctctacatctancgctcgctaacgtcctacgtttcgtacgtaaggtttccggggtccctcgtcgtacttcgaacggtcgggtcgtagggttcggtacgttaggggaaacctagttaacttcaactcgtaccacatcaagcaacgctcgcgacgccggtagtaagtagtacgttacgtactaacttacgttaactacgtaaacttaaattacgtaacgtaacggtacgttaccggtaggttacggttacggttccgggttaccggacgggttaacggtaacgggtacggaacgtaacgtaacgaaacgtaacgttcggtaaccggg

SEQ ID NO: 413696 - DNA, 607 bp, Homo sapiens
  misc_feature: GZ8MTXP01D2J5S.25.28.C06.1.454.CMB.2.raw
  modified_base (249)..(249): a, c, t, g, unknown or other
  modified_base (262)..(262): a, c, t, g, unknown or other
  modified_base (275)..(275): a, c, t, g, unknown or other
  modified_base (300)..(300): a, c, t, g, unknown or other
  modified_base (390)..(390): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttggctgaacttgggttttcctcgttgcttcttttaagaggtgtccagtgtcaggcgcatcgtgggtggaggtcgtggggggagcgtggtccagcctgggaactccctganctctctgtgtgcnctagactcacttnagtagtatggcttcgtctgggtccncagtcgtccgaggcgaagggggctggagtggcgtgggtagttcgtggtctgacagaccaaatgactatagtaccacggcggagttccggngggacggggtccattcacctatctaccgaaggactactacgaaacgaccgtaacctctactactagaactaaatacgggaaactaagttagaagaaggtaccgaagtacgttaccgggtactttattacgtgtcgaacgtacgttgaggttaggtacgtagttaaaggaaagttcgtaagtctctaccgttccgttacgtaaccgttcggaaccggg

SEQ ID NO: 413697 - DNA, 742 bp, Homo sapiens
  misc_feature: GZ8MTXP01B5D6T.25.28.C06.1.454.CMB.2.raw
  modified_base (284)..(284): a, c, t, g, unknown or other
  modified_base (292)..(292): a, c, t, g, unknown or other
  modified_base (314)..(314): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttggctgaacttgggttttcctcgttgcttcttttaagaggtgtccagtgtcaggcgcatcgtgggtggagtcggtgggggaggcgtggtccaggccgtaggggaacgtccctgacgtactctctgtgtggcgcctagctcaccttnagttagtntggtcttcgtcgtcgggtcccnctagtcgtccgagggcgaagggggctgggagtggcgtaggggtatttacgttggtctggactaagaaccaaagtgaactattacgtaccgacgggtcgggtaagtcccgggtagggaacgggggtccctaagtttcccaaaccgtactccgtaccggaacgggtaacctaaacgttaaccgaaacggtaaccgtaaacccttacgttaactacgtacgaaactaaacgtacgggtaaactaacgttagaaggtacgtaccggtaaggtaacgttaaccggttaccgttttaacgttacgttacggtcgtaaccgtaaccgttcggtaacgggttaggtagggtaacggttaaagggttaaaacgttcggttaacgttccgttaaccgtaccgtttccccggttaccgtaacccgttcggtaaccgggg

SEQ ID NO: 413698 - DNA, 759 bp, Homo sapiens
  misc_feature: GZ8MTXP01ATXMB.25.28.C06.1.454.CMB.2.raw
  modified_base (275)..(275): a, c, t, g, unknown or other
  modified_base (282)..(282): a, c, t, g, unknown or other
  modified_base (301)..(301): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatcgtggtggagtcgtgggggagcgtggtccagcctggggaatccctgagactctcctgtgtggcgcctagactcaccttnagtagtntgtcttcgtcgtcggtccnctagtcgaccgagggacgaagggggtctaggggagtcgggtacgtaggggtacttttacggtggtactacgaacagtaaacctaaagtcgaacaagtacgaaccgaacgggtcgggtacggtcccgggtaggggacggggtacctacgttacccgaaccgtattacccgtaaccggaaacgggtaacctaaaccgttaacccgaaaacgtaacccgtaaacccttactacgtactacgtaactaaaagtaacggtaaacgtaaacgttaacggtaacggtaacggtacggtaacggtaacgttaaccggttaccgtttaacgtttacgttacggtcggtaaccggtaaccgttacggtaacgggttacggtaacggtaacgttaaacgggttaaaacggttacgttaacgttacgttaaccgtaccgttacccgttaccgtaaccgttccggtccggg

SEQ ID NO: 413699 - DNA, 566 bp, Homo sapiens
  misc_feature: GZ8MTXP01A4D0S.25.28.C06.1.454.CMB.2.raw
  modified_base (161)..(161): a, c, t, g, unknown or other
  modified_base (301)..(301): a, c, t, g, unknown or other
  modified_base (455)..(455): a, c, t, g, unknown or other
  modified_base (510)..(510): a, c, t, g, unknown or other
tcagactgtacagtcacgaccggtgctcgatttagagctcacgtattggggtttggggggggagaggagcccagcactagaagtcggcggtgtttccactcggtgatcagcactgaacgcagcggactcaccatggagtttgggctgaactgggttttccncgttgctcttttaagaggtgtccagtgtcaggcgcatctggtggagtctgggggagcgtggtccagcctgggaatccctgagactctcctgtgtggcgcctagactcaccttcagttagtatggcttcgtctgggtcccncagtgtccaggcaagggggctgggagtggctggggatttactggctgacagaccaaatgacatatacgacggcggagtcccggtaggagggggcccaattccacccatactccgagggacaattccaaagacgaaaccctctaatctgacaaanggaacaacttagagagtcgaggactacggccgttattactgtgcgacttcgaggngtggcttaggaaaagttcgtaagtctaacacttcccgttcgaaccgttcgtcgggg

SEQ ID NO: 413700 - DNA, 621 bp, Homo sapiens
  misc_feature: GZ8MTXP01AZ13O.25.28.C06.1.454.CMB.2.raw
  modified_base (273)..(273): a, c, t, g, unknown or other
  modified_base (279)..(279): a, c, t, g, unknown or other
  modified_base (295)..(295): a, c, t, g, unknown or other
  modified_base (377)..(377): a, c, t, g, unknown or other
  modified_base (457)..(457): a, c, t, g, unknown or other
tcagactgtacagtcacgaccggtgctcgatttagagctcacgtattggggtttgggggggagaggagcccagcactagaagtcggcggtgtttccactaggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaatccctgagactctctgtgtgcgcctagctcaccttnagtgtnggcttcgctgggtccnccagtgtccgaggcgagggggctgggagtgggctgggggatttacgttggtctggacagaaccaaatgaacagtatcacggnggtagtcccggtggacggggcctacttcgacccagtccgtaccggaagggtactaacttaccgaaacgaccgaacccctntaactctacgacaaatacggaaactaacgttagaggtagtacgaggtacgttaccggtcgtttataccttggcgccgacttcggaggttaggtccggtagttaagggttaaacgttcgttaacgtctaacgtacgtttcccgacgtaacccgttcggtccgggg

SEQ ID NO: 413701 - DNA, 538 bp, Homo sapiens
  misc_feature: GZ8MTXP02IPV36.25.28.C06.1.454.CMB.2.raw
  modified_base (299)..(299): a, c, t, g, unknown or other
tcagactgtacagtcacgaccggtgctcgatttagagctcacgtattgggtttgggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagtagttatggcttcgtctgggtccnccagtgtccaggcaaggggctggagtggctgggattactggtctgacagaccaaatgacatatcacgcggagtccgtgaggggccattcaccatctccagggacaattcccaagacgaaccctctatctagacaaatgaactaacttgagagtagaggatacggccgtttatactgtgtcgactcacggagtggacgtaggaaaagtcgtaagtctactactccgtcacctcgtccggg

SEQ ID NO: 413702 - DNA, 492 bp, Homo sapiens
  misc_feature: GZ8MTXP02HT3NP.25.28.C06.1.454.CMB.2.raw
  modified_base (323)..(323): a, c, t, g, unknown or other
  modified_base (376)..(376): a, c, t, g, unknown or other
  modified_base (378)..(378): a, c, t, g, unknown or other
  modified_base (381)..(381): a, c, t, g, unknown or other
tcagactgtacagtcacgaccggtgctcgatttagagctcacgtattgggtttggggcagaagtctctctcagtcaggacacagcatggacatgagggtccctgctcagctcctgggactcctgctgctctggctcccagctatcagatgtggcatccagatgacccagtctccatccttccctgtctgcatctgttggagacagagtcaccatcacttgccgggcgagtcagggcattggaaattattggcctggtatcagcagaaaccagggaaatccaactctcatctatgctgcatccactttgctaatttgggtcctntcgattcagcgcagtggtctgggacagaattcactctcaccagtcagcagccncncanctagagatgtagtactacttattactataataaattagtactacgtacgtacgtacgtagtacgtacgtaccgacggacgaacgtacgacgacacgaacgaacgtacgtcg

SEQ ID NO: 413703 - DNA, 508 bp, Homo sapiens
  misc_feature: GZ8MTXP02IIPWN.25.28.C06.1.454.CMB.2.raw
  modified_base (244)..(244): a, c, t, g, unknown or other
  modified_base (285)..(285): a, c, t, g, unknown or other
  modified_base (386)..(386): a, c, t, g, unknown or other
  modified_base (390)..(390): a, c, t, g, unknown or other
  modified_base (392)..(393): a, c, t, g, unknown or other
tcagactgtacagtcacgaccggtgctcgatttagagctcacgtattgggtttggggcagaagtctctctcagtcaggacacagcatggacatgagggtccctgctcagctcctgggactcctgctgctctggctcccagctatcagatgtggcatccagatgaccaagtctccatcctcctgtctgcatctgttggagacagagtcaccatcacttgccgggcagtcagggcattggaaattnttggctggtatcagcagaaaccagggaaattccaactcctnaatctatgctgcactctactttcgtctaacgtttcgggttccggtctcgtacttcgtacgcggcgtagtgggtcgtgggacgagatctactctcacatcancacncnncacgctagagtatgtatactacttattatataataaattagtactacgtacgacgtacgtagtacgtacgaccgacggacgaacggtacgacgactaacgaacgtaacgtagtcg

SEQ ID NO: 413704 - DNA, 509 bp, Homo sapiens
  misc_feature: GZ8MTXP02JFC99.25.28.C06.1.454.CMB.2.raw
  modified_base (200)..(200): a, c, t, g, unknown or other
tcagactgtacagtcacgaccggtgctcgatttagagctcacgtattgggtttggggcagaagtctctctcagtcaggacacagcatggacatgagggtccctgctcagctcctgggactcctgctgctctggctcccagctatcagatgtggcatccagatgaccaagtctccatcctccctgtctgcatctgttgganacagagtcaccatcacttgccgggcgagtcagggcattggaaattattggcctggtatcagcagaaaccagggaaattcctaacctcctcatctatgctgcatccacttttcgctaagttttcggggtaccccttctcggatttccgagcggcagtgggtctggggacagaattcactctcaccatcagcagcctgcagcctgaagatgttagctaacttattactagtactaaaatttgaactagtcgaccgtggtatcgttccggcctagggaccaaggtcggacacgtacaaacgaacgtgtacgg

SEQ ID NO: 413705 - DNA, 555 bp, Homo sapiens
  misc_feature: GZ8MTXP02HUQNA.25.28.C06.1.454.CMB.2.raw
  modified_base (368)..(368): a, c, t, g, unknown or other
  modified_base (381)..(381): a, c, t, g, unknown or other
  modified_base (400)..(400): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggtttcctcgttgctcttttaagaggtgtccagtgtcaggcgcatctggtggagtcgtgggggagcgtggtccagcctgggaatccctgagactctcctgtgtggcgcctagactcaccttcagtagttatggctttcgtctggggtcccgccaggtgtccagggcaaggggctgggagtggctggggatttacttggctgacagaccaaatgacatancacgcggatccgnggacggggccatcacatcncgaggacatcaagacgaacctctatctagacaaatagaactaatagagagtacgaaggagtacggtacgtttattacgtgtcgacgtactacgaggtagtaggacgtaaggtaaaacgtcgtaagtctactacttccgtacgtaccgtcgtcggg

SEQ ID NO: 413706 - DNA, 561 bp, Homo sapiens
  misc_feature: GZ8MTXP02I8F0S.25.28.C06.1.454.CMB.2.raw
  modified_base (301)..(301): a, c, t, g, unknown or other
  modified_base (364)..(364): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggaggcgtggtccagcctgggaagtccctgagactctcctgtgtggcgcctagactcaccttcagtagttatggcttcgtctgggtccncagtgtccaggcaaggggctggagtggctggggattacttggtctgacagaccaaatgacatntcacgcgggatccggtggacggggccgattccaccatctccgaggacaatcccaaagacgaaccctctatctgacaaatagaaactaacttagagagtacgagagtacggtaccgtttatacgtgtgacgactcgaggagtggacgtaggaaaacgtcgtaagtctacgtacttcccgtacgtaccgtcgtacgggg

SEQ ID NO: 413707 - DNA, 555 bp, Homo sapiens
  misc_feature: GZ8MTXP02GV98L.25.28.C06.1.454.CMB.2.raw
  modified_base (552)..(552): a, c, t, g, unknown or other
tcagactgtacagtcacgaccggtgctcgatttagagctcacgtattgggtttgggctgagctgggttttcctcgttgctcttttaagaggtgtccagtgtcaggtgcagctggtgcagtctgggggaggcgtggtccaccctgggaggtccctgagactctcctgtgcagcctctggattcatcttcaacacctatgcaatgcactgggtccgccaggctccaggcaaggggctggagtgggtggcagttattcatatgatggaactaaataaaaagtatgttgactccgtggcgggccgattcaccgtctccagagacagatccaaagaagacggtgtatcctaccaaatcaaacaacctgagatccgaggacacggctgtgtattactgtgcgagagacgtcgggcggcgagggtccgtacccccgagggaaacgtaccgggcttaactattcccggacaatgggacaagtcgtgggggcgaaacggggaccaacgggtcatcggtctcctctcgcctccaccaaggcccatcggcttcccccgcgccnccg

SEQ ID NO: 413708 - DNA, 484 bp, Homo sapiens
  misc_feature: GZ8MTXP02F5FKG.25.28.C06.1.454.CMB.2.raw
  modified_base (290)..(290): a, c, t, g, unknown or other
  modified_base (328)..(328): a, c, t, g, unknown or other
  modified_base (398)..(398): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattattggcctggtatcagcagaaaccagggaaattcctaactcctnatctatgctgcatccactttgctaatttggggtccctntcgattcagcggcagtgggtctgggacagaattcactctcaccatcagcagcctgcagcctgagatgttnacattatactatacaaaatttgacaagtcgaccgtgatcgttcggaccagggaccaaggtcgactaactcgaaaacgaactgtagg

SEQ ID NO: 413709 - DNA, 555 bp, Homo sapiens
  misc_feature: GZ8MTXP02HF8GK.25.28.C06.1.454.CMB.2.raw
  modified_base (259)..(259): a, c, t, g, unknown or other
  modified_base (387)..(387): a, c, t, g, unknown or other
  modified_base (405)..(405): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcnctagactcaccttcagtagttatggctttcgtcgtcgggtcccgccagtgtccagggcgaaggggctgggagtggcgtggggtagttacttggtctgacagaccaaatgacatatcacgcggagtcgnggaggggccatcacatcncaggacaatccaagacgaaccctctatctagacaaatagaactaacttagagagtacgaggatacggtcgtttatacgtgtcgcgactcgaggagtaggacgtaggaaaagtcgtaagtctactacttcccgtccgtaccgtcgtcgggg

SEQ ID NO: 413710 - DNA, 551 bp, Homo sapiens
  misc_feature: GZ8MTXP02IS6LK.25.28.C06.1.454.CMB.2.raw
  modified_base (270)..(270): a, c, t, g, unknown or other
  modified_base (297)..(297): a, c, t, g, unknown or other
  modified_base (364)..(364): a, c, t, g, unknown or other
  modified_base (369)..(369): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggatccctgagactctctgtgtggcgcctagactcaccttnagtagttatggcttcgtcgtgggtccnccagtcgtccagggcaaggggctggagtggctggggatttactggtctgacagaccaaatgacatancacgnggatccgtggacggggccattcaccatctcaggacaatccgaagacgaacctctatctgacaaatcgaaactacttagagagtacgaggactacggtacgtttattactgtcgcgacctcgaggtagtcgacgtaaggaaaagttcgtaagtctactacgttcccgtcgtacctcgtcgggg

SEQ ID NO: 413711 - DNA, 565 bp, Homo sapiens
  misc_feature: GZ8MTXP02GREW8.25.28.C06.1.454.CMB.2.raw
tcagactgtacagtcacgaccggtgctcgatttagagctcacgtattgggtttgggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagtagttatggctttcgtctgggtcccgccagtgtccagggcaaggggctggagtggctggggatttacgttggtctgacagaccaaatgacatatcacgcggagtccggtggacggggccattccaccatctaccgagggacaattaccaagacgaaccctctatctgacaaatacgaaactaacttgagagtacgaggatacggtccgttattacgtgtgacgtacctcgaggtagtcggacgtaggaaaagtcgtaagtctactacgttcccgtacgacctcgtcgggg

SEQ ID NO: 413712 - DNA, 538 bp, Homo sapiens
  misc_feature: GZ8MTXP02JWUM5.25.28.C06.1.454.CMB.2.raw
  modified_base (202)..(202): a, c, t, g, unknown or other
  modified_base (340)..(340): a, c, t, g, unknown or other
  modified_base (419)..(419): a, c, t, g, unknown or other
  modified_base (428)..(428): a, c, t, g, unknown or other
  modified_base (532)..(532): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtcctccatccctcctgtctgcatctgttgganacagagtcaccatcacgttggccgggcgagtcaaggggcagttaggaaattagttggcctggtatcgagcaagaaaccaggggtaaacttccaacctcctcatctatgctgcatcctattgctagtttcggggccctntcgattcgagcgcagtgggtcagggacagtaacttcactctacacatcacgctacgccctgacacgtccgtagaaagtnttcggttanaaccttaaatttattacgtagtaaactaaaatttcgacgtacgtacgaccggtgtacgtcggtccgaccggaggaccgaaggtcgaacactaacgaacgtacgngtacgg

SEQ ID NO: 413713 - DNA, 576 bp, Homo sapiens
  misc_feature: GZ8MTXP02G76Z1.25.28.C06.1.454.CMB.2.raw
tcagactgtacagtcacgaccggtgctcgatttagagctcacgtattgggtttttgggggaagaggaagactgacggtcctcccaggagttcaggtgctgggcaccttgggcacgggggaggcgtggtccagcctgggaagtccctgagactctcctgtgtggcgcctagactcaccttcagtagttatggcttcgtctgggtccgccagtgtccaggcaaggggctggagtggctgggagttacttggtctgacagacaaatgacatatcacgcggagtccgtgaggggccgattcaccatctccagggacaattccaagagaaccctctatctgcaaatgaaacaacttgagagtccgaggatacggccgtttatactgtgcgactcgagagtggctagggaaaaagtcgtaagtctacattcccgtcgacctcgtacggggccaggggccacccgtggtccaccgtctcctcacgccttccacaacgggcccagtccggtccttccccctcggccgccctcgcctccgacggacgccaccgtcgtcgggggcacgacgccggccctcggggcc

SEQ ID NO: 413714 - DNA, 602 bp, Homo sapiens
  misc_feature: GZ8MTXP02HFWJA.25.28.C06.1.454.CMB.2.raw
  modified_base (398)..(398): a, c, t, g, unknown or other
tcagactgtacagtcacgaccggtgctcgatttagagctcacgtattgggtttttggggggaagaggaagactgacggtcctcccaggagttcaggtgcctgggcaccttgggcacggggaggcgtggtccagcctgggaagtccctgagactctcctgtgtggcgcctagactcaccttcagttagttatggctttacgtctgggtccgccagtgtccaggcaaggggctgggagtggcgtgggagttacttggtctgacagacaaatgacatatcacgcggagtccgtgaggggccgattcaccatctccaggacaattccaagagaacccctctatctgacaaatgaaacaacttgagagtccgagatacggtcgtttatactgtgcgactcagngtggctagggaaaacgtcgtaagtctacgacgttcccgtacgtacctcgtcggggccacgggcacccgtggtccacccgtctaccctctacgcttcccacaacgggcccagtccgttcctcccccgtcggcccgtcccgtcgccgtacccgacggaccgcctaacccgtcgtcgggggcaccggacgccggcccgtcggggccg

SEQ ID NO: 413715 - DNA, 535 bp, Homo sapiens
  misc_feature: GZ8MTXP02IXQ9J.25.28.C06.1.454.CMB.2.raw
  modified_base (273)..(273): a, c, t, g, unknown or other
  modified_base (421)..(421): a, c, t, g, unknown or other
tcagactgtacagtcacgaccggtgctcgatttagagctcacgtattgggtttgggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttnagtagttatggcttcgtctgggtccgccagtgtccaggcaaggggctggagtggcgtggggagttacttggtctggacagaccaaatgacatatcacgcggatccgtgaggggccatcacatctcaggacatcaagacgaacctctanctgacaaatgaactaacttgagagtcgaggatacggtaccgtttattactgtagcgactcaggagtggactaggaaaagtcgtaagtctctacttcccgtcgacctcgtcgggg

SEQ ID NO: 413716 - DNA, 543 bp, Homo sapiens
  misc_feature: GZ8MTXP02F9QRX.25.28.C06.1.454.CMB.2.raw
  modified_base (227)..(227): a, c, t, g, unknown or other
  modified_base (352)..(352): a, c, t, g, unknown or other
  modified_base (366)..(366): a, c, t, g, unknown or other
  modified_base (425)..(425): a, c, t, g, unknown or other
  modified_base (431)..(431): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttggccgggngagtcgagggcagttggaaatttgttggcctggtatcgagacaagaaaaccaggggtaaactttccctaacctcctacacttctatcgctgcattcctactttgacttagtttcggggtcccttntcgattcgagcggntaggtgggtctgggacagtaattcactctacacctatcagcagcctgcacgcctagatnttcgtnacctaattacttacgtattaacaaaatttgactacgtacgaccgtggacttcggtccgacccgtaagggaccgtaaagggtcgaactacgtaacgaaaacgtacgttggacg

SEQ ID NO: 413717 - DNA, 529 bp, Homo sapiens
  misc_feature: GZ8MTXP02JCUNF.25.28.C06.1.454.CMB.2.raw
  modified_base (367)..(367): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttaccggggcagtcagggcattggaaattatttggctggtatcagaagaaaccagggaaagtcctaacctcctcatctatgctgcatccactttgctaagtttcggggtccctctcgattcagcggcaggtgggtctggggacagattcnctctcacatcagcagcctgcagcctagaagattgtgactaacttattactagttactaaaaatttgaactagtacgtacccgtggaacttcggttcggacccgtacggggaacccgaagggtacgggaacacgtaacgaaacggactaggtacggactacgg

SEQ ID NO: 413718 - DNA, 494 bp, Homo sapiens
  misc_feature: GZ8MTXP02HBON7.25.28.C06.1.454.CMB.2.raw
  modified_base (324)..(324): a, c, t, g, unknown or other
  modified_base (388)..(388): a, c, t, g, unknown or other
  modified_base (395)..(395): a, c, t, g, unknown or other
tcagactgtacagtcacgaccggtgctcgatttagagctcacgtattgggtttggggcagaagtctctctcagtcaggacacagcatggacatgagggtccctgctcagctcctgggactcctgctgctctggctcccagctatcagatgtggcatccagatgacccagtctccatcctcctgtctgcatctgttggagacagagtcaccatcacttgccgggcgagtcagggcattggaaattattggcctggtatcagcagaaaccagggaaacttccaacctctcatctatgctgcatccactttgctatttggggccctntcgattcagcgcagtgggtctgggacagattcactctcacatccagcagcctgcagcctagaanatgttanactaacttattactagtactaaaagtttgaactagttagacccgtgattcgttcggaccgacgggaccaaggtacggacatacgaaacgaactagtcgg

SEQ ID NO: 413719 - DNA, 600 bp, Homo sapiens
  misc_feature: GZ8MTXP02HDSXC.25.28.C06.1.454.CMB.2.raw
  modified_base (262)..(262): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtgggtccagcctggggaacgtccctgagactctcctgtgtggcncctagactcaccttcagtagttatggctttcgtctcggggtcccgccagtgtcccgagggccgaagggggctgggagtgggctggggagtttacttgggctgacagaccaaatgacatatcacggcgggagtccggtggagggggcccattccacccatctccgagggacaattcccaaagacgaaccctctaatctacgacaaatagaaactaacgttagagtagtacggaggacgtacggtacctttattacgtagtcgacgacctcgaggagtcggacgtaaggaaaacgtcgtaacggtctacgtacgttcccggtcgtaccgtcggtccgggg

SEQ ID NO: 413720 - DNA, 513 bp, Homo sapiens
  misc_feature: GZ8MTXP02FZTN3.25.28.C06.1.454.CMB.2.raw
  modified_base (246)..(246): a, c, t, g, unknown or other
  modified_base (287)..(287): a, c, t, g, unknown or other
  modified_base (331)..(331): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcagtcagggcattggaaattnttggctggtatcagcagaaaccagggaaattcctaacctcncatctatgctgcatccgtatttcgactaagtttcggggcccttntccgattcgagcggcagtgggtctggggacagattcactctcacatcagcagctgcagcctagagatgtgactaacttattactagtactaaaatttgaacagtacgaccgtggtaagttcgttcggacccgagggaacccgaagggtacggaacacgtaacgaaaacgtaacgtagtacgg

SEQ ID NO: 413721 - DNA, 555 bp, Homo sapiens
  misc_feature: GZ8MTXP02FQSKI.25.28.C06.1.454.CMB.2.raw
  modified_base (368)..(368): a, c, t, g, unknown or other
tcagactgtacagtcacgaccggtgctcgatttagagctcacgtattgggtttgggctgagctgggttttcctcgttgctcttttaagaggtgtccagtgtcaggtgcagctggtgcagtctgggggaggcgtggtccaccctgggaggtccctgagactctcctgtgcagcctctggattcatcttcaacacctatgcaatgcactgggtccgccaggctccaggcaagggggctgggagtgggtggcagttattcatatgatggaaactaaataaaagtatgttgactccgtggcggccgattcaccgtctccagagacagatccaaagaagacggtgtatcctaccaaatcaaacaacctgaagntccgaggacacggctgtgtattactgtgcgagagacgtcgggcggcacgggtccgtacccccgaggaacgtacggctacgtacttccgacagtggacatcgtggggacgaagggaccacgggtcagtccgtctcctctcgcctccgaaccgaacggcccacgtccggtcctccccgtcgccgtcccg

SEQ ID NO: 413722 - DNA, 582 bp, Homo sapiens
  misc_feature: GZ8MTXP02JM9FA.25.28.C06.1.454.CMB.2.raw
  modified_base (301)..(301): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagtagttatggcttcgtctgggtcccncagtgtccagggcaaggggctgggagtgggctggggagtttacgttgggtctggaacagaaccaaatgaacatactcgacgcgggagtccggtggacgggggccattccacatctaccgaggacaattaccaagacgaaccctctatctagacaaatagaacaacttgagagtacgaggagtacggtcgtttattacgtgtcgcgacctcgacggaggtacggacgtaaggaaaacgtcgtaagttctacgtacgttcccgtacgaccgtcggtaccgggg

SEQ ID NO: 413723 - DNA, 487 bp, Homo sapiens
  misc_feature: GZ8MTXP02IBF3A.25.28.C06.1.454.CMB.2.raw
  modified_base (327)..(327): a, c, t, g, unknown or other
  modified_base (410)..(410): a, c, t, g, unknown or other
tcagactgtacagtcacgaccggtgctcgatttagagctcacgtattgggtttggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcaggggcattggaaattattggcctggtatcagcagaaaccagggaaattccaacctctcatctatgctgcatccactttgctaatttggggtccctntcgattcagcggcagtgggtctgggacagaatcactctcacatcagcagcctgcagcctagagatgttgctaacttattactntacaaaatttgaactagtgaccgtggatcgttcgacccgtagggaccaaggtcggacactacaaacgaactgtacgg

SEQ ID NO: 413724 - DNA, 550 bp, Homo sapiens
  misc_feature: GZ8MTXP02HIL96.25.28.C06.1.454.CMB.2.raw
  modified_base (301)..(301): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaatccctgagactctcctgtgtggcgcctagactcaccttcagtagttatggctttcgtctcgggtccnccagtgtcccagggcaaggggctggagtggctggggagttacttggtctggacagacaaatgacatatcacgcggagtccgtgacgggggcctatcaccatctccgagggacaattccaagacgaaccctctactctgacaaatagaactaacttgagagtacgagagtacgtcgttatactgtgcgactcgaggagtgacgtaggaaaagtcgtaagtctactacttcccgtacgtacctcgtcgggg

SEQ ID NO: 413725 - DNA, 507 bp, Homo sapiens
  misc_feature: GZ8MTXP02JZ8ZK.25.28.C06.1.454.CMB.2.raw
  modified_base (334)..(334): a, c, t, g, unknown or other
  modified_base (401)..(401): a, c, t, g, unknown or other
  modified_base (408)..(408): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattattggcctggtatcagcagaaaccagggaaagttcctaacctcctcatctatgctgcatcctatttcgactaagtttcggggtccctntcgattcgagcggcagtgggtctgggacagtattcactctcaccatcagcagcctgcagccagaagntggttanactaactttattactagtaactaaaatttgaactagtacgaccgtggtatcggttcgaccgagggaccgaaggtcgaacactacgaaacgacgtgtcgg

SEQ ID NO: 413726 - DNA, 566 bp, Homo sapiens
  misc_feature: GZ8MTXP02GKN82.25.28.C06.1.454.CMB.2.raw
  modified_base (369)..(369): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcagcatggagtttgggctgaactgggttttcctcgttgctcttttaagaggtgtccagtgtcaggcgcatctggtggagtcgtgggggagcgtggtccagcctgggaagtccctgagactctcctgtgtggcgcctagactcaccttcagtagttatggcttcgtctgggtccgccagtgtccaggcaaggggctgggagtgggctggggagtttacgttgggtctgacagacaaatgacatancacggcggagtccgtgacgggggccattcaccatctcgaggacaattaccaagacgaaccctctactctagacaaatcgaaactaacgttagagagtacggaaggtacgtaacggtaccgtttaattacgtgtcgacgacctcgaggacgtcggacgtaggaaaagtcgtacgtctctacgttcccgtcgacctcgg

SEQ ID NO: 413727 - DNA, 490 bp, Homo sapiens
  misc_feature: GZ8MTXP02GKCN3.25.28.C06.1.454.CMB.2.raw
  modified_base (226)..(226): a, c, t, g, unknown or other
  modified_base (247)..(247): a, c, t, g, unknown or other
  modified_base (324)..(324): a, c, t, g, unknown or other
tcagactgtacagtcacgaccggtgctcgatttagagctcacgtattgggtttggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttggccgggngagtcagggcattggaaattnttggctggtatcagcagaaacagggaaattccaactctcatctatgctgcatccactttgctaagtttggggccctntcgattcagcgcagtgggtctgggacagaattcactctacacatcgaagcagcctcgcacgctgagatgtgacacttattactatataaaattagtacagtagaccgtacgtagtacgttcgaccgacggaccgaacgtaggacgacacaaacgaactacgtacgg

SEQ ID NO: 413728 - DNA, 565 bp, Homo sapiens
  misc_feature: GZ8MTXP02H7M1A.25.28.C06.1.454.CMB.2.raw
  modified_base (283)..(283): a, c, t, g, unknown or other
  modified_base (302)..(302): a, c, t, g, unknown or other
  modified_base (404)..(404): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtggggggagcgtggtccagcctgggaagtccctgagactctcctgtgtggcgcctagactcaccttcagtagttanggtcttcgtctggggtccnccagtgtcccgagggcaaggggctgggagtggctgggatttacgtggtctgacagaccaaatgacatatcacgcggagtccgtgagggggccatcaccatcncgaggacaatccaagacgaaccctctaatctagaccaaatagaaactaacttagagagtacgaaggagtacggtacgttttatacgtgtcgacgactcgaggaggtgacgtaggaaaagttcgtaagtctacgtacttcccgtacgtaccgttcgacgggg

SEQ ID NO: 413729 - DNA, 498 bp, Homo sapiens
  misc_feature: GZ8MTXP02FNJ0Q.25.28.C06.1.454.CMB.2.raw
  modified_base (247)..(247): a, c, t, g, unknown or other
  modified_base (330)..(330): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattnttggcctggtatcagcagaaaccagggaaattcctaactcctcatctatgctgcatccatttgctaagtttcggggtcccctntcgattcagcggcaggtgggtctggggacagattcactctcaccatcagcagcctgcagcctagaagtatgttgactaacttattactagtactaaaagtttgaacagtcgaccgtggactcggtcgccgagggaccgaaggtcggacacgtacaaacgactaggtcg

SEQ ID NO: 413730 - DNA, 666 bp, Homo sapiens
  misc_feature: GZ8MTXP02F64J7.25.28.C06.1.454.CMB.2.raw
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagtagttatggcttcgtctgggtccgccagtgtccagggcaaggggctggagtggctggggagttacttggtctgacagaaccaaatgacatatccacgcggagtccggtggacgggggcctattccgaaccagtcctacccgaagggaactaaacgttacccgaaagaaccgtaaaccctactactacctagacaaatagaaactaaacgttagaagaagtaccggaaggaacgttaaccgggtaccgttttaacttaaccgtgttacggaccggtaccgttaccggaacgggtaggtacgggtaccgttaaaggggtaaaaaacggttcggtaacggttaccttaccgtaaccgtttccccggtaccggtaacccgttcggtaccggggg

SEQ ID NO: 413731 - DNA, 499 bp, Homo sapiens
  misc_feature: GZ8MTXP02F4K60.25.28.C06.1.454.CMB.2.raw
  modified_base (202)..(202): a, c, t, g, unknown or other
  modified_base (337)..(337): a, c, t, g, unknown or other
  modified_base (410)..(410): a, c, t, g, unknown or other
  modified_base (498)..(498): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggcctcccagctatcagatgtggcatccagatgaccaagtctccatcctccctgtctgcatctgttgganacagagtcaccatcacttgccgggcgagtcagggcattggaaatttattgggcctggtatcagcagaaaccaggggaaactttcctaacctcctcatctatgcctgcatccatttgactagtttcggggcccttntccgattccgagcggcaggtgggtctggggacagaatcactctcaccatcagcagcctgcagctagagatgtnactattatactagtacaaaatttgaactagtcgaccgtgtatcgttcgaccacggggaccaaggtcgaacacgtacaaaccgactggng

SEQ ID NO: 413732 - DNA, 543 bp, Homo sapiens
  misc_feature: GZ8MTXP02I92H0.25.28.C06.1.454.CMB.2.raw
  modified_base (253)..(253): a, c, t, g, unknown or other
  modified_base (297)..(297): a, c, t, g, unknown or other
  modified_base (337)..(337): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtcctccatccctccctgtctgcatctgttggagacagagtcaccatcacttggccgggcgagtcgagggcagttggaaatttnttggcctggtatcagcaagaaaccagggaaacttccaactcctnatctatgctgcatcctatttcgactagtttcggggccctntcgtattcgagcggcgtagtgggtctagggacagattcactctcacatcagcacgcctgacacgacctagaagtattgtagactaacttatactagtaactaaaagttcgaacgtacgtcgtaccggtggagttacggttaccgggacccgtaacgggaccgtaaagggtcgaacgtaacgtaacgaaaacggtaccgtagtacgg

SEQ ID NO: 413733 - DNA, 560 bp, Homo sapiens
  misc_feature: GZ8MTXP02G4JMC.25.28.C06.1.454.CMB.2.raw
  modified_base (299)..(299): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagactctcctgtgtggcgcctagactcaccttcagtagttatggcttcgtcgtgggtccnccagtcgtccagggcaaggggctgggagtggctggggagtttactggtctgacagaccaaatgacatatcacgcggagtccgtggaggggccattccaccactctaccgagggaacaacttcccaaagacgaaccctactaactctgacaaatagaaacaacttagagagtacgaggatacggtcgttattactgtgccgactcgagagtgcgtaaggaaaagtcgtaagtctactacttcccgtacgaccgtcgtccggg

SEQ ID NO: 413734 - DNA, 558 bp, Homo sapiens
  misc_feature: GZ8MTXP02I5SUJ.25.28.C06.1.454.CMB.2.raw
  modified_base (301)..(301): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaacgtccctgagactctcctgtgtggcgcctagactcaccttcagtagttatggcttcgtctgggtccnccagtgtccaggcaaggggctggagtggctgggagttactggtctgacagaccaaatgacatatcgacgcggagtccggtggacgggggccattcgaccatcctccgagggacaacttccaagacgaaccctctatctgacaaatgaacaacttgagagtacgagatacggtactttatatgtgcgacgtcgaggtacgtggtacgtaggaaaacgtcgtaagtcctactacttacccgtccgtaccgtcgtcgggg

SEQ ID NO: 413735 - DNA, 605 bp, Homo sapiens
  misc_feature: GZ8MTXP02GBI5Q.25.28.C06.1.454.CMB.2.raw
  modified_base (299)..(299): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggagcgtggtccagccgtgggaatccctgagctctctgtgtggcgcctagactcaccttcagtagttatggcttcgtctgggtccnccagtcgtccagggcgaaggggctgggagtggcgtggggattacgttggtctgacagaccaaatgacatatcgacgcggacgtccgtggacgggggccattccgacctatccgtaccgagggaacaacttaccgaaagaccgtaaccctactactctacgaacaaagtacaaactaactagacgtagtacgaggacgtacggtaccgttatacgtgtcgacgaccgtacgaggtaggtaggtacgtaaggtaaaacgttcgtaagttcctacgtacgttcccgtaccgtaccgttcggtccggggg

SEQ ID NO: 413736 - DNA, 574 bp, Homo sapiens
  misc_feature: GZ8MTXP02G0QY0.25.28.C06.1.454.CMB.2.raw
  modified_base (274)..(274): a, c, t, g, unknown or other
  modified_base (301)..(301): a, c, t, g, unknown or other
  modified_base (371)..(371): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttnagtagttatggctttcgtctgggtccnccagtgtccagggcaaggggctgggagtggctggggatttacgttggtctgacagaaccaaatgacatancacgcggagtccgtggacgggccattccaccatctaccgaggacaatccaaagacgaaccctctatctacgacaaatacgaaacaacttagagagtacgaggacgtacggtcgtttatacgtgtcgtacgacctcgaggagtacggtacgtaacggaaaagttcgtaagtctacgtacgttcccgtacgtaccgtcgtcgggg

SEQ ID NO: 413737 - DNA, 591 bp, Homo sapiens
  misc_feature: GZ8MTXP02JRPJ1.25.28.C06.1.454.CMB.2.raw
  modified_base (201)..(201): a, c, t, g, unknown or other
  modified_base (226)..(226): a, c, t, g, unknown or other
  modified_base (302)..(302): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggcctcccagctatcagatgtggcatccagatgacccagtctccatcctccctgtctgcatctgtgganacagatcacatcacgttggccgggngagtcgagggctagttaggaaatttgttggcctggtatcagacaagaaaccgagggtaaacttcctaacctcctanatctatgctgactactcctactttcgacgttacgtttcggggtcccttgtcgtattcgaggcggacgtagggtcgggtacgtagggaacaagtaactcactctaccacatcacgcacgcctgacacgtaccgtagaagtagtcggttacaacttaaacgtttaacttaccgttaattaaaccttaaaagtttcgaacgttacggtacgtaccggtaggtacgttaccggttaccgggaacccgtaagggaacgtaacggtacgaacacgtaacgaaacgtacgtgtacg

SEQ ID NO: 413738 - DNA, 526 bp, Homo sapiens
  misc_feature: GZ8MTXP02ITZFQ.25.28.C06.1.454.CMB.2.raw
  modified_base (336)..(336): a, c, t, g, unknown or other
  modified_base (406)..(406): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcagtcagggcagttggaaattattggcctggtatcagcaagaaaccaggggtaaacttcctaacctcctcatctatgctgcatcctactttgctaagtttcggggtccctntccgattcgagcgcgagtgggtctgggacagattcactctcacatcagcagcctgacagcctagaacgtntgtacacttattattactataactaaagttcgaactacggtcgtaccgtaggtacgtcggtaccggaccgaaggtaccgtaaggtacgaaactacgtaaccgtaaacgtacgtcggtacg

SEQ ID NO: 413739 - DNA, 568 bp, Homo sapiens
  misc_feature: GZ8MTXP02ISYII.25.28.C06.1.454.CMB.2.raw
  modified_base (274)..(274): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttnagtagttatggcttcgtctgggtcccgccagtgtccaggcaagggggctggagtggctggggagtttacttggctgacagaaccaaatgacatatcacgcggagtccggtgacggggccatccacactctcagggacaattaccaagacgaaccctactaactctagacaaatagaaactaacttagagagtacgaggagtacgtacgtttattactgtcgcgacctacgaggagtaggacgtaggaaaagtacgtaagtcgtactacgttcccgtacgtaccgtcgtccgggg

SEQ ID NO: 413740 - DNA, 568 bp, Homo sapiens
  misc_feature: GZ8MTXP02GPQA8.25.28.C06.1.454.CMB.2.raw
  modified_base (449)..(449): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaatccctgagactctctgtgtggcgcctagactcaccttcagtagttatggctttcgtcgtgggtcccgccagtgtccaggcgaaggggctggagtggctggggatttacgttggctgacagacaaatgacatatcacgcggatccggtaggacgggggccattcaccatctaccgaggacaattaccaagacgaaccctctactctagacaaatanaacgtaattagagagtacgaaggagtacggtaccgtttaattacgtgtcgacggacctacgaggtagtggacgtaaggaaaagtcgtaagtctactacttccgtacgtacctcgtcggg

SEQ ID NO: 413741 - DNA, 551 bp, Homo sapiens
  misc_feature: GZ8MTXP02HL0GO.25.28.C06.1.454.CMB.2.raw
  modified_base (206)..(206): a, c, t, g, unknown or other
  modified_base (328)..(328): a, c, t, g, unknown or other
  modified_base (377)..(377): a, c, t, g, unknown or other
  modified_base (449)..(449): a, c, t, g, unknown or other
  modified_base (466)..(466): a, c, t, g, unknown or other
  modified_base (497)..(497): a, c, t, g, unknown or other
  modified_base (502)..(502): a, c, t, g, unknown or other
tcagactgtacagtcacgaccggtgctcgatttagagctcacgtattgggtttttgggggaagaggaagactgacggtcctcccaggagttcaggtgctgggcaccttgggcacgggggaggcgtggtccagcctgggaagtccctgagactctcctgtgtggcgcctagactcaccttcagtagttatggcttcgtctgggtccnccagtgtccaggcaaggggctggagtggctgggagttacttggtctgacagacaaatgacatatcacgcggagtccgtgagggccgattcacatctccaggacaatccaaagagaacccctntatctgacaaaatgaaacaacttgagatccgagatacggcgtttatacngtgcgactcagagtggctaggaaaaagtcgaagtctcattcccgtacgacctcgtgggcccagggcacccgnggtcaccgtctctcgancttccaccaaggcccatccgtcttcccccgnggccnccctgcctccacgacgcacctcgtcgggcgacacgccggccgtcggccg

SEQ ID NO: 413742 - DNA, 688 bp, Homo sapiens
  misc_feature: GZ8MTXP02HF1UT.25.28.C06.1.454.CMB.2.raw
  modified_base (302)..(302): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaacgtccctgagactctcctgtgtggcgctagactcaccttcagtagtatggcttcgtcgtgggtcccncagtcgtccaggcgaaggggctgggagtggcgtggggtatttacgtggtctaggacagaacccaaaatgaacatatccgacggcgggagtccggtaggaccgggggccctattccacctatcctaccgaagggaactaacttacccgaagaaccgaaccctctaactactagaacctaaaatacgaaaactaacgttaggaacggaagtacggaaggtaacgttaaccgggttaccgttttaacgttaacgttgtacggtacccgtaaccgttacgaaacgggtaggtacggtaaccggtaaaggggtaaaaacggttaccggttaacgttaccgttaccgttaccgtttacccccggtaccgtaaccccgttacggtcccggggg

SEQ ID NO: 413743 - DNA, 549 bp, Homo sapiens
  misc_feature: GZ8MTXP02HN2OD.25.28.C06.1.454.CMB.2.raw
  modified_base (202)..(202): a, c, t, g, unknown or other
  modified_base (228)..(228): a, c, t, g, unknown or other
  modified_base (249)..(249): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgaccaagtctccatcctccctgtctgcattctgttgganacagagtcaccatcacttggccgggnagtcagggcagttggaaattnttggcctggtatcagcaagaaaccagggaacttcctaactcctcatctatgctgcactcctactttcgacttaagtttcgggtcccttctccgtattccgagcggtctagggttggggtctggggacagtaattctactctacaccatcacgacacgcctgacacgtcctagtaagtagttgtagtactaaactttattaacgtagtaactaaaagttgaactacggtacgaccgtgtacgttcggttaccggaccgacggaccgaaggtcgaacgactaacgaaacgtacgtcgtacgg

SEQ ID NO: 413744 - DNA, 551 bp, Homo sapiens
  misc_feature: GZ8MTXP02JGGJO.25.28.C06.1.454.CMB.2.raw
  modified_base (300)..(300): a, c, t, g, unknown or other
  modified_base (398)..(398): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagtagttatggcttcgtctgggtccnccagtgtccaggcaaggggctggagtggctggggagttacttgggtctgacagaccaaatgacatatcacgcggagtccgtgagggggccattcacanctccgaggacattccaagacgaaccctctatctagacaaatgaacaacttgagagtcgaggagtacggcgtttattactagtcgacgacctcgaggagtcggacgtaggaaaagtcgtaagtctactacgttcccgtcgaccgtcgtccgggg

SEQ ID NO: 413745 - DNA, 568 bp, Homo sapiens
  misc_feature: GZ8MTXP02GWRPT.25.28.C06.1.454.CMB.2.raw
  modified_base (301)..(301): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgctagactcaccttcagtagttatggctttcgtctgggtccnccagttgtccaggcgaaggggctgggagtggcgtggggtagttacttgggtctgacagaccaaatgacatatcacggcggatccggtggacgggggccatcaccatctaccgaggacaacttccaagacgaaccctctatctagacaaatagaaactaacttgagagtacgagtagtacggtcttatacgtgtcgcgactcgacggagtacggacgtaaggaaaagtcgtaagtctactacttcccgtacgtaccgtcgtaccgggg

SEQ ID NO: 413746 - DNA, 557 bp, Homo sapiens
  misc_feature: GZ8MTXP02HAP1K.25.28.C06.1.454.CMB.2.raw
  modified_base (355)..(355): a, c, t, g, unknown or other
tcagactgtacagtcacgaccggtgctcgatttagagctcacgtattgggtttgggctgagctgggttttcctcgttgctcttttaagaggtgtccagtgtcaggtgcagctggtgcagtctgggggaggcgtggtccaccctgggaggtccctgagactctcctgtgcagcctctggattcatcttcaacacctatgcaatgcactgggtccgccaggctccaggcaaggggctggagtgggtgcagttattcatatgatggaaactaataaaagtatgtgactcgtggcggccattcacgtctccagagacagatccaaagaagacgtgtatcctaccaaatcaacaactganatccgagacacgctgtgtatactgtgcgagagacgtcggggcgcgagggtccgaccccgaggaacgtcggactactacgttccactagtacggacagttcgagggggacgaaacggggaccacgggtcacgtcgtccttcctacgtcgccctaccaaccgaacggcccctaacgtccggtcctcccccgtcggccgtccccg

SEQ ID NO: 413747 - DNA, 641 bp, Homo sapiens
  misc_feature: GZ8MTXP02HL4TK.25.28.C06.1.454.CMB.2.raw
  modified_base (338)..(338): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtcctccatcctcctgtcctgcatcgtgtggagacagatcacctatctacgttcggccggggcgaaggtcgaggggtcaagtttaggaaaatttgtttcggcctggtaatcgagacaaaggaaaccgaaggggtaaacctttcccaaacctcctacaattctaagtcnctcgactacttcctaatttccgacgttaacggttttcggggacccttgtaccgtattccggagtcggtctagggttggggtcagggtacaagttacttcacttcacaccatcgagcagccacgcacgtaccgtagtaagtaattggttacgtacgttaaccttaatttaacgttaacgttaaacttaaaacttaagtaacgtaacgttacggtaccggttacggtacgttaccggttaccggtaccggtaacgggaaccgtaacggtacggaacgtaacgaacgtaaacgaacgtacgtacgg

SEQ ID NO: 413748 - DNA, 542 bp, Homo sapiens
  misc_feature: GZ8MTXP02IVY24.25.28.C06.1.454.CMB.2.raw
  modified_base (205)..(205): a, c, t, g, unknown or other
  modified_base (371)..(371): a, c, t, g, unknown or other
  modified_base (420)..(420): a, c, t, g, unknown or other
  modified_base (440)..(440): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggcctcccagctatcagatgtggcatccagatgacccagtcctccatccctccctgtctgcattctgttgganacagagtcaccatcacgttggcccgggcgagtcgaaggggcaagttaggaaaatttgttggccttggtatcgagacaaggaaaacccgtaggggtaaactttccctaaaccctcctataatctatcgactgacctactcctactttcgactagtttcggggccctntcgattcgagcgctagtcgggctagggacagtattcactctcacatcancacgctgcagcctagaagtntgtacactaacttattactactaactaaaattcgacgtacgtcgtaccgtgtacgtcgtccgacgtaggactaaggacgactacgtacgaaacgtcgtgacg

SEQ ID NO: 413749 - DNA, 569 bp, Homo sapiens
  misc_feature: GZ8MTXP02HS4NO.25.28.C06.1.454.CMB.2.raw
  modified_base (206)..(206): a, c, t, g, unknown or other
  modified_base (328)..(328): a, c, t, g, unknown or other
  modified_base (377)..(377): a, c, t, g, unknown or other
tcagactgtacagtcacgaccggtgctcgatttagagctcacgtattgggtttttgggggaagaggaagactgacggtcctcccaggagttcaggtgctgggcaccttgggcacgggggaggcgtggtccagcctgggaagtccctgagactctcctgtgtggcgcctagactcaccttcagtagttatggcttcgtctgggtccnccagtgtccaggcaaggggctggagtggctgggattacttggtctgacagacaaatgacatatcacgcggagtccgtgagggccgattcaccatctccagggacaattccaagagaaccctntatctgacaaatgaaacaacttgagagtccgaggatacggctttatacngtgcgactcaggatggactaggaaaaagtcgtaagtctacattcccgtcgacctcgtcggggccaggggccaccctggtccaccgtctcctcacgcttccaaccgaacgggcccagtccggtcctcccccgtcggcccgccctcgcctccgacggacgccacctcgtcgggggcacgagccggccgtgggcc

SEQ ID NO: 413750 - DNA, 545 bp, Homo sapiens
  misc_feature: GZ8MTXP02F67RQ.25.28.C06.1.454.CMB.2.raw
  modified_base (299)..(299): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtctgggggaggcgtggtccagcctgggaagtccctgagactctcctgtgtggcgcctagactcaccttcagtagttatggcttcgtctgggtccnccagtgtccaggcaaggggctggagtggctgggattacttggtctgacagaccaaatgacatatcacgcggagtccgtggacggggccattcaccatctaccgaggacaatccaagacgaacctctatctgacaaatagaactaactgaagagtacgaggatacggtcgtttatactgtcgcgactcacggagtggacgtaggaaaagtcgtaagtctacacgttcccgtacgaccgtcgtcgggg

SEQ ID NO: 413751 - DNA, 543 bp, Homo sapiens
  misc_feature: GZ8MTXP02HB8LJ.25.28.C06.1.454.CMB.2.raw
  modified_base (298)..(298): a, c, t, g, unknown or other
  modified_base (361)..(361): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtctgggggagcgtggtccagcctgggaagtccctgagactctcctgtgtggcgcctagactcaccttcagtagttatggcttcgtctgggtccncagtgtccaggcaggggctggagtggctggggattacgtggtctgacagaccaaatgacatancacgcggatcgtggaggggccatcaccatctccaggacaatcaagacgaacctctatctgacaaatagaacaattgagagtacgagatacggtacttattacgtgtcgacgacctgaggtagtggacgtaggaaaacgttcgtaagtctctacgttcccgtcgtaacccgttcgtccggggg

SEQ ID NO: 413752 - DNA, 596 bp, Homo sapiens
  misc_feature: GZ8MTXP02F2V4X.25.28.C06.1.454.CMB.2.raw
  modified_base (294)..(294): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtctgggggagcgtggtccagcctgggaatccctgagactctcctgtgtggcgcctagactcacttcagtagtatggcttcgtctggtccncagtgtccaggcaaggggctggagtggctgggagttacttggctgacagacaaatgacatatcacgcggatccgtggacggggccattcaaccagtctacccgagggaacaagttaccaaagacgtaaaccctctactacctagacaaaagtaacaaactaacgttagaagtacgtacgaggtaacgtacggtacgtttattacgtgtacgaccgtaccgtacgacggtacggtacggtacgtaaacggtaaaacgttacgtaacgtactacgtaccgttcccgtacgtaccgtcggtcggg

SEQ ID NO: 413753 - DNA, 586 bp, Homo sapiens
  misc_feature: GZ8MTXP02HYYUC.25.28.C06.1.454.CMB.2.raw
  modified_base (300)..(300): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaagtccctgagactctcctgtgtggcgcctagactcaccttcagtagttatggctttcgtctgggtccnccagtcgtccagggcaaggggctgggagtggcgtggggtatttacgttgggctagacagaccaaatgacattatcacggcgggtagtccggtagggacgggggtccattccaaccatcgtccgaaggacaacttaccgaagacgaaccctctactctagactaaatagaactaacttagaagagtacgagacgtacggtcgtttatacgtgtgcgactacgaggtagtaggacgtaggaaaacgtcgtaagtctacgtacgttcccgtacgtaccgttcgtcgggg

SEQ ID NO: 413754 - DNA, 564 bp, Homo sapiens
  misc_feature: GZ8MTXP02G4WDR.25.28.C06.1.454.CMB.2.raw
  modified_base (302)..(302): a, c, t, g, unknown or other
  modified_base (402)..(402): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaatccctgagactctcctgtgtggcgcctagactcaccttcagtagttatggctttcgtctgggtcccnccagtctccgagggcgaaggggctggagtggctgggattctggctgacagaaccaaatgaacatatcacggcggagtccgaggacggggccatcacatcncgaggacaatccaaagacgaaccctctatctagacaaatcgaaactatagagagtcgaaggactacggtaccgtttatacgtgtacgcgacctgaggagtcggacgtaaggtaaaacgtcgtaagtctacgtacttccccgtacgtacccgttcgtccgggg

SEQ ID NO: 413755 - DNA, 607 bp, Homo sapiens
  misc_feature: GZ8MTXP02H1QDB.25.28.C06.1.454.CMB.2.raw
  modified_base (388)..(388): a, c, t, g, unknown or other
tcagactgtacagtcacgaccggtgctcgatttagagctcacgtattgggtttttgggggaagaggaagactgacggtcctcccaggagttcaggtgctgggcaccttgggcacgggggaggcgtggtccagcctgggaagtccctgagactctcctgtgtggcgcctagactcaccttcagtagttatggcttcgtctgggtccgccagtgtccaggcaaggggctgggagtggctgggagttacttggtctgacagacaaatgacatatcacgcggagtccgtgaggggccgattcaccatctccagggacaattccaagagaaacccctctatctgacaaaatgaaacaaacttgaagagtccgaggatacggcgtttatactgngcgactcgagagtggactaggaaaagtcgtagtctcacttcccgtcgacctcgtacggggcccagggccacccgtggtccaccggttctccgtcacgtcttaccaccgaaacgggccctaacgtccggtcccttcccccgtcggcccggccccttcgacccttccgacggacggccaccgttccgtcgggggacaccgacggccggcccgtcgggcccg

SEQ ID NO: 413756 - DNA, 553 bp, Homo sapiens
  misc_feature: GZ8MTXP02HNGTI.25.28.C06.1.454.CMB.2.raw
  modified_base (301)..(301): a, c, t, g, unknown or other
  modified_base (371)..(371): a, c, t, g, unknown or other
  modified_base (383)..(383): a, c, t, g, unknown or other
  modified_base (429)..(429): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagttagttatggcttcgtctgggtccnccagtgtccagggcaaggggctgggagtgggctggggtattacgttggtctgacagaccaaatgacatancagcggatccgngaggggccatcaccatctccgaggacaattccaaagacgaaccctntactctagacaaatagaaactaacttagagagtcgaggatacggtcgtttatactgtgcgactcaggagtggacgtacggaaaagtcgtaagtctacgtacttcccgcgtacctcggtacgggg

SEQ ID NO: 413757 - DNA, 588 bp, Homo sapiens
  misc_feature: GZ8MTXP02HTR95.25.28.C06.1.454.CMB.2.raw
  modified_base (195)..(195): a, c, t, g, unknown or other
  modified_base (205)..(205): a, c, t, g, unknown or other
  modified_base (300)..(300): a, c, t, g, unknown or other
  modified_base (349)..(349): a, c, t, g, unknown or other
  modified_base (429)..(429): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctgctccagctatcagatgtggcatccagatgaccaagtctcatcctcctgtctgcatctgtganacagatcacntcacttggccgggcgagtcgaggggtcagttaggtaaatttgttggcctggtatcgagacaagaaaccgaggggtaaactttcctaacctcctanatctatgctgctacgtctactttcgacttaggtttccggggtacccttntacggattccgaggcggtacgtaggggttcgggtctaggggacagtacttcctacttcacactatccgaggcacgtaccncgtacacgtacgtaagtaagtcgttaggtactaacgttaatttacttaacgtaacttaaaacttaagtcgaacgtacgtacggtacggtgtaccggttacggaccggaaccgaagggaacgtaaggtacgaactaacgtaacgaacggtcgtcggtacg

SEQ ID NO: 413758 - DNA, 586 bp, Homo sapiens
  misc_feature: GZ8MTXP02INGA0.25.28.C06.1.454.CMB.2.raw
  modified_base (212)..(212): a, c, t, g, unknown or other
  modified_base (361)..(361): a, c, t, g, unknown or other
  modified_base (379)..(379): a, c, t, g, unknown or other
tcagactgtacagtcacgaccggtgctcgatttagagctcacgtattgggtttgggctgagctgggtttcctcgttgctcttttaagaggtgtccagtgtcaggtgcagctggtgcagtctgggggagcgtggtccaccctgggaggtccctgagactctcctgtgcagcctctggattcatcttcaacacctatgcaatgcactgggtccnccaggctccaggcaaggggctggagtgggtggcagttatttcatatgatggaactaaataaaagtatgttgactccgtggcggcattcacgtctccagagacagatccaaagaagacgtagtactcctaccaaatcaaacaacctgaantccgaggacacggctgtntattactgtgcgagagacgtcggggcggcagggtccgtacccccgagggaaacgtaccgggactaacgtacgttcccgactaaacgtcgggaactagtcggtagggggacgaaacggggaccacgggttacacgttccgtcctccgtctcgccctccaaccgaaacgggccccacgttccggtccctttccccgcggcccgtccccg

SEQ ID NO: 413759 - DNA, 654 bp, Homo sapiens
  misc_feature: GZ8MTXP02G9DKB.25.28.C06.1.454.CMB.2.raw
  modified_base (299)..(299): a, c, t, g, unknown or other
  modified_base (417)..(417): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtcctgagctctctgtgtggcgcctagactcaccttcagtagttatggcttcgtcgtgggtcccncagtgtccagggcgaaggggctgggagtgggcgttggggtatttacgttgggtctggaacagaaccaaatgaacatatcgacggcggagtccggtaggacggggcctatccaccatcncgaggacaactaccaagacgaaccctactactctagacaaatacgaaactaacgttaggaagtagtacgaaggtaacgtaccgggttaccgtttaacgttaacgtcggtacgtacccggtaccgttaccggaacgggtaaggttacgggtacggttaaaacgggtaaaaacggttaccggtaaacggttcctaccgtaccgtttaccccggtaccggtacccgttacggtccggggg

SEQ ID NO: 413760 - DNA, 527 bp, Homo sapiens
  misc_feature: GZ8MTXP02FUOEI.25.28.C06.1.454.CMB.2.raw
  modified_base (245)..(245): a, c, t, g, unknown or other
  modified_base (409)..(409): a, c, t, g, unknown or other
tcagactgtacagtcacgaccggtgctcgatttagagctcacgtattgggtttgggggcagaagtctctctcagtcaggacacagcatggacatgagggtccatgctcagctcctgggactcctgctgctctggctcccagctatcagatgtggcatccagatgaccaagtctccatcctcctgtctgcatctgttggagacagagtcaccatcacttgccgggcgagtcaggcattggaaattntttggcctggtatcagcaagaaaccagggaaacttcctaacctctacatctatgctgcatccacgtttgctaagtttcggggtccctctcgtattcaggcggctaggttgggtctggggacagtaattcactctcaccatcagcagctgcagctagatatgttnatacttattactataactaaaatttgaacaggtacgaccgtagggtatcggtttaccggccgaacggggaaccgtaaagggtacggaaacggtaactaacgaaaaccgaacgtttcgg

SEQ ID NO: 413761 - DNA, 522 bp, Homo sapiens
  misc_feature: GZ8MTXP02IQI5U.25.28.C06.1.454.CMB.2.raw
  modified_base (339)..(339): a, c, t, g, unknown or other
  modified_base (398)..(398): a, c, t, g, unknown or other
  modified_base (400)..(400): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgaccagtctccatcctcctgtctgcatctgttggagacagagtcacatcacttggccggcgagtcagggcagttggtaaattagttggccttggtatcagcaaggaaaccaggggtaaacttccctaaacctcctacatctatgctgcatccactttgactagttcggggtccctntcgattcgagcggctagtggggtctgggacagtattcactctacaccatcagcagtccncncacgcgtagtagtagtgtagtactacttattactactaataaatagtacgtacgtacgtacgtacgtacgtacgtacgtaccgacggacgaagtacgacgtacgacgtaacgtacgtagtcg

SEQ ID NO: 413762 - DNA, 565 bp, Homo sapiens
  misc_feature: GZ8MTXP02JDPNP.25.28.C06.1.454.CMB.2.raw
  modified_base (468)..(468): a, c, t, g, unknown or other
  modified_base (513)..(513): a, c, t, g, unknown or other
tcagactgtacagtcacgaccggtgctcgatttagagctcacgtattgggtttttgggggaagaggaagactgacggtcctcccaggagttcaggtgctgggcaccttgggcacgggggaggcgtggtccagcctgggaagtccctgagactctcctgtgtggcgcctagactcaccttcagtagttatggcttcgtctgggtccgccagtgtccaggcaaggggctggagtggctgggagttacttggtctgacagacaaatgacatatcacgcggagtccgtgaggggccgattcaccatctccagggacaattccaaagagaaccctctatctgcaaatgaaacaacttgagagtccgaggatacggccgtttattactgtgcgacctcagagtggactagggaaaaagtcgtagtctcattcccgcgacctctggggccagggccacccgtggtcaccggttcncctcagccttccaccaacgggcccatccgtccttcccctcggccnccctcgcctccgacgacgcacctcgtcggggcacgacgccggccctgggccg

SEQ ID NO: 413763 - DNA, 604 bp, Homo sapiens
  misc_feature: GZ8MTXP02FU50E.25.28.C06.1.454.CMB.2.raw
  modified_base (260)..(260): a, c, t, g, unknown or other
  modified_base (304)..(304): a, c, t, g, unknown or other
  modified_base (376)..(376): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagccgtgggaatccctgagactctcctgtgtggcncctagactcaccttcagtagttatggcttcgtctcggggtcccnccagtcgtccagggcaaggggctgggagtggcgtggggattacgttggtctagacagaccaaatgaacatancacggcggagtccggtaggacgggggcctattccaccatctccgagggaacaacttaccaaacgacgaaccctctatactagaacaaagagaaactaacgttagaaggagtacgaaggaacgtacggtacgtttatacgtgtacgacgacctacgaggagtaggacgtaaggtaaaagtacggtaacgtacgtactacgttcccggtaccgtaccgtcggtaccgggg

SEQ ID NO: 413764 - DNA, 593 bp, Homo sapiens
  misc_feature: GZ8MTXP02G8BBE.25.28.C06.1.454.CMB.2.raw
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagccgtgggaatccctgagactctcctgtgtggcgcctagactcaccttcagtagttatggtcttcgtctgggtccgccagtgtccaggcaaggggctgggagtggctggggtagttacgttggtctgacagaccaaatgacatatcacggcggagtccgtggacgggggccattccaccatctaccgaggacaatccaagacgaacctctatctgacaaatagaactaacgttgaacgtagtacggaggtagtacggtacgtttattacgtagttgtacgaccgtacgagggtagtcggtacgtaagggaaaagttcgtaacgttccgtacgtaccgttcccggtaccgtaccgttcggtaccggggg

SEQ ID NO: 413765 - DNA, 553 bp, Homo sapiens
  misc_feature: GZ8MTXP02I883M.25.28.C06.1.454.CMB.2.raw
tcagactgtacagtcacgaccggtgctcgatttagagctcacgtattgggtttgggggagaggagcccagcactagaagtcggcggtgtttccactcggtgatcagcactgaacgcagcggactcaccatggagtttggctgaactgggttttcctgttgctctttaagaggtgtccagtgtcaggcgcatctggtggagtcgtgggggaggcgtggtccagcctgggaagtccctgagactctcctgtgtggcgcctagactcaccttcagtagttatggctttcgtctgggtccgccagtgtccagggcaaggggctggagtgggctggggagttacttgggtctgacagaccaaatgacatatcacgcggagtccggtgacgggggccattcaccatctccagggacaattcaagacgaaccctctatctgacaaatacgaaacaacttagagagtacgaggatacggtacgtttattactgtcgcgtacctacgacggagtggctaggaaaagtcgtaagtctcacttcccgtacgtaccgtcgtcggg

SEQ ID NO: 413766 - DNA, 579 bp, Homo sapiens
  misc_feature: GZ8MTXP02IPVH7.25.28.C06.1.454.CMB.2.raw
  modified_base (299)..(299): a, c, t, g, unknown or other
tcagactgtacagtcacgaccggtgctcgatttagagctcacgtattgggtttgggggagaggagcccagcactagaagtcggcggtgtttccactcggtgatcagcactgaacgcagcggactcaccatggagtttgggctgaactgggtttcctcgttgctctttaagaggtgtccagtgtcaggcgcatctggtggagtcgtgggggaggcgtggtccagcctgggaagtccctgagactctcctgtgtggcgcctagactcaccttcagtagttatggctttcgtctgggtcccnccagtgtccagggcaaggggctgggagtggcttggggagttacttggctgacagaccaaatgaacatatcacggcggagtccgtggacgggggcctattccaccatcctcacgggacaacttaccaagacgaaaccctcgtaatctagacaaatacgaaactaacttagaagagtacgaggaatacggtacgtttattacgtagtcgtacgtactcgacggagtacggacgtaaggtaaaagtcgtaagtcgtacgtacttcccgtacgacctcgtcggg

SEQ ID NO: 413767 - DNA, 568 bp, Homo sapiens
  misc_feature: GZ8MTXP02HBPND.25.28.C06.1.454.CMB.2.raw
  modified_base (272)..(272): a, c, t, g, unknown or other
  modified_base (374)..(374): a, c, t, g, unknown or other
tcagactgtacagtcacgaccggtgctcgatttagagctcacgtattgggtttgggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaagtccctgagactctcctgtgtggcgcctagactcaccttnagtagttatggctttcgtctcggggtcccgccagtcgtccagggcaagggggctgggagtggcgtggggatttacgttggtctgacagaccaaatgacatancacggcggagtcggtggagggggcccattccacatcgtccaggacaataccaagacgaaccctctatctgacaaatacgaactaacttagagagtacgaggatacggtcgtttattactagtcgacgacctcgaggagtacggaccggaaaagtcgtagtctcgtacgtcccgtacgacctcggtcggggaccg

SEQ ID NO: 413768 - DNA, 684 bp, Homo sapiens
  misc_feature: GZ8MTXP02G7USM.25.28.C06.1.454.CMB.2.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtcctccatccctccctgtctgctatctgttggagacagagtccaccatccacgttcggccgggcgagtcgaggggctagttaggtaaatttgttcggcctaggtactcgagacaaacggaaaccgtaggggtaaaacctttccctaaaccctcctactaatcctagtcgcttcgcctaactccctatttccgacgttaacggtttccggggtcccttctacgtattccggaggtcgggacgtagggttcgggtacgtagggaactaagtaacttctactctaccactatcgagcgacgtccgtagaccgacgtaccgtaggaaagttgttacggtttaacgtaacccttaaaattttacctttaacgttaaacggttaaaacctttaaaaaagtttcgtaaaacggttaacggttaccggtaaacccggttgggtaaaccgttccgggtaacccgggaccgtaacggggaaaccgtaaggaacgtaactaacgaacgtaaaacgtcggtaggcg

SEQ ID NO: 413769 - DNA, 543 bp, Homo sapiens
  misc_feature: GZ8MTXP02H8LM1.25.28.C06.1.454.CMB.2.raw
  modified_base (280)..(280): a, c, t, g, unknown or other
  modified_base (296)..(296): a, c, t, g, unknown or other
  modified_base (379)..(379): a, c, t, g, unknown or other
  modified_base (399)..(399): a, c, t, g, unknown or other
  modified_base (488)..(488): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtctgggggagcgtggtccagcctgggaagtcctgagactctcctgtgtggcgcctagactcaccttcagtagttanggcttcgctgggtccnccagtgtccaggcaaaggggctggagtggctggggagtttactggtctagacagaccaaaatgacatatcacgcgagttccgngagggggccattcaccatcnccagggacaaatccaagagaaaccctctaactctgacaaatagaaacaaattgagagtcgaggatacgccgtttatactgtgcgacctnagagtcggctaggaaaagtcgtaagtctactatcccgtcgaaccttcgccggggg

SEQ ID NO: 413770 - DNA, 626 bp, Homo sapiens
  misc_feature: GZ8MTXP02JUAUJ.25.28.C06.1.454.CMB.2.raw
  modified_base (373)..(373): a, c, t, g, unknown or other
  modified_base (391)..(391): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagtagttatggctttcgtctgggtcccgccagtgtccatgcgaaggggctgggagtgggctggggtattacgttggtctagacagacaaatgaacatancgacgcggacgtcccggngacggggcctattccaccatctccgaggacaataccaagacgaaccctctactcagactaaatagaaactaacgttagaagacgtacgaaggtaacgtacggttaccgtttaacgttacgtacgttacggtccgtaccgtacgaacgggtaggttacgggacgttaaacgggtaaaaacggttcggttaacgttaccgttactaccgtttaccccggtaccgtacccgttccggg

SEQ ID NO: 413771 - DNA, 563 bp, Homo sapiens
  misc_feature: GZ8MTXP02FPX4E.25.28.C06.1.454.CMB.2.raw
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaatccctgagactctcctgtgtggcgcctagactcaccttcagtagttatggcttcgtctgggtccgccagtgtccagggcaaggggctggagtggctggggatttacgttggtctgacagaccaaatgacatatcacggcggagtccggtggacgggggccattccacctatctaccgagggaacaacttccaagacgaaccctctatctgacaaatagaacaacttagagagtacgaggatacggtcgtttatactgtgcgactcgaggagtggacgtaaggaaaagtcgtaagtctactacgttcccgtacgaccgtcggtacgggg

SEQ ID NO: 413772 - DNA, 615 bp, Homo sapiens
  misc_feature: GZ8MTXP02GUWAI.25.28.C06.1.454.CMB.2.raw
  modified_base (259)..(259): a, c, t, g, unknown or other
  modified_base (298)..(298): a, c, t, g, unknown or other
  modified_base (372)..(372): a, c, t, g, unknown or other
  modified_base (388)..(388): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcnctagactcaccttcagtagtatggcttcgtctgggtccnccagtgtccagggcaaggggctggagtgggctggggagtttactgggtctgaacagaaccaaaatgaacatacncgacggcggagtcggnggacggggcctattccacctactcgtaccgacggacaaactaccaaacgaccgaaccctactactactacgaacaaataacaaactaacgtagaagtagtacggaaggtacgtacggttaccgtttaagttacgtgtacgtacgtactacgacggtaggtacggtacgtaaaggtaaaacgttacgtaacgttctacgtacgttcccgtacgtaccgtacggtcggg

SEQ ID NO: 413773 - DNA, 515 bp, Homo sapiens
  misc_feature: GZ8MTXP02ILP7Q.25.28.C06.1.454.CMB.2.raw
  modified_base (297)..(297): a, c, t, g, unknown or other
  modified_base (338)..(338): a, c, t, g, unknown or other
  modified_base (417)..(417): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctcctgtctgcatctgttggagacagagtcacatcacttgccgggcgagtcgagggcagttggaaattgtttggcctggtatcagcaagaaaccagggtaaactttcccaaacctcctnatctatgctgcatcctatttcgactagtttcggggtccctntcgattcgagcggtcagtggggtctggggacagtaattcactctcacatcagcacgctgcacgcctagaagtatggtanactaacttattactagtaactaaaattgactagtcgaccgtggtagtcgttccgaccgaggaccgaaggtcgaacactaacgaaacgtacgtagtacg

SEQ ID NO: 413774 - DNA, 555 bp, Homo sapiens
  misc_feature: GZ8MTXP02FUUTU.25.28.C06.1.454.CMB.2.raw
tcagactgtacagtcacgaccggtgctcgatttagagctcacgtattgggtttgggctgagctgggttttcctcgttgctcttttaagaggtgtccagtgtcaggtgcagctggtgcagtctgggggaggcgtggtccaccctgggaggtccctgagactctcctgtgcagcctctggattcatcttcaacacctatgcaatgcactgggtccgccaggctccaggcaaggggctggagtgggtggcagttattcatatgatggaaactaataaaagtatgttagactccgtggcggccgattcaccgtctccagagacagataccaaagaagacggtgtatcctaccaaatcaaacaacctgagctccgagacacgctgtgtattactgtgcgagagcgtcgggcggcgaggtccgtacccccgaggaacgtaccggcgtactattccgacatcggacagtcgtcggggacgaacgggaccgacggtcacgtcgtcctcctcgtcgcctcccaaccgaacggcccacgtccggtccttccccgcggccctcccg

SEQ ID NO: 413775 - DNA, 511 bp, Homo sapiens
  misc_feature: GZ8MTXP02J2E4R.25.28.C06.1.454.CMB.2.raw
  modified_base (233)..(233): a, c, t, g, unknown or other
  modified_base (389)..(389): a, c, t, g, unknown or other
  modified_base (403)..(403): a, c, t, g, unknown or other
  modified_base (409)..(409): a, c, t, g, unknown or other
tcagactgtacagtcacgaccggtgctcgatttagagctcacgtattgggtttgggggcagaagtctctctcagtcaggacacagcatggacatgagggtcccctgctcagctcctgggactcctgctgctctggctcccagctatcagatgtggcatccagatgaccaagtctccatcctccctgtctgcatctgttggagacagagtcaccatcacttgccgggcgagtcnggcattggaaattatttggcctggtatcagcagaaaccagggaaagtttccaacctcctcaatctatgctgcatccactttcgctaatttcggggtacccgttctcgatttcagtcggcagtgggtctggggacagaatttcactctcaccatcancagcctgcagcctnaagtangttgctaacttattactagtactaaaaatttgaaactacgtgacccgtggatcgttaccggcccgaggaccaaggtggaacatacaaacgtaactggtacgg

SEQ ID NO: 413776 - DNA, 539 bp, Homo sapiens
  misc_feature: GZ8MTXP02F35U7.25.28.C06.1.454.CMB.2.raw
  modified_base (301)..(301): a, c, t, g, unknown or other
tcagactgtacagtcacgaccggtgctcgatttagagctcacgtattgggtttgggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagtagttatggcttcgtctggggtcccnccagtgtcccaggcaaggggctggagtggctggggatttacttggtctgacagaccaaatgaacatatcacgcggagtccgtgaggggccattcacatctccaggacaatccaagacgaaccctctatctgacaaatgaacaacttagagagtcgaggatacggtccgtttatactgtgcgactcgaggagtggctaggaaaagtcgtaagtctcacttcccgtcgaccgtcgtcggg

SEQ ID NO: 413777 - DNA, 515 bp, Homo sapiens
  misc_feature: GZ8MTXP02F0IVC.25.28.C06.1.454.CMB.2.raw
  modified_base (404)..(404): a, c, t, g, unknown or other
  modified_base (415)..(415): a, c, t, g, unknown or other
  modified_base (420)..(420): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctcctgtctgcatctgttggagacagagtcaccatcacttgccgggcagtcagggcattggaaattattggcctggtatcagcagaaaccaggggaaattcctaacctctacatctatgcttgcatccgactttgactaagtttcggggtaccctctccggtaatttcgaggcgggctaggtggggtctaggggacagtaattcactctacacactcagcagccgnacagctagatntgtanactattatactataactaaatgaactacgtacgacgtgtacgttcgtacgaccgacggacgtaacggacgaacacaacgaaacgacgtacgtacg

SEQ ID NO: 413778 - DNA, 554 bp, Homo sapiens
  misc_feature: GZ8MTXP02F40IH.25.28.C06.1.454.CMB.2.raw
  modified_base (302)..(302): a, c, t, g, unknown or other
  modified_base (371)..(371): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagtagttatggctttcgtctgggtcccnccagtgtccagggcaaggggctgggagtggctggggagttacgttggtctgacagaccaaatgacatancacgcggagtccgtggacggggccattcacatctccaggacaattccaaagacgaaccctctatactagacaaatgaaactaactagaagagtacgaggatacggtcgtttatacgtgtgcgactcgaggagtacggactaaggaaaagtcgtaagtctacacttcccgtcgacctcgtcggg

SEQ ID NO: 413779 - DNA, 586 bp, Homo sapiens
  misc_feature: GZ8MTXP02JHG5X.25.28.C06.1.454.CMB.2.raw
  modified_base (274)..(274): a, c, t, g, unknown or other
  modified_base (303)..(303): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttnagtagttatggctttcgtcttcggtcccnccaggtcgtccagggcgaaggggctgggagtggcgtggggatttacgtgggtctgacagaacaaatgacatctcacgcggagtccgtggacggggccattccaccatctaccgagggacaattcccaaagacgaaaccctctaactctagacaaagtagaaacctaacttagaaggaagtacggaagtacgtacggtacgtttattactgtcgacgacctgaacggaggtggcgtaaggtaaaacgtcgtaagtctactacgttcccgacgtacctcgtcggg

SEQ ID NO: 413780 - DNA, 665 bp, Homo sapiens
  misc_feature: GZ8MTXP02HX6E2.25.28.C06.1.454.CMB.2.raw
  modified_base (198)..(198): a, c, t, g, unknown or other
  modified_base (221)..(221): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgaccagtctccatcctcctgtctgcatctgtgganacagagtcacatcactggccggngagtcgagggcagttaggaaatttgttcggccttggtactcagcaagaaaccgaggggtaaacttccctaaacctcctatatctatgacttgctaactcctactttcgacttaacggtttccggggtaccccttgttaccggtatttccggacgggtccggtacgtaggggtttcgggggtaccgtacggggtaaaccgtaggttaaactttcccgtaacgttcctacctaaacccgtacgtaccgtacgtaccgacggtcccgtacgaccgtaccggtaccgttaggtaaacgtacgttacggttaccgtaacttaaacgtttaactttaacgtagttaaaccttaaaagtttcgaacgtacgtacgtaccggtagtacgttacgtaccggaccgtaacggaccgaaggtacgaacgacgtaacgaaacgtacgtacggtacg

SEQ ID NO: 413781 - DNA, 618 bp, Homo sapiens
  misc_feature: GZ8MTXP02IRQWI.25.28.C06.1.454.CMB.2.raw
  modified_base (261)..(261): a, c, t, g, unknown or other
  modified_base (304)..(304): a, c, t, g, unknown or other
  modified_base (403)..(403): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggagcgtggtccagccgtgggaagtccctgagactctcctgtgtggcncctagactcaccttcagtagttatggcttcgtcgtcgggtccnccagtcgtccagggcgaagggggtctgggaggtaagggcgttaggggtagtttactgggtctagaacagaaccaaatgacatatcgacgcggagtccgnggacggggtccattccacatctacgaggacaactaccaaagacgtaaccctctactctagactaaattacgaaacctaagttagaagtagtacgaaggtaacgttacggtacgttttaatacgtagtcgtaccgaccgttacgacggtaggtacgtacgtaaggtaaaacgtcgtaacgtctacgtactacccggtacgtaccgtcggtacgggg

SEQ ID NO: 413782 - DNA, 530 bp, Homo sapiens
  misc_feature: GZ8MTXP02GGVUZ.25.28.C06.1.454.CMB.2.raw
  modified_base (227)..(227): a, c, t, g, unknown or other
  modified_base (248)..(248): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgaccaagtctccatcctccctgtctgcatctgttggagacagagtcaccatccacttgccgggngagtcagggcattggaaattnttggcctggtatcagacaagaaaccagggtaaacgttcctaacctcctacatctatgctgacatcctatttcgactaagtttcggggtaccctctcgtacttcgacgcggcgtaggtgggtctgggacagtacttcactctcaccatcagcacgccgtgcacgcctagaagtgtagtacgactaacttattacgtagtaactaaaagttgaacgtacgtacgaccgtggtagtcggtcgaccgaggacgaaggtacgactacgtacgaaacgtacgtgtacg

SEQ ID NO: 413783 - DNA, 556 bp, Homo sapiens
  misc_feature: GZ8MTXP02IPAM0.25.28.C06.1.454.CMB.2.raw
  modified_base (385)..(385): a, c, t, g, unknown or other
  modified_base (407)..(407): a, c, t, g, unknown or other
  modified_base (439)..(439): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagtagttatggcttcgtctgggtccgccagtgtccaggcaagggggctggagtgggctggggagtttacttggtctgacagaccaaatgacatatcacgcgggagtccgnggacgggggccattcaccatcnccgaggacaattccgagacgaaccctctatcngacaaatagaactattagagagtcgaggatacggtctttattactgtgcgactcgaggtagtggacgtaaggaaaagtcgtaagtctactacgttcccgtcgtaccgtcgtccgggg

SEQ ID NO: 413784 - DNA, 558 bp, Homo sapiens
  misc_feature: GZ8MTXP02GA2XM.25.28.C06.1.454.CMB.2.raw
  modified_base (297)..(297): a, c, t, g, unknown or other
  modified_base (362)..(362): a, c, t, g, unknown or other
  modified_base (422)..(422): a, c, t, g, unknown or other
tcagactgtacagtcacgaccggtgctcgatttagagctcacgtattgggtttgggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaagtccctgagactctcctgtgtggcgcctagactcaccttcagtattatggcttcgtctgggtccnccagtgtccaggcaaggggctggagtggctggggattacttggtctgacagaccaaatgacatancagcggagtccgtgacggggccattcacatctccgaggacaatccaaagacgaaaccctntactctagactaaatgaaactaacttagagtagtacgaggatacggtacgtttatacgtgtcgactactcgaggtagtaggacgtaggaaaacgtcgtaagtctacgtacttcccgtacgtaccgtcggtccgggg

SEQ ID NO: 413785 - DNA, 632 bp, Homo sapiens
  misc_feature: GZ8MTXP02IKR4D.25.28.C06.1.454.CMB.2.raw
  modified_base (259)..(259): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctagtggagtcgtgggggagcgtggtccagccgtgggaatccctgagactctctgtgtggcncctagactcaccttcagtagttatggctttcgtcgtggggtccccgccaggtcgtcccagggccgaagggggctggggagtggcttggggtagtttacgttggtacctaaacaggaacaaagtgaactatatcgacggcggacgtccgtggacggggcccattccacctatcctaccgagggaacaacttacccgaaagacgaaccctactactcctagacaaaatgaaacaacgttgaacgaggacgaaggacgtaacggtccgtttattaccgtgtacgaccgacctacgagggagtcggtacgtaaaggtaaaacgtcggtaagtcgtacgtacgttccccggtacgtacccgttcggtacgggacccgg

SEQ ID NO: 413786 - DNA, 563 bp, Homo sapiens
  misc_feature: GZ8MTXP02FJMCA.25.28.C06.1.454.CMB.2.raw
  modified_base (259)..(259): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaatccctgagactctcctgtgtggcncctagactcaccttcagtagttatggcttcgtctgggtcccgccagtgtccagggcaaggggctggagtggctggggattacgttggtctgacagaccaaatgacatatcacggcggagtccggtggagggggccattccaccatctccgagggacaattccaacgacgaaccctctatctgacaaatgaacaacttgagagtacgaggatacggtcgttatactgtgcgtacctcgaggagtcggacgtacggaaaacgtcggtaacgtctactacgttacccgtcgtaccgtcggtccgggg

SEQ ID NO: 413787 - DNA, 532 bp, Homo sapiens
  misc_feature: GZ8MTXP02G7MJN.25.28.C06.1.454.CMB.2.raw
  modified_base (200)..(200): a, c, t, g, unknown or other
  modified_base (340)..(340): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctcctgtctgcatctgttgganacagagtccacatcacttggccgggcgagtcagggcattggaaattgttggcctggtatcagacaagaaaccaggggtaaacttccctaaacctcctacagtctatcgctgcatcctattcgactagtttcggggccctntcgtattcgagcggtctaggtgggtctagggacagtaattcgactctacacatcagctagcctgcagccgtagaagtattgtactactaaacttacttactagttaaactaaaagtttgaacgtagtacgaccgtgtacgtcgtacggaccaacgggtacgaaggtacgactactacgaactacgttggacg

SEQ ID NO: 413788 - DNA, 566 bp, Homo sapiens
  misc_feature: GZ8MTXP02JN09L.25.28.C06.1.454.CMB.2.raw
  modified_base (299)..(299): a, c, t, g, unknown or other
  modified_base (370)..(370): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagctcaccttcagtagttatggcttcgtctgggtccnccagtgtccagggcgaaggggctgggagtggctggggagtttacttggtctggacagaccaaatgacatancacgcggatccggtgacggggccatcaccatctccgagggacaattaccgaagacgaaccctctatctagacaaatagaaacacttagagagtacgaggatacggtcgtttatacgtgtcgacgacctcgacggagtacggacgtaaggaaaacgtacgtaagtctacgtacttcccgtacgtaccgtcgtcgggg

SEQ ID NO: 413789 - DNA, 576 bp, Homo sapiens
  misc_feature: GZ8MTXP02HXTC8.25.28.C06.1.454.CMB.2.raw
  modified_base (281)..(281): a, c, t, g, unknown or other
  modified_base (299)..(299): a, c, t, g, unknown or other
tcagactgtacagtcacgaccggtgctcgatttagagctcacgtattgggtttggggggagaggagcccagcactagaagtcggcggtgtttccactcggtcatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagactctcctgtgtggcgcctagactcaccttcagtagttanggtcttcgtctgggtccnccagtcgccaggcgaaggggctggagtggcgtggggatttacgttggtctgacagaccaaagtgactatatcgacgcgggagtcccgtggacggggcccgtattccaccactctaccgaggacaattaccgaaagacgaaccctcgtactctagacaaatagaaactaacgttagagagtacgagacgtacggtacgtttatacgtgtcgtacgactacgaggagtcgacgtaaggaaagtcgtaagtctactacttccgtacgtaccgtcgtcggg

SEQ ID NO: 413790 - DNA, 555 bp, Homo sapiens
  misc_feature: GZ8MTXP02FQYMT.25.28.C06.1.454.CMB.2.raw
  modified_base (272)..(272): a, c, t, g, unknown or other
  modified_base (374)..(374): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagactctcctgtgtggcgcctagactcaccttnagttagttatggcttcgtctggggtcccgccaggtgtccagggcaagggggctgggagtgggctggggatttacgttggtctgacagaaccaaatgacatancacgcggagtccgtggacggggccatcacatctcaggacaattccaagacgaacctctatctagacaaatagaaacacttagagagtacgaggatacggtacgttatacgtgtcgacgactcgacggagtggacgtaggaaaagtcgtaagtctctacttcccgtacgtacctcgtcgggg

SEQ ID NO: 413791 - DNA, 625 bp, Homo sapiens
  misc_feature: GZ8MTXP02JNLO8.25.28.C06.1.454.CMB.2.raw
  modified_base (230)..(230): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtcctccatccctccctgtctgctatctggtggagacagatcaccatcacttggccggggngagtcgaggggctaagttagggtaaaatttgttcggcctggtactcgagacaaggaaaccgaaggggtaaacttccaacctcctcactctatcgctgctatcctagtttcgacttaacggtttccggggtacccctcgtatacgtcggcggcgtcgggttagggtcggtacgggacgaagtaacgtacctactacctacctacctaactacaccggacacgtccgacacgacgtacctagaagtacgtgttacgtaactaactttaacttaacgttacgtaaacttaaaacttaacgttacgaacggttacggtacggttaccggaagttcggtaccggtacccggacggaacggtaacgaaggtaaccacgtaaacgaacgacgtagcggtacg

SEQ ID NO: 413792 - DNA, 693 bp, Homo sapiens
  misc_feature: GZ8MTXP02JKLR4.25.28.C06.1.454.CMB.2.raw
  modified_base (261)..(261): a, c, t, g, unknown or other
  modified_base (276)..(276): a, c, t, g, unknown or other
  modified_base (306)..(306): a, c, t, g, unknown or other
  modified_base (339)..(339): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagccgtgggaacgtccctgagactctcctgtgtggcncctagactcaccttnagtagttatggctttcgtctggggtccccncgtagtcgtccgagggacggaaggggctagggnggtgggcgttggggtagtttacgttgggtctggaaacaagaaaccaaagtgaactatacaccgaacgggtcgggacggtccgggagggaccgggggcctaacttccgaccctactcctaccgagaacgaactaaactaccgaacggaaccctaccctactaacttaccttaaacgaaagtacgaaccgtccgtagacggacgaccggaacggaaccgacggtaccgtagtaacgttacgtcggtcggacgggacggggaacgtaacgttaacgttacggttacggtttaacgttacgttaacgtttaacctttaccgtttacccgtacggtccgggtacccgtacgggttcccg

SEQ ID NO: 413793 - DNA, 605 bp, Homo sapiens
  misc_feature: GZ8MTXP02FS4DT.25.28.C06.1.454.CMB.2.raw
  modified_base (308)..(308): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctggggaagtccctgagactctcctgtgtggcgcctagactcaccttcagttagttatgggtctttcgtcgtggggtcccnccagtcgtccagggcaagggggctggagtgggctggggattacgttggtctgaacagaccaaatgaacatatccgacgcgggagtccggtggacgggggccattccaccatctaccgaggacaattaccgaagacgaaccctactactctgacaaatagaaactaacttagagagtacgaaggtacgtacggtaccgtttaattacgtgtacgtaccgtacccgtacgacggaggtcggtacgtaaggtaaaacgtacgtaagtactacgtacttcccgtcgtaccgtcgtacgggg

SEQ ID NO: 413794 - DNA, 708 bp, Homo sapiens
  misc_feature: GZ8MTXP02GQQGV.25.28.C06.1.454.CMB.2.raw
  modified_base (258)..(258): a, c, t, g, unknown or other
  modified_base (273)..(273): a, c, t, g, unknown or other
  modified_base (302)..(302): a, c, t, g, unknown or other
  modified_base (372)..(372): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggaggcgtggtccagcctgggaatccctgagactctctgtgtggcncctagactcaccttnagtagttatggctttcgtctcgggtcccncagtgtccaggcaaggggctgggagtggcgtggggatttacgttggtctgacagaaccaaatgacatacncacggcggtagtccggtaggacgggggtccctaatttcccgaacctactccgtacccgaaggggtaacctaaacgttacccgaaaagtaaccgtaaacccccttaccttaacgttaccttacggaacctaaaagtaacgaaacctaaacgtttaggaaggtaacggttaccggaagggtaacgttaccgggttaccgttttaagttaacgttcggttacggaccgtacccgttacggaacgggtaggtacgggtaccgtaagggtaaaaacggttcggttaacgttccgttaccgttaccgttaccccggtaccggtacccgttcggtaccggggg

SEQ ID NO: 413795 - DNA, 597 bp, Homo sapiens
  misc_feature: GZ8MTXP02HWEM7.25.28.C06.1.454.CMB.2.raw
  modified_base (262)..(262): a, c, t, g, unknown or other
  modified_base (277)..(277): a, c, t, g, unknown or other
  modified_base (286)..(286): a, c, t, g, unknown or other
  modified_base (303)..(303): a, c, t, g, unknown or other
  modified_base (371)..(371): a, c, t, g, unknown or other
  modified_base (385)..(385): a, c, t, g, unknown or other
  modified_base (400)..(400): a, c, t, g, unknown or other
  modified_base (403)..(403): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctgggtggagtcgtgggggaggcgtggtccagccgtgggaactccctgagactctcctgtgtggcncctagactcaccttnagtagttanggtcttcgctgggtccncagtgccaggcaaggggctgggagtgggcgtggggatttacgtggtctgacagaaccaaatgacatancgagcggagtccgnggacggggcatcacntcncgaggacaatacaagacaacctctactctagactaaatacgaaactaacgttagaagacgtacgaaggtacgttacggtacgtttaagtaacgtgtacgtaccgtaccgttcgaacggtaggtacggtacgtaaggtaaaagtcgtaacgttactacgtaccgttacccggtaccgtaccgttcggtaccgggg

SEQ ID NO: 413796 - DNA, 505 bp, Homo sapiens
  misc_feature: GZ8MTXP02JPS63.25.28.C06.1.454.CMB.2.raw
  modified_base (201)..(201): a, c, t, g, unknown or other
  modified_base (395)..(395): a, c, t, g, unknown or other
  modified_base (404)..(404): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttgganacagagtcaccatcacttggccgggcgagtcaggggcattggaaattattggcctggtatcagcaagaaaccagggaaacttccaactcctcatctatgctgcatccactttgctaagtttcggggtccctatcgatttcagtcggctaggtgggtctggggacagaatttcactctcacatcagcagcctgcngcctgaagntgtgactaacttagttactgtaactaaaatttgaactagtgacccgtgattcggtccgaccgtaggaccaaggtcgacactacaaaacgtacgtcgtacgg

SEQ ID NO: 413797 - DNA, 564 bp, Homo sapiens
  misc_feature: GZ8MTXP02F50UP.25.28.C06.1.454.CMB.2.raw
  modified_base (297)..(297): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaatccctgagactctcctgtgtggcgcctagactcacttcagtagtatggcttcgtctgggtccnccagtgtccaggcaaggggctggagtggctggggagttacttggtctgacagaccaaatgacatatcacgcggagtccgtggacgggggccagttcacatcgtccgagggacaacttccaagacgaaccctctactctgacaaatagaactacttagagtagtacgaggtagtacggtacgtttatacgtgtgtacgactcgagggagtggtacgtaaggaaaacgtcgtaagtctactacgttcccgtacgaccgtcgtaccgggg

SEQ ID NO: 413798 - DNA, 655 bp, Homo sapiens
  misc_feature: GZ8MTXP02JXBWW.25.28.C06.1.454.CMB.2.raw
  modified_base (275)..(275): a, c, t, g, unknown or other
  modified_base (303)..(303): a, c, t, g, unknown or other
  modified_base (374)..(374): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggaggcgtggtccagccgtgggaactccctgagactctcctgtgtggcgctagactcaccttnagttagttatggcttcgtcgtgggtccncagtcgtccaggcgaaggggctggagtggcgtggggatttacgtggtctgacagaaccaaatgaacatacncgacggcgggtagtccggtaggacggggccctattccacctactccgtaccgaacgggaactaacttacccaaacgaaccgtaaccctacgtactactacgaactaaaatacgaaaacctaacgttaggaacggtaacggtacggaacgggtaacgttaaccgggttaccgttttaacgttacgtggtacgaccggtaccgtacggaacgggtaggtcggacgtaaggtaaaacgtcgtaagtctacgtacgttcccgtaccgtacccgtcggtaccgggg

SEQ ID NO: 413799 - DNA, 619 bp, Homo sapiens
  misc_feature: GZ8MTXP02JCWX6.25.28.C06.1.454.CMB.2.raw
  modified_base (260)..(260): a, c, t, g, unknown or other
  modified_base (283)..(283): a, c, t, g, unknown or other
  modified_base (301)..(301): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctgggtggagtcgtgggggaggcgtcggtccagcctggggaatccctgagctctcctgtgtggcncctagactcaccttcagtgttanggctttcgtctgggtccnccagtgtccaggcgaaggggctgggagtggcgtggggtatttacgtgggtctgacagaccaaatgacatatcgacggcgggtagtccgggtaggacggggtccctattccacctactcctaccgagggtaactaacttaccgaaacgaccgtaaccccgtactactactagaacaaatacgaaactaacgttagagtagtacgaggactacggtacgtttatacgtgtcgacgactacgaggtacgtaggcgtaaagggtaaaacgttcgtaagtccgttacgtacgtttcccggtaccgtacccgttcgtaccgggg

SEQ ID NO: 413800 - DNA, 627 bp, Homo sapiens
  misc_feature: GZ8MTXP02FD7RI.25.28.C06.1.454.CMB.2.raw
  modified_base (276)..(276): a, c, t, g, unknown or other
  modified_base (301)..(301): a, c, t, g, unknown or other
  modified_base (348)..(348): a, c, t, g, unknown or other
  modified_base (368)..(368): a, c, t, g, unknown or other
tcagactgtacagtcacgaccggtgctcgatttagagctcacgtattggggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctggggaagtccctgagactctcctgtgtggcgcctagactcaccttnagtagtatggcttcgtctgggtccnccagtgtccaggcaaggggctggagtggctggggattacgttggtcngacagaccaaatgacatacncgacggcggagtccggtggacggggcctatccaccactctaccgaggactaactaccaacgacgtaaccctactatctagaacaaagtaacgaaactaacgttaggaaggacgtacggaaggtaacgttaccggttaccgtttaattacgtgtacgaccgtaccgtacgaacgggtaggtacgggtacgtaaacgggtaaaacggttacgtaacgttccttaccgtaccgttaccccggtaccgacccgtcggtcgggg

SEQ ID NO: 413801 - DNA, 681 bp, Homo sapiens
  misc_feature: GZ8MTXP02JDRS5.25.28.C06.1.454.CMB.2.raw
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgctagactcaccttcagtagttatggcttcgtctgggtccgccagtgtccgaggcaagggggctgggagtggcgtggggtagtttacgtggtctgacagaccaaaatgaactatatacgacggcgggtagtccggtgggacgggggcctagttccacctatccgtaccgacgggaactaacgttaccgaaagtaccgaaaccccttctaactacgttacgaactaaaacgtacgaaaacctaacgtttaggaaacgggtaacggttacgggaagggtaacgttaaccggggttacccgttttaagttaaccgttggtacggtaccgtacccgtcggtaaggggtacgtagggtacgtaaaggggtaaaacggttcgtaagttaccgtacgtacttacccggcgtaacccgtcggtacggggg

SEQ ID NO: 413802 - DNA, 679 bp, Homo sapiens
  misc_feature: GZ8MTXP02IWTD9.25.28.C06.1.454.CMB.2.raw
  modified_base (354)..(354): a, c, t, g, unknown or other
  modified_base (392)..(392): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaacttgggttttcctcgttgcttcttttaagaggtgtccagtgtcagatgcaacgtggcggaggtcgggggagcggtggtccgaggccggggaatcccgtgagactctcctgtgcagtcgccgcgtcctaccttccgttcgtttggctattcacgtcgggtcccgccacggctaccgaggcgaagggacgtggacggtgggtggccggtnagtagtgggtggatggaagtaagtgaccgtattttagngtacagtaccgtccggtggacgggccgactccaaccgtatcgtaccaagacgcacgacctaaccaaagtaacttaccctttatccgtagacgtaaagttaacgaaaaccgtgaacgtacgtaccgacgtaaccgaccgtcgtagttccctaaagttcgtacggtcggtacgggttacaaggaaacggtaaaccggtcggggtacccggggtaccgtaccggtaccggacgtaacggtaccgggacccgtacccgggtacggggaacccgaacggggacctaaccggg

SEQ ID NO: 413803 - DNA, 640 bp, Homo sapiens
  misc_feature: GZ8MTXP02JH1I8.25.28.C06.1.454.CMB.2.raw
  modified_base (260)..(260): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatcgtggtggagtcgtgggggagcgtggtccagcctgggaacgtccctgagactctcctgtgtggcncctagactcaccttcagtagttatggcttcgtcgtcgggtccgccagtcgtccgagggcgaaggggctgggaggtgggcgttaggggtagtttacgttggtctagacaggaaccaaatgaactatatcgacggcgggacgtccggtaggacgggggcctagtttccaacccgacttccgtaccgaagggaacctaaacttacccgaaacgacgaaccctctaactcgtagaaccaaatacgaactaacgttagagtagtacgaagggaacgttacggtaccgtttaattacgtacgcgtaccgacctaggacggacggtacggacgtaaggaaaagtcggtaactcgtacgtacgttccgaccgtaccgtcggtccgggg

SEQ ID NO: 413804 - DNA, 590 bp, Homo sapiens
  misc_feature: GZ8MTXP02J1JXH.25.28.C06.1.454.CMB.2.raw
  modified_base (304)..(304): a, c, t, g, unknown or other
  modified_base (457)..(457): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggaggcgtgggtccagccgtgggaagtccctgagactctcctgtgtggcgcctagactcaccttcagtagttatggcttcgtctgggtcccnccagtcgtccaggcgaaggggctgggagtggcgtggggagtttacgtggtctgacagaccaaatgacatatcgacgcgggagtcccggtggacgggggccattccaccactcctccgagggactaactaccaagacgaaccctactactctanacaaatacgaactaactagagagtacgaggagtacggtacgtttattacgtgtcgacgtaccgtacgaggtacgtaggacgtaaggtaaaagtcgtaagtctacgtacgttcccgtacgtaccgtcggtcggg

SEQ ID NO: 413805 - DNA, 525 bp, Homo sapiens
  misc_feature: GZ8MTXP02J06D8.25.28.C06.1.454.CMB.2.raw
  modified_base (296)..(296): a, c, t, g, unknown or other
  modified_base (521)..(521): a, c, t, g, unknown or other
tcagactgtacagtcacgaccggtgctcgatttagagctcacgtattgggtttgggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtctggggagcgtggtccagcctgggaagtccctgagactctcctgtgtggcgcctagactcaccttcagtagttatggcttcgtctgggtccnccagtgtccaggcaaggggctggagtggctggggattactggctgacagaccaaatgacatatcacgcggagtccgtgagggggccagttcacccatctccaggggacaattccaagacgaaaccctctatctgacaaatgaacacttgagagtcgaggatacggccgtttatactgtgcgactcagagtgctgaaaagtcgtaagtctcacttccgcgacctcncggg

SEQ ID NO: 413806 - DNA, 611 bp, Homo sapiens
  misc_feature: GZ8MTXP02IWV53.25.28.C06.1.454.CMB.2.raw
  modified_base (229)..(229): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttggcccggggngagtcgaggggctagttaggaaaatttgttcggcccttggtatccgaagacgaaaggaaacccgaaggggtaaaacgtttaccctaaaccctcctacatcctaatgctgcatcctactttcgactaagtttcggggtccccttctcgattcgaggcggctagggtgggtcgtagggaacagtaacttccgaccttctaccacccgatccacgcgtacgccctgccgacgaccgtagaagtattggttagacttaaactttacttaactagttaaccttaaaagtttcgaacgtacggtacggtaacccggtggtacttcggttaccggacccgaagggaaccgtaaggtacggaactaacgaacaaacgtaacgtagtacgg

SEQ ID NO: 413807 - DNA, 609 bp, Homo sapiens
  misc_feature: GZ8MTXP02IENEH.25.28.C06.1.454.CMB.2.raw
  modified_base (165)..(165): a, c, t, g, unknown or other
  modified_base (301)..(301): a, c, t, g, unknown or other
  modified_base (340)..(340): a, c, t, g, unknown or other
  modified_base (382)..(382): a, c, t, g, unknown or other
  modified_base (417)..(417): a, c, t, g, unknown or other
  modified_base (458)..(458): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttggctgaactgggtttcctcgttgctntttaagaggtgtccagtgtcaggcgcatcgtggtggagtcgtggggggagcgtggtccaggccgtgggaacgtcctgagactctcctgtgcagtcgtccgcgtccaccttcggtcgtttggcattcacgtggtccncaggctccgaggcaagggctggaggtggggtggcggttnagttagtggggtagggatgggaagtactggactatttttagngacgagccgtccgtaggaacgggcccatccgactntcctccgaaggcgacaggacctacgaaacgtactactttanctagactaagttacgaaacgtgactacgacgtacgactacgcttagtctagtacgtggtcgtcggggtactagaaacgggtaacgtcggggtccggggtcctcggtaacggcgaacggtcgggaaccgtccggtacgggggacaaacgggg

SEQ ID NO: 413808 - DNA, 568 bp, Homo sapiens
  misc_feature: GZ8MTXP02GC2RM.25.28.C06.1.454.CMB.2.raw
  modified_base (282)..(282): a, c, t, g, unknown or other
  modified_base (375)..(375): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttggctgaactgggttttcctcgttgctcttttaagaggtgtccagtgtcaggcgcatctggtggagtcgtgggggaggcgtggtccagccgtgggaatccctgagactctcctgtgtggcgcctagactcaccttcagtagtanggcttcgtctgggtcccgcagtcgtccagggcgaagggggctgggagtgggctggggtattacgttggtctggacagaccaaatgaacatacncgacgcggagtccggtaggacggggccattcaccatctcgaggacaattacaagacgaacctctatctgaacaaatagaaacatgagagtacgagactacggtcgtttatacgtgtacgtacgacctacgaggtagtaggacgtaaggaaaagtcgtaagtctactacgttcccgtacgtacctcgtacgggg

SEQ ID NO: 413809 - DNA, 765 bp, Homo sapiens
  misc_feature: GZ8MTXP02GKS8E.25.28.C06.1.454.CMB.2.raw
  modified_base (272)..(272): a, c, t, g, unknown or other
  modified_base (281)..(281): a, c, t, g, unknown or other
  modified_base (301)..(301): a, c, t, g, unknown or other
  modified_base (323)..(323): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagactctctgtgtggcgcctagactcaccttnagtagttanggcttcgtctggggtccccncagtcgcgaggcgagggctggngtggcgtagggtagttcgttggtctaggaacagaacctaaagtcgaactatacaccgacgggtcggggtacgttcccgggtaggggaccgggggtaccctacgtttacccaaacccgtacgtcccgtacccggaaacggggtaaaccttaaacgttaacccgaaaacggtaacccgtaaaccccttacgttaacttaccgtaacgaaacctaaaagttaacgaaaaccgtaaacgttaacggtaacgggtaacggtaacggtaaacgggtaacggttaaccgggttaaccggtttaacgtttacgttacgttacggtaccggtacccgtaccggtaacgggtacgggtacgggtacggtaaacgggtaaaacggttaacggttaacgttaccgttaccgttaccgttacccggttacccggtacccggttaccggtccgggg

SEQ ID NO: 413810 - DNA, 567 bp, Homo sapiens
  misc_feature: GZ8MTXP02H6BI3.25.28.C06.1.454.CMB.2.raw
  modified_base (202)..(202): a, c, t, g, unknown or other
  modified_base (398)..(398): a, c, t, g, unknown or other
tcagactgtacagtcacgaccggtgctcgatttagagctcacgtattgggtttggggcagaagtctctctcagtcaggacacagcatggacatgagggtccctgctcagctcctgggactcctgctgctctggctcccagctatcagatgtggcatccagatgacccagtcctccttccttcctgtctgcatctggtggganacagagtcaccatcacgttggccgggcgagtcaggacattaccaattattagcctggtactacaacaacaaaccgagggaaacgtaccctaagctacctagtactacttatttctgcatcctaccccttgcacgtcgacggggtcccatctcgcttcaggcgctagtggacgtcgtgggactagtatttcagtccncacctactccgaccgcctgacacgcctgacgtacttcttgacctaactttacttacttacgtaactaaaactatacaactacgtaccgtcccgtaacgttacggtttcggaccgacggggtaccaacggtaacggtcggaaccttacgaaacggtacctaggtcgaccg

SEQ ID NO: 413811 - DNA, 602 bp, Homo sapiens
  misc_feature: GZ8MTXP02IM2YB.25.28.C06.1.454.CMB.2.raw
  modified_base (214)..(214): a, c, t, g, unknown or other
  modified_base (375)..(375): a, c, t, g, unknown or other
  modified_base (506)..(506): a, c, t, g, unknown or other
tcagactgtacagtcacgaccggtgctcgatttagagctcacgtattgggtttgggctgagctgggttttcctcgttgctcttttaagaggtgtccagtgtcaggtgcagctggtgcagtctgggggaggcgtggtccaccctgggaggtccctgagactctcctgtgcagcctctggattcatcttcaacacctatgcaatgcactgggtccnccaggctccaggcaaggggctggagtgggtggcagttattcatatgatggaaactaaataaaagtatgttagactccggtggccggccgatttcaccgtctaccgagacgacagataccaaagaagtacggtgtatcctaccaaaatcaaacactagacgntaccgaaggaccacgggtcttgtagttacttaacgtgtgcgagagtacgtcggggcggtcgacgggtcccgtacccccgaaggtaacggtaccgcgttaacttacgttccgaactacgtggacacgttcgngggggacgaacggggcgaacggtcgacgtcgtacctccgtcgtcgccctccgaaccgaacggcccacgttccgtccttcccccgcggtcccgcccg

SEQ ID NO: 413812 - DNA, 699 bp, Homo sapiens
  misc_feature: GZ8MTXP02J1QNK.25.28.C06.1.454.CMB.2.raw
  modified_base (258)..(258): a, c, t, g, unknown or other
  modified_base (273)..(273): a, c, t, g, unknown or other
  modified_base (379)..(379): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaagtccctgagactctcctgtgtggcncctagactcaccttnagtagttatggctttcgtcgtcgggtcccgccagtcgtcccagggccgaagggggctgggagtggcgtggggtatttcgtggtctgacagaaccaaatgacatacncgacgcgggagtccggtaggacgggggtcctatttccgaccactccgtaccgaacgggaactaaacgttacccgaaacgaccgtaaaccccttactaactctacgaactaaaacgttaacgaaaacctaacgttacggaaggtaacggtacggaagggtaacgttaaccgggttaccgttttaacgtttaccgtaggttacggtacccggtaccgttaccggaacggggtaacggtacgggtacgtaaacggggtaaaaacgttcggtaacgttacctacgttaccgtttccccggtaccgtaacccgtcggtaccgggg

SEQ ID NO: 413813 - DNA, 566 bp, Homo sapiens
  misc_feature: GZ8MTXP02GMKIP.25.28.C06.1.454.CMB.2.raw
  modified_base (300)..(300): a, c, t, g, unknown or other
  modified_base (370)..(370): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcactatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagtagttatggcttcgtctgggtccnccagtgtccagggcaaggggctggagtgggctggggatttacgtggtctgacagaaccaaatgaacatancacgcggatccggtgacggggccattcaccatctccagggacaattaccaaagacgaacctctatactagacaaatagaactaactgagagtacgaggagtacggtaccgtttattacgtgtcgacgacctgaggagtcggacgtaacggaaaagtcgtaagtctacgtacttcccgtacgtaccgtcgtacgggg

SEQ ID NO: 413814 - DNA, 593 bp, Homo sapiens
  misc_feature: GZ8MTXP02HCHLD.25.28.C06.1.454.CMB.2.raw
  modified_base (300)..(300): a, c, t, g, unknown or other
  modified_base (377)..(377): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagtagttatggcttcgtctgggtccnccagtgtccagggcaaggggctgggagtgggcgtggggagtttacgtgggtctggaacagaccaaaagtgaacatancgacggcgggagtccggtaggacgggggcctatccacatctaccgagggacaacgttaccgaagacgaaccctctactctagacaaatacgaactaacgttgaagagtacgaaggtactacggtacgtttatacgtgtcgtacgaccgtgacggtagtggacgtaaggtaaaagtcgtaagtctacgtacgttcccgacgtaccgtcgtaccgggg

SEQ ID NO: 413815 - DNA, 604 bp, Homo sapiens
  misc_feature: GZ8MTXP02FLUSG.25.28.C06.1.454.CMB.2.raw
  modified_base (283)..(283): a, c, t, g, unknown or other
  modified_base (301)..(301): a, c, t, g, unknown or other
  modified_base (347)..(347): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggccgaactgggtttcctcgttgctcttttaagaggtgtccagtgtcaggcgcatctggtggagtcgtgggggaggcgtggtccagccgtgggaagtccctgagactctcctgtgtggcgctagactcaccttcagtagttangtcttcgtcgtgggtccnccagtgtccgaggcgaagggctggagtggcgtgggattactggtcngacagacaaatgacatatcgacggcggagtccgtggagggggccattccacgatctccgaggacaactacaaagtacgaccctactatctagacaaagtacaaactaacttagagtaacggtaccgaaggtacgtacggttaccgtttagttacgtgtcgtaccgtactacgaggacggtacggtacgtaaaggtaaaacgtcgtaacgtaacgtacgtaccgttaccgtaccgtacccgtcggtcggggaacccgg

SEQ ID NO: 413816 - DNA, 549 bp, Homo sapiens
  misc_feature: GZ8MTXP02HSEV9.25.28.C06.1.454.CMB.2.raw
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagtagttatggctttcgtctgggtccgccagtgtccaggcaaggggctggagtggctggggagttacttggtctgacagaccaaatgacatatcacgcggagtccgtgagggggccagttcaccatctccagggacaattccaagacgaaccctctactctagacaaatagaacaacttgagagtacgaggatacggccgtttatactgtgcgactcaggagtggacgtaggaaaaagtcgtaagtctactacttcccgtacgacctcgtcgggg

SEQ ID NO: 413817 - DNA, 585 bp, Homo sapiens
  misc_feature: GZ8MTXP02J2JB8.25.28.C06.1.454.CMB.2.raw
  modified_base (285)..(285): a, c, t, g, unknown or other
  modified_base (305)..(305): a, c, t, g, unknown or other
  modified_base (379)..(379): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatcgtggtggagtcgtgggggaggcgtggtccaggcctgggaactccctgacgactctcctgtgtggcgcctagactcacttcagtagttntggcttcgtcgtgggtcccnccagtcgtccgaggcgaaggggctgggagtggcgtggggtagtttacgtggtctgacagaccaaatgacatacncacgcggacgtccggtggacggggccattccaccactcctaccgacgggacaacgttaccaagacgaaccctctaactctacgacaaatacgaactaagttagagtagtacgaggtacgtacggtacgtttatacgtgtcgcgaccgtgacggagtgcgtaaggaaaagtcgtaagtctactcttacccgcgtaccgtcgtcgggg

SEQ ID NO: 413818 - DNA, 553 bp, Homo sapiens
  misc_feature: GZ8MTXP02F0RIQ.25.28.C06.1.454.CMB.2.raw
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaatccctgagactctcctgtgtggcgcctagactcaccttcagtagttatggcttcgtctgggtccgccagtgtccagggcaaggggctggagtggcgtgggagttacttggtctgacagaccaaatgacatatcacgcggagtccggtggagggggccagttccaccatctcccgagggacaacttaccaagacgtaaccctctatctagacaaatagaacaacttagagagtacgagatacggtcgttatactgtgcgactcgaggagtggacgtaggaaaagtcgtaagtctactactcccgtcgaccgtcgtcgggg

SEQ ID NO: 413819 - DNA, 491 bp, Homo sapiens
  misc_feature: GZ8MTXP02GP2WW.25.28.C06.1.454.CMB.2.raw
  modified_base (289)..(289): a, c, t, g, unknown or other
  modified_base (329)..(329): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgaccaagtctccatcctcctgtctgcatctgttggagacagagtcaccatcacttgccgggcgagtcagggcattggaaattattggcctggtatcagcagaaaccagggaaacttccaactcctnatctatgctgcatccactttgctaagtttcggggtccctntcgattcgagcggcagtgggtctgggacagattcactctcacatcagcagcctgcagcctgaagtatgtgactaacttattactatactaaaatttgaactagtcgaccgtgatcgttcgaccgaggaccgaaggtcggaacacgtacgaaacgactagtcg

SEQ ID NO: 413820 - DNA, 656 bp, Homo sapiens
  misc_feature: GZ8MTXP02IOZKG.25.28.C06.1.454.CMB.2.raw
tcagactgtacagtcacgaccggtgctcgatttagagctcacgtattgggtttgggggggagaggagcccagcactgggattccgaggtgtttccattcggtgatcagcactgaacacagaggactcaccatggcgttttggctgagctgggttttccttgttgctgttttaaaggtgtccagtgtgaggtgcagctgggcggagtctggaggaggcctgatccagccgtgggggtccctgagactctcctgtgcagcctcgtggttcagtcgttagtcacagtcctactgatccgtcggggtcccgccgaggcctccggaaggggaaggggctgggacgtggtcgtctctagtttatttagtagccgtaataactacccactactaccgcagacctcggtagacgggtcgtacttaccttactcctccgaagacgaactaacttaccgaacgtaccacccttactacttaccttacaaagtcggaaccgcccgtagacgacggacccgacggaccgacggtccgtagttagttacgtggtacggacgggacggggagaacgttaacggttaggttaggtttacttaccggtaactttaaccgttaacccgtttcccgacggtttccggggacccgttacggggttcccttccggg

SEQ ID NO: 413821 - DNA, 612 bp, Homo sapiens
  misc_feature: GZ8MTXP02GZTCM.25.28.C06.1.454.CMB.2.raw
  modified_base (206)..(206): a, c, t, g, unknown or other
  modified_base (306)..(306): a, c, t, g, unknown or other
  modified_base (317)..(317): a, c, t, g, unknown or other
  modified_base (346)..(346): a, c, t, g, unknown or other
tcagactgtacagtcacgaccggtgctcgatttagagctcacgtattggggtttgggggcagaagtctctctcagtcaggacacagcatggacatgagggtccctgctcagctcctgggactcctgctgctctggctcccagctatcagatgtggcatccagatcgacccagtctccatccctccctgtctgcattctggttgganacagagtccacatcacgttcggccgggcgagtcgaggggcagttaggaaatttgttggcctggtatcagcaagaaacgagggtaaacttccaacctcctnatctatgactnacatcctattgactagtttcggggccctntcgtattcgagcggacgtaggttgggtactaggggaactaagtaaacttcctactcctacaacctagtccaggaccacgtccacggactacgtaccgtagtaaagtcttaggttacgaaccttaaactttaacttaacgttaacttaaacttaaaagtttcgaaccgtaaggtaccgtaccggttagtacggttaccggtaccggaacccgaacggggtaacctaagggtacgaactaacgtaaacgtaaacgtacggtagtaccg

SEQ ID NO: 413822 - DNA, 539 bp, Homo sapiens
  misc_feature: GZ8MTXP02F6S0H.25.28.C06.1.454.CMB.2.raw
  modified_base (297)..(297): a, c, t, g, unknown or other
  modified_base (362)..(362): a, c, t, g, unknown or other
  modified_base (491)..(491): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtgagtctgggggagcgtggtccagcctgggaagtccctgagactctcctgtgtggcgcctagactcaccttcagtagttatggcttcgtctgggtccnccagtgtccagggcaaggggctggagtggctgggatttactggtctgacagaccaaatgacatancacgcggatccgtgaggggccatcaccatctccagggacaattcccaaagacgaaaccctctaactctgacaaaattcgaaacaacttgagagtcgagatacggtctttatactgtgcgactcaggagnggactaggaaaatgtaagtctactacttcccgtcgacctcgtacgggg

SEQ ID NO: 413823 - DNA, 627 bp, Homo sapiens
  misc_feature: GZ8MTXP02GEDE9.25.28.C06.1.454.CMB.2.raw
  modified_base (274)..(274): a, c, t, g, unknown or other
  modified_base (295)..(295): a, c, t, g, unknown or other
  modified_base (367)..(367): a, c, t, g, unknown or other
  modified_base (447)..(447): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatcgtggtggagtcgtgggggaggcgtggtccagcctgggaatccctgagactctcctgtgtggcgcctagactcacttnagtatatggcttcgctggccncagtgtccaggcgaaggggctggaggtggcgtgggagtttacgtggtctgaacagaacctaaatgaacatancgacgcggagtccggtggacggggcctattccacctatacctcccgaagggaactaacgttaccgaaagactaaaccctntaactacctagaaaccaaaagtacgaaactaacgttagaaggagttaccggaaggtacgttaaccggttacggtttaacttaccgtagtcgtacgtaccgtagacggtaaggtggtacgtaaaaggaaaagttaccggtaagtactactaacgtttcccgaccgtaaccgtcgtcggggg

SEQ ID NO: 413824 - DNA, 562 bp, Homo sapiens
  misc_feature: GZ8MTXP02FO514.25.28.C06.1.454.CMB.2.raw
  modified_base (257)..(257): a, c, t, g, unknown or other
  modified_base (296)..(296): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgttcagtgtcaggcgcatctggtggagtcgtgggggagcgtggtccagcctgggaatccctgagactctcctgtgtggcncctagactcaccttcagtgtatggcttcgtctgggtccncagtgtccaggcaaggggctggagtggctggggatttagttggtctgacagaccaaagtgacatatcacgcggagtcccggtgacgggggccattcaccatcctccgagggacaagttccaaagacgaaccctctatctagacaaatacgaacacttagagagtcgagtatacggtacgttattacgtgtcgacgtacctcgacggagtaggcgtaaaggaaaagtcgtaagtcctactacgttcccgtcgaccgtcggtccgggg

SEQ ID NO: 413825 - DNA, 549 bp, Homo sapiens
  misc_feature: GZ8MTXP02HLM57.25.28.C06.1.454.CMB.2.raw
  modified_base (299)..(299): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaagtccctgagactctcctgtgtggcgcctagactcaccttcagtagttatggcttcgtctgggtccnccagtgtccaggcaaggggctggagtggctggggagttacttggtctgacagaccaaatgacatatcacgcggagtccgtgacgggggcctatcaccatctccgaggacaattaccaagacgaaccctctatctgacaaatgaaactaacttagagagtcgagagtacggtcgttattactgtcgcgactcgacggagtcggacgtaggaaaagtcgtaagtctactacttcccgtcgaccgtcgtcggg

SEQ ID NO: 413826 - DNA, 578 bp, Homo sapiens
  misc_feature: GZ8MTXP02FG08S.25.28.C06.1.454.CMB.2.raw
  modified_base (301)..(301): a, c, t, g, unknown or other
  modified_base (365)..(365): a, c, t, g, unknown or other
  modified_base (427)..(427): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatcgtggtggagtcgtgggggagcgtggtccagcctgggaatccctgagctctcctgtgtggcgcctagactcaccttcagttagtatgggcttcgtctgggtccncagtcgtccaggcaaggggctggagtggctggggattcttggtctgacagaccaaatgacatancacgcggagtccgtggacggggccagttcacatctccgaggacaataccaagacgaaccctntatctacgacaaatagaactaacgttacgaagagtaccgaaggtacgtacggtacgtttaattacgtgtacgccgtaccgtacgaggtacggtggacgtaaggaaaacgtcgtaagtctacgtacgttcccgtcgaccgtcggtaccgggg

SEQ ID NO: 413827 - DNA, 570 bp, Homo sapiens
  misc_feature: GZ8MTXP02JXEF8.25.28.C06.1.454.CMB.2.raw
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtctgggggagcgtggtccagcctgggaagtccctgagactctcctgtgtggcgctagctcaccttcagtagttatggcttcgtctgggtccgccagtgtccaggcaaggggctggagtggctggggtattacttgggtctgacagaccaaatgacatatcacggtcggagtccggtggacgggggccgtattccaccactcgtccgagggacaacttacccaagacgtaaccctactactctcgacaaatagaacaacttagagtagtacgaggtagtacggtcgtttattacgtgtagcgactcgacggagtaggcgtaggaaaacgtcgtaagtcgtacacgttccgtccgtacctcgtcgggg

SEQ ID NO: 413828 - DNA, 566 bp, Homo sapiens
  misc_feature: GZ8MTXP02GDY8B.25.28.C06.1.454.CMB.2.raw
  modified_base (299)..(299): a, c, t, g, unknown or other
  modified_base (372)..(372): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagctctcctgtgtggcgctagactcaccttcagtagttatggctttcgtctggggtcccnccagtgtccagggccgaaggggctgggagtggctaggggtatttacgttggtctgacagaccaaatgacatancgagcgggatccggtggacggggccattcacatctaccgagggacaataccaagacgaacctctactctgacaaatagaacaacttagaagagtacgagacgtacggtacgtttatacgtgtcgcgtactcgaggtagtcggacgtaaggaaagtcgtaagtctacgtacttcccgtacgacctcggtacgggg

SEQ ID NO: 413829 - DNA, 565 bp, Homo sapiens
  misc_feature: GZ8MTXP02I1INT.25.28.C06.1.454.CMB.2.raw
  modified_base (259)..(259): a, c, t, g, unknown or other
  modified_base (274)..(274): a, c, t, g, unknown or other
  modified_base (304)..(304): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaagtccctgagactctcctgtgtggcncctagactcaccttnagttagttatggctttcgtctggggtcccnccagtgtccagggcaaggggctggagtggctggggatttactggtctgacagaccaaatgacatatcacgcggagtccggtggacgggggccaattccgaccatctccagggacaattccaagacgaacctctaatctgacaaatgaaactaacttgagagtacgaggagtacggtacgtttattactgtcgacgactacgaggagtggacgtaaggaaaagtcgtaagtctactacgttcccgtcgtacctcggtcgggg

SEQ ID NO: 413830 - DNA, 556 bp, Homo sapiens
  misc_feature: GZ8MTXP02JDPBE.25.28.C06.1.454.CMB.2.raw
  modified_base (300)..(300): a, c, t, g, unknown or other
  modified_base (366)..(366): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagtagttatggcttcgtctgggtccnccagtgtccaggcaaggggctggagtggctggggattacgttggtctgacagaccaaatgacatancacgcggagtccggtggagggggccattccaccatctccgaggacaatccaagacgaaccctctatctagacaaatagaactaactagagagtcgaggatacggtacgtttatacgtgtacgcgtactcgacggagtacgacgtaggaaaagtcgtaagtctactactcccgtacgtaccgtacgtcggg

SEQ ID NO: 413831 - DNA, 567 bp, Homo sapiens
  misc_feature: GZ8MTXP02GSS4T.25.28.C06.1.454.CMB.2.raw
  modified_base (301)..(301): a, c, t, g, unknown or other
  modified_base (402)..(402): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagtagttatggcttcgtctggggtccnccagtcgtccagggcaaggggctggagtggctggggtagtttacttggtctgacagaccaaaatgacatatcacgcggagtccgtggaggggccatcacanctccaggacatccaagacgaacctctatctgacaaatagaaactaacttagaagagtacgaggaacgtacggtaccgtttattacgtgtacgtacgaccgtcgacggagtggaccgtaggaaaacgtcggtaagtctacgtactcccgtacgtacctcgtcgggg

SEQ ID NO: 413832 - DNA, 582 bp, Homo sapiens
  misc_feature: GZ8MTXP02IYW5R.25.28.C06.1.454.CMB.2.raw
  modified_base (300)..(300): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactcggttttcctcgttgctcttttaagaggtgtccagtgtcaggcgcatctggtggagtcgtgggggaggcgtggtccagcctgggaagtccctgagactctcctgtgtggcgctagactcaccttcagtagttatggcttcgtctgggtccncagtgtccaggcaaggggctgggagtggctggggattacgttggtctgacagaaccaatgacatatcacgcggagtccggtggacggggcctaattccaccgatctccgagggacaacttaccaaagacgaaccctctactctagacaaatacgaaactaacttagagagtacgaggtactacggtacgtttattacgtgtacgcgtactacgaggagtacggtacgtaaggtaaaacgtcgtaagtctactacgttacccgtaccgtaccgtcgtacgggg

SEQ ID NO: 413833 - DNA, 597 bp, Homo sapiens
  misc_feature: GZ8MTXP02JAKQI.25.28.C06.1.454.CMB.2.raw
  modified_base (300)..(300): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagtagttatggcttcgtctgggtccnccagtgtccaggcaaggggctggagtggctggggattacttgggctgacagaccaaatgacatatcacgcggagtccgtggacggggccattccacatctcgaggacaatccaaagacaaccctctatctagacaaatagaaactaacttaggagtacgtacgaaggtacgtacgggtaccgtttagttacgtggtacgtaccgtaccgttacggacgggtaggttacgggacgttaagggaaaacgttcggtaagtcgttacctacgttccccgtacgtacccgttcggtccgggg

SEQ ID NO: 413834 - DNA, 767 bp, Homo sapiens
  misc_feature: GZ8MTXP02ISZN2.25.28.C06.1.454.CMB.2.raw
  modified_base (175)..(175): a, c, t, g, unknown or other
  modified_base (269)..(269): a, c, t, g, unknown or other
  modified_base (298)..(298): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgcttcttttaagnggtgtccagtgtcaggcgcatctggtggagtcgtgggggagcgtggtccagcctgggaatccctgagctctctgtgtgcgcctagctcaccttnagtagttatgggctttcgctggggtcccncagtcgccgagggcgaggggtctggagtcggcgtagggtagtttacgttggtctaggaacagaaccaaatgaactatacgaccgacgggcggggtacgtccgggtaggggaccgggggtcctaattacccgaccgtacgttaccgtacccggaaacgggtaaacctaaaccgtttaacccgaaaacggtaaacccgtaaaccccttacgttaacgtcctaacgtaaacgtaaaacgttaaacgtaaaacgtaaaccgttaacggtaacgggtaacggtaacgggtaacgggtaacggttaaccgggtttaaccggtttaacgtttaacgttacggttacggtaccggtaaccgtacggtaacgggtacgggtacggtaacggtaaacgggtaaaacggttaacggttaacgttaccgttaccgttacccgttacccggttacccggttacccggttaccgggtacgggg

SEQ ID NO: 413835 - DNA, 590 bp, Homo sapiens
  misc_feature: GZ8MTXP02FYUMB.25.28.C06.1.454.CMB.2.raw
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaatccctgagactctcctgtgtggcgcctagactcaccttcagttagttatggctttcgtctgggtcccgccagtgtccagggcaaggggctgggagtggcgtggggatttacgttggtctgacagaaccaaatgaacatatcacggcggagtccggtaggacgggggccattccgaccatcctccgagggaacaattaccaaagacgaaccctctatactagacaaatacgaaactaacgttagaagtagtacggaggtacgtacggtactttattacgtgtcgacgactcgaggtagtggacgtaaggaaaacgtcgtaagtctactacgttcccgtacgtaccgtcgtacgggg

SEQ ID NO: 413836 - DNA, 574 bp, Homo sapiens
  misc_feature: GZ8MTXP02HTS6U.25.28.C06.1.454.CMB.2.raw
  modified_base (274)..(274): a, c, t, g, unknown or other
  modified_base (516)..(516): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaagtccctgagactctcctgtgtggcgcctagactcaccttnagtagttatggctttcgtcgtcgggtccgccagtcgtccgagggcgaaggggctggagtggcgtggggtagttacgttggtctgacagaccaaatgacatatcacgcggagtccggtgacgggggccattcaccatctacgaggacaattacccaagacaaccctctactctagacaaatagaaactaagtgaaggtagtacgaggactacggtcgtttagtactgtacgcgacgtcgaggngtacggacgtaaggaaaagtcgtaagtctactacttcccgtacgtaccgtcgtcgggg

SEQ ID NO: 413837 - DNA, 613 bp, Homo sapiens
  misc_feature: GZ8MTXP02FVAMF.25.28.C06.1.454.CMB.2.raw
  modified_base (302)..(302): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagccgtgggaatccctgagactctctgtgtggcgcctagactcaccttcagttagtatggtcttcgtcgtcgggtccncctagtcgtccagggcgaaggggctggagtggcgtggggtagtttacgttggtctaggacagaacctaaagtgaacatactcgacggcgggacgtccggtgggacgggggcctattaccacctatccgtaccgacggaactaacttaccgaaagacgtaaccctctactactagacaaatagaaactacgtagagtagacgagtacgtacggtacgtttatacgtgtcgacgtacctgaggagtacggtacgtaaaggaaacgttcgtaacgttctacgtaccgttcccgtacgtaccgtcggtaccgggg

SEQ ID NO: 413838 - DNA, 570 bp, Homo sapiens
  misc_feature: GZ8MTXP02JKYQ4.25.28.C06.1.454.CMB.2.raw
  modified_base (299)..(299): a, c, t, g, unknown or other
  modified_base (383)..(383): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaatccctgagactctcctgtgtggcgcctagactcaccttcagtagttatggcttcgtctgggtccncagtcgtccaggcgaaggggctggagtggcgtggggattacttggctgacagaccaaatgacatatcgacgcgggagttccggnggacggggccgtatcaccatctcgaggacattaccgaagacgaacctctatctagacaaatagaactaacttgagagtacgagagtacggtcgtttagtacgtgcgtacgacgtcgacggagtacggacgtaaggaaaacgtcgtaacgtacgtacgtacgtcccgtacgtaccgtcggtaccgggg

SEQ ID NO: 413839 - DNA, 579 bp, Homo sapiens
  misc_feature: GZ8MTXP02GZP9D.25.28.C06.1.454.CMB.2.raw
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagccgtgggaacgtccctgagactctcctgtgtggcgcctagactcaccttcagtagttatggcttcgtctgggtccgccagtgtccaggcgaaggggctggaggtggcgtgggagttacgttggtctgactagaccaaatgacatatcgacgcggagtccggtggaggggccagttccaccactctccgacgggacaattaccgaagacgaaccctactactcacgacaaatacgaacaacgttacgagagtacgaggacgtacggtacgtttatacgtgtacgccgtactcgaggagtacggacgtaaggaaagtcgtaagtctctacgtcccgtactaccgtcgtccgggg

SEQ ID NO: 413840 - DNA, 664 bp, Homo sapiens
  misc_feature: GZ8MTXP02G26OD.25.28.C06.1.454.CMB.2.raw
  modified_base (262)..(262): a, c, t, g, unknown or other
  modified_base (308)..(308): a, c, t, g, unknown or other
  modified_base (391)..(391): a, c, t, g, unknown or other
  modified_base (465)..(465): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggaggcgtggtccagccgtgggaacgtccctgagactctcctgtgtggcncctagactcaccttcagttagttatggctttcgtcgtcgggtcccncctagtcgtccgagggcgaaggggctagggagtgggcgtggggtatttacgttgggtctggaacagaaccaaatgaacatacncgacggcggagtccggtgggacggggccattccaccatcctaccgaagggacaacttccaaagaccgaaccctntactctagaactaaactacgaaactaacgttagaagggtaacgtaccgtaaggtacgttaaccgggtacgtttaacgttacgtacgtcggtaccgtaccgtcggtaacgggtaggtacgggtaacgttaagggtaaaacggttcgtaacgttccgtaccgttaccgttccccggtaccgtacccgtcggtacccggggg

SEQ ID NO: 413841 - DNA, 582 bp, Homo sapiens
  misc_feature: GZ8MTXP02IJIYY.25.28.C06.1.454.CMB.2.raw
  modified_base (284)..(284): a, c, t, g, unknown or other
  modified_base (367)..(367): a, c, t, g, unknown or other
  modified_base (396)..(396): a, c, t, g, unknown or other
tcagactgtacagtcacgaccggtgctcgatttagagctcacgtattgggtttgggctgagctgggttttcctcgttgctcttttaagaggtgtccagtgtcaggtgcagctggtgcagtctgggggaggcgtggtccaccctgggaggtccctgagactctcctgtgcagcctctggattcatcttcaacacctatgcaatgcactgggtccgccaggctccaggcaaggggctggagtgggtggctagttatttcatatgataggaaactaaataaaaagtntgttagactcgtggcggcgattcaccgtctaccagagacagataccaagaagacggtgtatcctacaaatacaacaacctganctacgaggacacgctgtctaatactgtgngagagacgtcggggacggcgtacggtccgacccccgaagggtaaacgtaccggtactacgttacgttcccgaacagtcggaactagtccggtagggggaccgaaacgggaccgacggtacaacgtcgtactccgtctcgccctacgacccgaaggcccacgtcggtccctcccgtcggacctcccg

SEQ ID NO: 413842 - DNA, 572 bp, Homo sapiens
  misc_feature: GZ8MTXP02JIARK.25.28.C06.1.454.CMB.2.raw
tcagactgtacagtcacgaccggtgctcgatttagagctcacgtattgggtttttgggggaagaggaagactgacggtcctcccaggagttcaggtgctgggcaccttgggcacgggggaggcgtggtccagcctgggaagtccctgagactctcctgtgtggcgcctagactcaccttcagtagttatggcttcgtctgggtccgccagtgtccaggcaaggggctggagtggctgggagttacttggtctgacagacaaatgacatatcacgcggagtccgtgaggggccgattcaccatctccagggacaattccaagagaaccctctatctgcaaatgaaacacttgagagtcgaggatacggcgtttatactgtgcgactcagagtggactaggaaaagtcgtaagtctcattcccgtcgacctctcggggccagggcacccgtggtcaccggtctcctccgacgccttcccaccgaagggccccagtccggtccttccccctcggccgcccgtcgcctccgacggacgccaccgtcgtcggggcacgagccggcccgtcggtcccg

SEQ ID NO: 413843 - DNA, 599 bp, Homo sapiens
  misc_feature: GZ8MTXP02JSMUQ.25.28.C06.1.454.CMB.2.raw
  modified_base (300)..(300): a, c, t, g, unknown or other
  modified_base (372)..(372): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagctctcctgtgtggcgcctagactcaccttcagtagttatggcttcgtctgggtcccncagtgtccaggcaaggggctggagtggcgtggggtagtttacgttgggtctgacagaaccaaatgacatacncacggcggagtccggtggacggggcctattccaccatcctaccgagggacaattaccaaagacgaaccctctaactctagacaaatacgaacaacgttagagagtacgaggacgtacggtcgtttatacgtagtcggcgtacccgtgacggtagtacggaccgtaaggaaaacggttcgtaaggtccttacgtacgtttccccggtaccgtacccgtccggtcgggg

SEQ ID NO: 413844 - DNA, 654 bp, Homo sapiens
  misc_feature: GZ8MTXP02G4OC3.25.28.C06.1.454.CMB.2.raw
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagtagttatggcttcgtctgggtccgccagtgtcccagggcaaaggggtcgtcggtaggtggtcggtcgggtagggttacgtttaggttcgtcgtacgacgaacgtaaactagtacgaatatacgacgccggggacggtacggtcggtaggggaccgggtacgttactacccgactctcccgtacgggacgtaactacgtaacgagaaccctacctatactacgacaaactaagtaacgaaactagtaggacgtacgaggagtacgtacggttaccttagtcgtgtacgaccgtacgtacggtaggagggtacgtaaggtaaacggttaacgtaaggttactacgtacttacccgtacccgtaccgtaccgttccggggg

SEQ ID NO: 413845 - DNA, 700 bp, Homo sapiens
  misc_feature: GZ8MTXP02JHIVR.25.28.C06.1.454.CMB.2.raw
  modified_base (278)..(278): a, c, t, g, unknown or other
  modified_base (306)..(306): a, c, t, g, unknown or other
  modified_base (382)..(382): a, c, t, g, unknown or other
  modified_base (390)..(390): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttggctgaacttgggttttcctcgttgcttcttttaagaggtgtccagtgtcaggcgcatcgtggtggagtcgtgggggaggcgtggtccagccgtgggaacgtccctgagactctcctgtgtggcgcctagactcaccttnagtagttatggcttcgtcgtgggtcccncagtcgtccgaggcgaaggggctggagtggcgtggggtatttacgtggtctagactagaaccaaatgaactatacncgaacggngggtacgtccggtagggacggggtccctaattccgaacctaactccgtacccgaacgggaaacctaaacgttaacccgaaacgaaccgtaaaccccttacttaactactacgaaacctaaaagttaacgaaaacctaaacgttagaagggtacgtaacgtaaggtaaacgttaccggttaacgtttaacgttacgtcggtacgtaccgtaaccgtacggaacggggtaacgtacgggtaacgtaaaagggtaaaacgttacgtaacgtaccgtacgtaccgttcccggtaccgtacccgtcggtaccggg

SEQ ID NO: 413846 - DNA, 574 bp, Homo sapiens
  misc_feature: GZ8MTXP02FZCF9.25.28.C06.1.454.CMB.2.raw
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagactctcctgtgtggcgcctagactcaccttcagtgttatgggcttcgtctgggtccgccagtgtccagggcaaggggctggagtgggctggggagttacgttggtctgacagaccaaatgacatatcacgcggagtcgtagacgggggccattcgaccatctacccgagggacaattccaaagacgtaaccctctatctgactaaatgaactaacttgagagtacgagagtacgtacgtttatactgtgacgacctgaacggtaggtacggtagtaacgggtaaaagttcgtaaggttcctacgtacgttcccgtacgtacctcgtccggggg

SEQ ID NO: 413847 - DNA, 797 bp, Homo sapiens
  misc_feature: GZ8MTXP02JWHSV.25.28.C06.1.454.CMB.2.raw
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatcgtggtggagtcgtgggggagcgtggtccagccgtgggaacgtccctgagactctcctgtgtggcgctagactcaccttcagtagttatggcttcgtcgtgggtcccgccaggtcgtacccgagggtccgaaagggggctaggggagtcgggacgttggggtacttttacgttgggtacctggaaccaaggaaaccctaaaaagtcggaaactaagttaacgtaccgaacgggtccggggaacgttcccgggtagggaaccgggggacccctaagtttacccgaaacccgtactacccgtacccgaaacggggtaaacctaaacgtttacccgaaaacggaaccggtaaaccccttaccgttaacttaccttaacggaaacctaaaagttacgaaaaccgtaaacgttaggaagggtaacggttaccggaaacgggtaacgttaaccgggttaccgttttaaacgttaccgttaggttacggaccgtaaccgttacggaacggggtaacggtacggggtaaccgtaaacgggtaaaaacggttcggtaacggttaccgttacgtaacgttccccggtaccgtacccgtacggtaccggggg

SEQ ID NO: 413848 - DNA, 588 bp, Homo sapiens
  misc_feature: GZ8MTXP02GUTHS.25.28.C06.1.454.CMB.2.raw
  modified_base (241)..(241): a, c, t, g, unknown or other
  modified_base (298)..(298): a, c, t, g, unknown or other
  modified_base (366)..(366): a, c, t, g, unknown or other
  modified_base (373)..(373): a, c, t, g, unknown or other
  modified_base (451)..(451): a, c, t, g, unknown or other
  modified_base (454)..(454): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttggctgaactgggttttcctcgttgcttcttttaagaggtgtccagtgtcaggcgcatctggtggagtcgtgggggagcgtggtccagcctgggaatccctganctctctgtgtgcgcctagactcaccttcagtagttatggcttcggtcgtgggtcccnccagtcgtccgagggcaaggggctggagtggcgtgggtagtttacgtggtctagacagaaccaaagtnactatancgacggcggtacgtcggaggacgggcctactccacactccgacgagacaactacaacgtactacctactactctaganaanagaactagtagagagtacgagacgtacgtacgttattacgtgtcgtacgtacgtacgtacggtaggtacggtacgtaacggtaaacgtacgtaacgtacgtacgtaccgttaccgtaccgtaccgtacggtcgg

SEQ ID NO: 413849 - DNA, 711 bp, Homo sapiens
  misc_feature: GZ8MTXP02JZ9MG.25.28.C06.1.454.CMB.2.raw
  modified_base (310)..(310): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatcgtggtggagtcgtgggggaggcggtggtccaggccgtagggaacgtccctgacgactctcctgtgtggcgcctagactcaccttcagtagttatggtcttcgtcgtgggtccncagtcgtccgagggcgaaggggctgggagtgggcgtggggtagtttacgttggtctagacgagaacctaaaagtgaactatactaccgacggcggggtacggttcccgggtaggggacgggggtcccgtaactttacccgaacccgtacgttcccgtacccggaacggggtaacctaaacgttaacccgaaagtaaccgtaaaccccttactactacgtacgaactaaagtaacgaaactaacgttagaacggtagtacgaaggtacgtacggttacgtttaacttacgtcgtacgtaccgtacgtaccggacggtaggtaggtacgtaaagggtaaaacggttcggtaacgtaccttacgtaccgttaccccggtaccggtacccggtacggtccggggg

SEQ ID NO: 413850 - DNA, 667 bp, Homo sapiens
  misc_feature: GZ8MTXP02IRD3Z.25.28.C06.1.454.CMB.2.raw
  modified_base (302)..(302): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcggtggggggggctggtccaggcctgggaagtccctgagactctcctgtgtggcgcctagactcaccttcagtagttatggcttcgtctgggtcccncagtcgtccgaggcgaaggggctggagtggcgtggggagtttacgttggctagacagaactaaagtgaactatatcgaacggcggacgttccgtgggacgggggtccctattccgaacctatccgtaccgaacgggaactaaacgttaccgaaacgtaacgtaaaccccttactaactacgtacgaactaaataacgtaaaactaaacgttagaaggtaacgtacgggaacggtaacggttaaccggttaccgtttaacgttaaccgtgtacgtaccgtaccgtacgaggtagtacgggtacgtaagggaaaacgttcgtacgtaacgtctacgttcccgtacgtaccgtcggtacgggacccgg

SEQ ID NO: 413851 - DNA, 546 bp, Homo sapiens
  misc_feature: GZ8MTXP02IC9GM.25.28.C06.1.454.CMB.2.raw
  modified_base (280)..(280): a, c, t, g, unknown or other
  modified_base (398)..(398): a, c, t, g, unknown or other
  modified_base (436)..(436): a, c, t, g, unknown or other
  modified_base (441)..(441): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtctgggggagcgtggtccagcctgggaatccctgagactctcctgtgtggcgcctagactcaccttcagtagttanggcttcgtctgggtccgccagtgtccagggcaaggggctggagtggctggggatttactggtctgacagaccaaatgacatatcacgcggagtccgtggaggggcccattcaccatcnccagggacaagttccaagacgaaactctactactcaanaatanaactaactagtagagtacgagagtacgtacgttattatgtgacgactcgagtaggagacgtacgtaaagtacgtcgtactacgtactccgtcgtacgtacgtcgg

SEQ ID NO: 413852 - DNA, 549 bp, Homo sapiens
  misc_feature: GZ8MTXP02FJP1I.25.28.C06.1.454.CMB.2.raw
tcagactgtacagtcacgaccggtgctcgatttagagctcacgtattggggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtctgggggaggcgtggtccagcctgggaagtccctgagactctcctgtgtggcgcctagactcacttcagtatatggcttcgtctgggtccgccagtgtccagggcaaggggctggagtggctgggagttacttgggtctgacagaccaaatgacatatcacgcgggagtccgtggagggggccattccaccatctccagggacaattcccaagacgaaccctctatctgacaaatagaacaacttgagagtcgaggatacggccttatactgtgacgacctcgaggaggtacggacgtaggaaaagtgtaacgtctacgacttcccgtcgacctcgtcggggg

SEQ ID NO: 413853 - DNA, 569 bp, Homo sapiens
  misc_feature: GZ8MTXP02IIH8H.25.28.C06.1.454.CMB.2.raw
  modified_base (201)..(201): a, c, t, g, unknown or other
  modified_base (415)..(415): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctcctgtctgcatctgttgganacagagtcaccatcacgttgccgggcgagtcagggcagttggaaattgttggcctggtatcagacaagaaaccgaggggtaaacttccctaaacctcctacatctatgactgacctatccctatttcgactaaggtttcggggtccctctcgtattccgaggcgcgtagggttcgggtctagggacagtaatcactctacacatcagcacgccngcagtcctagaagattggtactactaaacttacttacgtacgtaaactaaaatttcgaactacggtacgtaccgtaggtacgttacggttcccggaaccgtaacgggaaccgtaagggtacggaacctagaaccgaaaaccgtgtacggtccgg

SEQ ID NO: 413854 - DNA, 585 bp, Homo sapiens
  misc_feature: GZ8MTXP02G54P4.25.28.C06.1.454.CMB.2.raw
  modified_base (378)..(378): a, c, t, g, unknown or other
tcagactgtacagtcacgaccggtgctcgatttagagctcacgtattgggtttgggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtctgggggagcgtggtccagcctgggaagtccctgagactctcctgtgtggcgcctagactcaccttcagtagttatggcttcgctgggtccgccagtgtccaggcaaggggctggagtggctgggagttactggtctgacagaccaaaatgaacatatcaacgcggagttccgngagggggcccaattcaccatctccagggacaattccaaagagaaaccctctaatctagacaaaatagaaacaaacttagagaagtacgaagaagtaacggtacggtttacttacttagtgtacgaccgttaccgacggagtaggtacgtacggtaaaaggtaacgtaagtacgtactactacccgtaccgtaaccgtacgtccgggg

SEQ ID NO: 413855 - DNA, 576 bp, Homo sapiens
  misc_feature: GZ8MTXP02JOEKX.25.28.C06.1.454.CMB.2.raw
  modified_base (279)..(279): a, c, t, g, unknown or other
  modified_base (288)..(288): a, c, t, g, unknown or other
  modified_base (306)..(306): a, c, t, g, unknown or other
  modified_base (377)..(377): a, c, t, g, unknown or other
  modified_base (394)..(394): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggagcgtggtccagccgtgggaacgtccctggagactctcctgtgtggcgcctagactcaccttnagtagttanggtcttcgtctgggtccncagtgccaggcaggggctggagtgggctggggtatttacgttggtacctgaacagaaccaaagtgacatancgacgcgggagtccggnggacgggcctatccaccatctacgaggacataccagacgacctctatctagacaaatacaactaactagagagtacgagtagtacggtctttatacgtgtcgacgtactacgaggtacgtaggacgtaaggtaaaacgtcgtaacgtcgtacgtacgtcccgtacgtaccgtcggtaccggg

SEQ ID NO: 413856 - DNA, 622 bp, Homo sapiens
  misc_feature: GZ8MTXP02GD3QF.25.28.C06.1.454.CMB.2.raw
  modified_base (276)..(276): a, c, t, g, unknown or other
  modified_base (303)..(303): a, c, t, g, unknown or other
  modified_base (383)..(383): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatcgtggtggagtcgtgggggaggcgtggtccagccgtgggaactccctgagactctcctgtgtggcgcctagctcaccttnagtagttatggcttcgtctgggtcccncctagtcgtccgaggcgaaggggctggagtggcgtggggtagttacgttggtctgaactagaacctaaatgaacagtacncgaacgcgggagtccggtggacggggcctaattccaccactccgtaccgaacgggtaactaacttacccgaaagaaccgtaaaccctactaactctagaactaaatacgaaactaacgttagagaagtacgaacggtacgtacggtacgtttatacgtgtcgtacgtactcgaggacgtacggacgtaaggtaaacgtcgtaagtcgtactacgttcccgtacgtaccgtcgacggggg

SEQ ID NO: 413857 - DNA, 636 bp, Homo sapiens
  misc_feature: GZ8MTXP02JAWCE.25.28.C06.1.454.CMB.2.raw
  modified_base (377)..(377): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatcgtggtggagtcgtgggggaggcgtggtccagccgtgggaactccctgagactctcctgtgtggcgcctagactcaccttcagtagttatggtcttcgtcgtcgggtcccgccagtcgtccgagggccaaggggctggagtggcgtggggattcttggtctgacagaccaaagtgacatancgacgcgggagtccggtaggacggggcctattccgaccatccgtaccgagggaactaactaccgaaagaccgaaccctctactactgaacctaaatacgaaactacgttagagacgtacgaaggtacgtaccggtacgtttatacgtcggtacgaccgtaccgtcgaacggggtagtacgggtacgtaaacggggtaaacgtcggttaacggttactaccggttacgttccccggtacgtacccggtacggtccggggg

SEQ ID NO: 413858 - DNA, 607 bp, Homo sapiens
  misc_feature: GZ8MTXP02GT5WZ.25.28.C06.1.454.CMB.2.raw
  modified_base (283)..(283): a, c, t, g, unknown or other
  modified_base (344)..(344): a, c, t, g, unknown or other
  modified_base (404)..(404): a, c, t, g, unknown or other
  modified_base (491)..(491): a, c, t, g, unknown or other
  modified_base (594)..(594): a, c, t, g, unknown or other
tcagactgtacagtcacgaccggtgctcgatttagagctcacgtattgggtttgggctgagctgggttttcctcgttgctcttttaagaggtgtccagtgtcaggtgcagctggtgcagtctgggggaggcgtggtccaccctgggaggtccctgagactctcctgtgcagcctctggattcatcttcaacacctatgcaatgcactgggtccgccaggctccgaggcaaggggctggagtgggtgctagttattcatatgataggaaactaaataaaaagtntgttagacgtccggtggcggcattcaccgtctccagagacagataccgaaagaagacggtntactcctaaccaaatacaaactaacctgaagactccgaagacgacgctgtagtattacgngtgcgagagacgtcggggcgacgtacggtcccgacccgaagggtaacgtacggactacgtactccgaagtacgtaggactagtcggngggggaccgaaaggggaccacggtacagttcccggtctccgtacgtccgacccttccgaaacccggaacggtcccctaacgttcccggttccccttcccccgngggcccctccccg

SEQ ID NO: 413859 - DNA, 620 bp, Homo sapiens
  misc_feature: GZ8MTXP02JD95L.25.28.C06.1.454.CMB.2.raw
  modified_base (201)..(201): a, c, t, g, unknown or other
  modified_base (302)..(302): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatccctcctgtctgcatctgttgganacagatcaccatcacttggccgggcgagtcgagggcagttaggtaaattgttcggcctggtatcgagacaagaaaccgagggtaaacttccaacctcctanatctatgctgactactcctattcgacgtaacgtttcggggtacccttcgtacgtactttccgagggtccggtacgtagggttcgggggtacgtacggggaactaaggtaacttaccaccttcctaccgaaccctactccgaacgaccgacgtccgtcgaccacgtaccgtagtaacgtagttgttacgtacttaaacttagttaacttagtaaactaaaagttcgaacgtacgtacgtaccggtaggtacgttcggttaccggaccgtaacgggaacgtaacggtacgaacacgtaacgtaaacgtacgtacgtacgg

SEQ ID NO: 413860 - DNA, 726 bp, Homo sapiens
  misc_feature: GZ8MTXP02H4GT4.25.28.C06.1.454.CMB.2.raw
  modified_base (286)..(286): a, c, t, g, unknown or other
  modified_base (295)..(295): a, c, t, g, unknown or other
  modified_base (317)..(317): a, c, t, g, unknown or other
  modified_base (347)..(347): a, c, t, g, unknown or other
tcagactgtacagtcacgaccggtgctcgatttagagctcacgtattgggtttgggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtgggagttcgtggggggagcggtgggtccagccgtagggaacgtccctgacgtactctcctggtgtggcgcctagactcaccttnagtagttanggtctttcgcgtggggtccccncgtagtcgccgagggacgaggggtcgtggngtcggtcgtagggtatttcgtggtctagaacgagaaccaagtcgaactattacgaccgacgggtcggtacgtccggtaggggaccggggtcctacttaccaacctacgtacccgtaccggaacggtaactaaacgtacccgaaacgtaaccgtaacccttactacgttacgtaacgaactaaagtacgtaaactaacgtagaacggtaggtacggtaacggtaacgttaacggttaccgtttaacgttacgttacggtaccgtaccgtaaccgtacggaacggtacgggtacggtaacggtaaacggtaaaacggttacggttaacgttaccgttacgtacccgttacccggtaccggtaaccgttaccgggtacgggg

SEQ ID NO: 413861 - DNA, 717 bp, Homo sapiens
  misc_feature: GZ8MTXP02INEGQ.25.28.C06.1.454.CMB.2.raw
  modified_base (176)..(176): a, c, t, g, unknown or other
  modified_base (243)..(243): a, c, t, g, unknown or other
  modified_base (277)..(277): a, c, t, g, unknown or other
  modified_base (286)..(286): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgcttcttttaagnggtgtccagtgtcaggcgcatctggtggagtcgtgggggaggcgtggtccagccgtgggaactcccngagactctcctgtgtggcgcctagactcaccttnagtagttanggtcttcgtcgtcgggtccgccagtcgtccagggcgaaggggctgggagtgggcgtggggtagtttacgttggtctagacagaaccaaatgaactatactccgacggcgggaacgttccgggtagggaaccgggggtccctaagtttccaaacccgtaacgtccgtacccggaacggggtaacctaaacgttacccgaaaacgtaaccgtaaaccccttacttaacgttacctagtaaacctaaaacgtaacgtaaaaccgtaaaccgtttaggaacggtaacggtaccgggtaaaggtaacgttaccggttaaccgttttaacgttacgttgtacgtaccgtaccgtacggacggtaggtaggacgtaaacggtaaagttacgtaacgttacgtttacgttacccgtacgtaccgtcggacgggtaccgg

SEQ ID NO: 413862 - DNA, 681 bp, Homo sapiens
  misc_feature: GZ8MTXP02IIZ8J.25.28.C06.1.454.CMB.2.raw
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatcgtggtggaggtcgtggggggaggcgtggtccaggccgtgggaactccctgagactctcctgtgtggcgcctagactcacttcagttagttatggtcttcgtcgtcgggtcccgccgtagtcgtccgagggcgaaggggctggagtggcgtggggtagtttacgtggtctgacagtaaccaaatgaacatactacgacggcggggacgtcccgggtaggggacgggggtccctattccgaacctactcctacccgaaggggaaacctaacgttacccgaaaagaaccgtaaacccttacttaactactacgaaactaaaacgttaacgaaaactaacgttaggaaggtaacggtaccggtaaggtaacgttaccgggttacgttttaagtacgttcggtcgtaccgtaacctgacgggtaggtacggtacgtaaaggtaacgtcgtaacgtctacgtacgttcccgtacgtaccgtcggtacggg

SEQ ID NO: 413863 - DNA, 614 bp, Homo sapiens
  misc_feature: GZ8MTXP02IX0R9.25.28.C06.1.454.CMB.2.raw
  modified_base (209)..(209): a, c, t, g, unknown or other
  modified_base (233)..(233): a, c, t, g, unknown or other
  modified_base (388)..(388): a, c, t, g, unknown or other
  modified_base (423)..(423): a, c, t, g, unknown or other
  modified_base (465)..(465): a, c, t, g, unknown or other
  modified_base (482)..(482): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatggtggcatccagatcgacccagtcctccacttcctccctgtctgctattctggttgganacagactcacatcacttggccggnagtcgagggctagttaggtaaatttgttcggccttggtaactcgacgacaacggaaaaccgaggggtaaaacctttccctaaaccctcctactacttctagtcgctcgacctacttacctatttacgacgttaacggtttccggggtaccccttntacggtattcgaggcggtacgtaggttcggggtanagggaacctaagtacttccactctacacatccagctacgccngacgacgctagaagttnttagtactaacttatttactacgttaagtaaacttaaagtcgaacgtacgtacggtacggtggtacgttacggtaccggaccggaacggtaacgaaggtacgtaactaacgtaacgaacgtcggtacgtacg

SEQ ID NO: 413864 - DNA, 563 bp, Homo sapiens
  misc_feature: GZ8MTXP02FZYPA.25.28.C06.1.454.CMB.2.raw
  modified_base (298)..(298): a, c, t, g, unknown or other
  modified_base (365)..(365): a, c, t, g, unknown or other
  modified_base (437)..(437): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtctgggggagcgtggtccagcctgggaatccctgagactctcctgtgtggcgcctagactcaccttcagtagttatggcttcgtctgggtccnccagtgtccaggcaaggggctgggagtggctggggagttacttggtctgacagaccaaatgacatancacgcggagtccgtggagggccgattcacatctcagggacaattaccaagacgaaccctctatctgacaaanagaacaacttagaggagtacgaaggactacggtaccgtttattacgtgtcgtcgacgtcgaggagtcggacgtaacggaaaaggtcgtaagtctacgtacttcccggtacgtaccgtacgtcgggg

SEQ ID NO: 413865 - DNA, 577 bp, Homo sapiens
  misc_feature: GZ8MTXP02FSDAR.25.28.C06.1.454.CMB.2.raw
  modified_base (370)..(370): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaagtccctgagactctcctgtgtggcgcctagactcaccttcagtagttatggctttcgtcgtcgggtcccgccagtcgtccagggcaaggggctggagtggctggggattacgttggctgacagacaaatgacatancacgcggagtccggtggacggggcctattccaccatctccgagggacaattaccgaaagacgaaccctctactctagacaaatagaaactaacgttagaagtagtacgaaggtacgtacggtaccgtttatacgtgtcgcgacctcgaggagtggacgtaaggaaagtcgtaagtctacgtacttcccgtacgaccgtcgtacgggg

SEQ ID NO: 413866 - DNA, 535 bp, Homo sapiens
  misc_feature: GZ8MTXP02G6M2O.25.28.C06.1.454.CMB.2.raw
  modified_base (201)..(201): a, c, t, g, unknown or other
  modified_base (223)..(223): a, c, t, g, unknown or other
  modified_base (244)..(244): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggcctcccagctatcagatgtggcatccagatgacccagtctccatcctcctgtctgcatctgttgganacagatcacatcattggccggnagtcagggcagttggaaattnttggcctggtatcgagcaaggaaaccaggggtaaactttccctaaccgtcctcaattctagtgtctgactatcctacttgaccttagtttcggggtccctctcgattcgagcggtacaggtgggtctagggacagtatcactctacacctatcacgcacgctgactacgcctagaagtattgtacgactaaacgtttattacgtagtaactaaaagttgaacgtagtcgtaacggtgtacgtcggttccgaccgaggaccgaaggacgaacacgacgaacgacgtagtacg

SEQ ID NO: 413867 - DNA, 677 bp, Homo sapiens
  misc_feature: GZ8MTXP02FG5OE.25.28.C06.1.454.CMB.2.raw
  modified_base (259)..(259): a, c, t, g, unknown or other
  modified_base (381)..(381): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagactctcctgtgtggcncctagacctcaccttcagttagttatggtccttcgtctcgggtcccgccagtcgtaccagggcgaaggggctgggaggtcggcgtggggagttacgttggctgacagaaccaaatgacatanccacggtcggacgtccggtggacgggggccgtattaccgaccactcctaccggaagggaacctaaagttacccgaaagaaccgaaaccccttactaactactagaactaaaatacgaaaccaacgttagaagggtagtaccggaagtacgttaaccgggttaccgtttaattaccgtagtacggtacccgtaccgtacggaacgggtacgggtaggtaccgtaaaagggtaaaaacggttcggttaacgtacttaccgtaaccttccccggttaccgaacccgtcggtaccggggg

SEQ ID NO: 413868 - DNA, 593 bp, Homo sapiens
  misc_feature: GZ8MTXP02FUZ6H.25.28.C06.1.454.CMB.2.raw
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcggtggtccagcctgggaatccctgagactctcctgtgtggcgcctagactcaccttcagtagtatggtcttcgtctgggtccgccagtgtccaggcgaaggggctgggagtggcgtggggagttcgttggtctgacagaccaaatgaacatactcacgcggagtccggtggacggggccatcacatctacaggacaactacaagacgaaccctctactactgacaaatacgaaactaacgtagaaggagtacgaggtacgtacggttaccgtttagttactggtacgccgtaccgtacgaggtacggtacggtacgtaaggaaaacgtacggtaacgttctacgtacgttcccgtaccgtaccgtacgtcggggg

SEQ ID NO: 413869 - DNA, 618 bp, Homo sapiens
  misc_feature: GZ8MTXP02JEAPR.25.28.C06.1.454.CMB.2.raw
  modified_base (327)..(327): a, c, t, g, unknown or other
tcagactgtacagtcacgaccggtgctcgatttagagctcacgtattgggtttttggggggaagaggaagactgacggtcctcccaggagttcaggtgctgggcaccttgggcacgggggaggcgtggtccagcctgggaagtccctgagactctcctgtgtggcgcctagactcaccttcagtagttatggcttcgtctgggtccgccagtgtccaggcaaggggctgggagtggctgggagttacttggtctgacagacaaatgacatatcacgcggagtccgtgagggccatcaccatctcaggacaatccaagacgaaccctntatctgacaaatgaaacaacgttgaagagtccgaggactacggtccgtttatactgtcgcgtacctcgaggtagtggactaaggaaaagtcgtagtctctacttcccgtacaccgtcgtcggggccacgggccaacccgtcggtccgacccgtcctacctcgacgtccgttacccgaaccgaccgggccctacgtccggtcccgttcccccgtcggcccgtcccgtcgcccttaccgacggaccgccacccgtcggtccgggggaccaccggcgcccggcccgtcggtccg

SEQ ID NO: 413870 - DNA, 628 bp, Homo sapiens
  misc_feature: GZ8MTXP02JR6ZG.25.28.C06.1.454.CMB.2.raw
  modified_base (256)..(256): a, c, t, g, unknown or other
  modified_base (297)..(297): a, c, t, g, unknown or other
tcagactgtacagtcacgaccggtgctcgatttagagctcacgtattgggtttgggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtctgggggagcgtggtccagcctgggaacgtcccgagactctcctgtgtggcncctagactcaccttcagtagttatggcttcgtctgggtccnccagtcgtccaggcaaggggctgggagtggcgtgggagttactggtctgactagacaaatgactatactcgacggcggtagtccgtaggacgggggtcccagttcaccctatcctaccgaggggaacaacgttaccaaacgacgtaacccctcttaactcctacgacctaaaagtcggtaaaacctaacgttagaacgtaggtacggaaggtacgtaacgggtccgtttaagttaccgtagtacgcgaccgttcgaggtacggtaggacgtaggtaaaacgtcgtaacgtctacgtacgttcccggtacgtaccgtcggtcgggtacccgg

SEQ ID NO: 413871 - DNA, 625 bp, Homo sapiens
  misc_feature: GZ8MTXP02HN23P.25.28.C06.1.454.CMB.2.raw
  modified_base (305)..(305): a, c, t, g, unknown or other
  modified_base (392)..(392): a, c, t, g, unknown or other
  modified_base (411)..(411): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggagcgtggtccagcctgggaacgtccctgagactctcctgtgtgcgcctagactcaccttcagttagttatggctttcgtcgtggggtcccnccgagttcgtcccgagggcgaagggggctggggagtggcgttggggtactttacgttgggtcctgactagaaccaaagtgacattanccacggcgggagttccggnggacgggggccctattccaccatcctaccgaggaacaacttaccgaaagacgaaccctctactctacgacaaatagaactaacgtagagagtacgaggtacgtacgtacgtttagttacgtacgtcgtcgtaaccgtcgaagggtacgtcggtacgtaaggtaaaacgtcgtaagtcgtacgtacgttcccgtaccgtaccgttcggtaccggg

SEQ ID NO: 413872 - DNA, 602 bp, Homo sapiens
  misc_feature: GZ8MTXP02JO48U.25.28.C06.1.454.CMB.2.raw
  modified_base (302)..(302): a, c, t, g, unknown or other
  modified_base (374)..(374): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagccgtgggaagtccctgagactctctgtgtggcgcctagactcaccttcagtagttatggcttcgtctggggtcccnccagtcgtccagggcaaggggctggagtggcgtgggagtttacttggtctggacagaaccaaatgaacatancacggcgggagtccggtggacgggggccccagtttccaaccgtactccgtacccgaagggacaaacttacccgaaagaccgtaaccctactaatcctagactaaatacgaaactaacgttagaagagtacgaggagtaacggtcgtttaattacgtgtcgcgacctagacggagtagacgtaggaaaacgtcgtaagtctacacgttcccgacgtaccgtcgtcgggg

SEQ ID NO: 413873 - DNA, 620 bp, Homo sapiens
  misc_feature: GZ8MTXP02FQ96J.25.28.C06.1.454.CMB.2.raw
  modified_base (283)..(283): a, c, t, g, unknown or other
  modified_base (346)..(346): a, c, t, g, unknown or other
  modified_base (429)..(429): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggcgttttggctgagctgggttttccttgttgctgttttaaaaggtgtccagtgtgaggtgcagctggcggagtctggaggaggcctgatccagccgtgggggtccctgagactctcctgtgcacgcctcgtgggttcagtcgttagtcacngctactgatcgtgggtcccgccaggctccgaggggagggctggagtgcgtctctagttattanagccgtataacaccactactacgcagacctcggtagaacgggctatttcctatctcagacaacattcccgaagaccacccttntactactacaacgtcgaccgcctagacgacgacggacggaccgtaccggtacgtagttacgttacgtgggtcgggacggggacggggtaataaacgttacggtttaaggtttacggtttactttacggtaactttaacccgttaccgtttacccgtacgggttccgggtacccgttcgggtttaccctcgg

SEQ ID NO: 413874 - DNA, 591 bp, Homo sapiens
  misc_feature: GZ8MTXP02GR5LZ.25.28.C06.1.454.CMB.2.raw
  modified_base (457)..(457): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagatatcagatgtggcatccagatgacccagtctccatcctccctgtctgcatctgttggagacagagtcaccatcacttggccgggcgagtcgagggcagttaggaaatttagttcggcctggtatcagacaagaaaccgagggtaaacgttaccctaacctcctacatctatgctgactactcctactttccgacgttaacgtttcggggtccccgttcttcgtacttcgacggcggacgtagggttcggggtcgtaggggaactaagtacttaccactctacaccatcacgcagcctgacacgtcctagaacgtnttacggttacacttaatttagttaccttaagttaaacttaaaagtttgaccgtagtaccggtaccgtagtacggttcgtaccgggacccgtaagggaccgaagggtcgaacaacgtacgaaacgtgtacgtacg

SEQ ID NO: 413875 - DNA, 567 bp, Homo sapiens
  misc_feature: GZ8MTXP02FGXR4.25.28.C06.1.454.CMB.2.raw
  modified_base (365)..(365): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagtagtatggcttcgtctgggtccgcagtgtccaggcaaggggctggagtggctggggattacgttggtctgacagaccaaatgacatancacgcggagtccggtgacgggggccattccacactctaccgacgggacaattcccaagacgaaaccctactatactgacgaaatagaacaacgttagagagtacgaggatacggtccgtttatacgtgtcgcgacctcgaggaggtcggacgtaggaaaagtcgtaagtctactacgttcccgtacgaccctcgtaccgggg

SEQ ID NO: 413876 - DNA, 618 bp, Homo sapiens
  misc_feature: GZ8MTXP02GTFXZ.25.28.C06.1.454.CMB.2.raw
  modified_base (302)..(302): a, c, t, g, unknown or other
  modified_base (392)..(392): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagttagttatggctttcgtctgggtccnccagtgtccagggcaaggggctgggagtggcgtggggtagtttacgttgggtctgacagaaccaaatgacatatcacggcggagtccggnggacggggccattccaccatctccgagggacaacttccaagacgaaccctctatctagacaaatacgaaactaacgttagagagtacggaggaacgttaccgggtacgttttaagttacgtggtacgaccgtaccgtacgagggtacggtacgggaccgtaaagggtaaaacgttcggtaacgttcctacgtacgttccccggtacgtacccgttcggtaccgggg

SEQ ID NO: 413877 - DNA, 537 bp, Homo sapiens
  misc_feature: GZ8MTXP02JX6QE.25.28.C06.1.454.CMB.2.raw
  modified_base (227)..(227): a, c, t, g, unknown or other
  modified_base (248)..(248): a, c, t, g, unknown or other
  modified_base (336)..(336): a, c, t, g, unknown or other
  modified_base (421)..(421): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgaccaagtctccatcctccctgtctgcatctgttggagacagagtcaccatcacttggccgggngagtcagggcattggaaattnttggcctggtatcagcaagaaaccaggggaaacttcctaacctcctcatctatgctgcatcctatttcgactagtttcggggtccctntcgattcgacggcggctaggtggggtctaggggacagtaacttcgactctcaccatcagcagcctagcagcctagaagatggttnactaacttattactagtaactaaaatttgaactagtacgaccgttggacttcggttaccgacccgtaacggggaccgtaagggtcggaacacgtaccgaaaacgtacgtggtacgg

SEQ ID NO: 413878 - DNA, 548 bp, Homo sapiens
  misc_feature: GZ8MTXP02IOBC2.25.28.C06.1.454.CMB.2.raw
  modified_base (259)..(259): a, c, t, g, unknown or other
  modified_base (300)..(300): a, c, t, g, unknown or other
  modified_base (379)..(379): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaatccctgagactctcctgtgtggcncctagactcaccttcagtagttatggctttcgctgggtccncagtgtccagggcaaggggctggagtggctgggagttactggtctgacagaaccaaatgacatatcacgcggatccggngacggggcctatcacatctcgagacaatccaaagacgaacctactatactagacaaatagaactaattagagagtcgagagtacggtactttatacgtgtcgcgactcgaggagtacggagtaacggtaaaagtcgtaagtctactacgtaccgtcaccgttcgacggg

SEQ ID NO: 413879 - DNA, 599 bp, Homo sapiens
  misc_feature: GZ8MTXP02IQNAL.25.28.C06.1.454.CMB.2.raw
  modified_base (282)..(282): a, c, t, g, unknown or other
  modified_base (301)..(301): a, c, t, g, unknown or other
  modified_base (463)..(463): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctggggaagtccctgagactctctgtgtggcgcctagactcacttcagtgttanggtcttcgtctggggtccnccgagtgccagggcagggggctgggagtgggctggggtagtttacgttggtctgaacaggaccaaatgaacatatccgacgcgggtatcccggtgggacggggcccgtattcaaccgatccgtaccgagggacaacttaccaaagcgaaaccctctactacngacaaattacgaaactaacttggaagagtacgaggtatacggtacgtttagtacgtgtcgacgtaccgtcgaggtagtggacgtaacggtaaaagtcgtaagtctctacgttcccggtacgtaccgtcggtcgggg

SEQ ID NO: 413880 - DNA, 605 bp, Homo sapiens
  misc_feature: GZ8MTXP02ITF56.25.28.C06.1.454.CMB.2.raw
  modified_base (304)..(304): a, c, t, g, unknown or other
  modified_base (362)..(362): a, c, t, g, unknown or other
  modified_base (466)..(466): a, c, t, g, unknown or other
  modified_base (546)..(546): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctgggtggagtcgtgggggaggcgtggtccagccgtgggaactccctgagctctctgtgtggcgctagactcacttcagtagttatggctttcgtctcggggtccnccagtcgtccgagggtcgaaggggctagggagtgggcgtggggtatttacgttggtcngaactagaaccaaaatgactatactccgacggcggtagtccggtggacggggccgtaattccgaactagtcaccgagggaactaagttaccgaagacaaccctntactctagacaaagtacgaaactacgttagagtagacgaggattacggtacgtttatacgtgtagccgtactgaggtagnggtacgtaaagtaaacgtcgtaagtcctactacgttcccgacgtacctacggccggggg

SEQ ID NO: 413881 - DNA, 673 bp, Homo sapiens
  misc_feature: GZ8MTXP02JA3KL.25.28.C06.1.454.CMB.2.raw
  modified_base (278)..(278): a, c, t, g, unknown or other
  modified_base (307)..(307): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccaggccgtgggaacgtccctgagactctcctgtgtggcgcctagactcaccttnagtagttatggtcttcgtcgtcgggtccncctagtcgtccagggcgaaggggctggaggtggcgtggggtattacgttggtctgaacagaacctaaagtcgaactatataccgacggcggggtaacgtccgggtaggacgggggccctattccgacctacgtcctaccgacgggtaacctaaacgttacccgaaacgaaccgtaaccccttacttaactactacgaaactaaaactacgtaaaacctaacgttaggaacggtacgtacggaaggtacgtacggttaccgtttattacgtgtacgtaccgtaccgtacgacgggtagttaggtacgtaaaggtaaaacgttcgtaacgtctacgtacgttcccgtacgtacccgtcggtaccgggg

SEQ ID NO: 413882 - DNA, 791 bp, Homo sapiens
  misc_feature: GZ8MTXP02GA6WR.25.28.C06.1.454.CMB.2.raw
  modified_base (281)..(281): a, c, t, g, unknown or other
  modified_base (288)..(288): a, c, t, g, unknown or other
  modified_base (307)..(307): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttggctgaacttgggttttcctcgttgctcttttaagaggtgtccagtgtcaggcgcatcgtgggtggagtcggtggggggaggcggtggtccaggtccgtgggaacgtccctgacgactctcgtgtgtgcgctagctcacttnagtagtntggtcttcgtctcgggccncagtcgccgaggcgaaggggctgggagtggcgtggggtatttcgttggtctagaactagaaccaaagtcgaactagtacgaccgaacgggccggtacggtccggggtagggaaccgggggtccctaattcccgaacctacgttcccgtaaccggaaacgggtaacctaaaccgttacccgaaaacggtaacccgtaaaccccttactaacttaccgtaagaaacctaaaacgttacgaaaacccgttaacgttagggaaagggtacggtaaaccgggtaaaggttaaccggttaacccgggtttacgttttaaacgttaacccggttggttacccggttacccggaaccgttacggggtaaacgggtagggttaaaccgggtaacggttaaaaacgggggtaaaaacgttcggtttaaccggttacccttaacgttacccggtttaccccggttccggtaccccggtttacgggtacccggggg

SEQ ID NO: 413883 - DNA, 774 bp, Homo sapiens
  misc_feature: GZ8MTXP02GUADQ.25.28.C06.1.454.CMB.2.raw
tcagactgtacagtcacgaccggtgctcgatttagagctcacgtattggggtttggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagccgtagggaacgtccctgagactctcctgtgtggcgcctagactcaccttcagtagttagtggtctttcgtcgtcggggtcccgccaggttcgtcccgagggccgaaagggggctaggggaggtggcgttggggtagtttacgttggtcctggaactagaaccgaaatcgaactatacgtcgaacggcgggtaacgtccggtaggacgggggtccgtaattccgaaccctactccgtaccgaacgggtaactaaacgttaacccgaaacgaaccggtaaacccctacgttaaactacctacggtaaactaaaacgttaacgaaaaccgttaaaccgtttaaggaaagggtaacgttaaccgggaagggttaaacgttaaccgggttaccgttttaaacgtttacgttacgttacggtaccgtaaccgttacgtaacggggtaaggttacgggtaaccgttaaaggtaaaaacggttccggttaaacgttacccgttaccgtaacgtttcccccggtaaccgtacccggttaccgttaccccggggg

SEQ ID NO: 413884 - DNA, 602 bp, Homo sapiens
  misc_feature: GZ8MTXP02GZLRN.25.28.C06.1.454.CMB.2.raw
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggaggcgtggtccagcctgggaatccctgagactctcctgtgtggcgctagactcaccttcagtagttatggctttcgtcgtcggggtccgccaggtgtccagggcgaaggggctggagtggctggggtattacgttggtctgactagaaccaaatgaacatacgtcacggcggagtccggtggacggggccctattccacccatcctaccgaagggacaacttaccgaaagacgaaccctctactactagaacaaatagaactacgttagagtagtacgaggactacggtactttaatacgtcgtacgcgacctacgacgggagtcgggacgtaaggtaaaagtcgtaagtccgtactacgttcccgtacgtacccgtcggtaccgggg

SEQ ID NO: 413885 - DNA, 583 bp, Homo sapiens
  misc_feature: GZ8MTXP02HNBIA.25.28.C06.1.454.CMB.2.raw
  modified_base (256)..(256): a, c, t, g, unknown or other
  modified_base (295)..(295): a, c, t, g, unknown or other
  modified_base (360)..(360): a, c, t, g, unknown or other
  modified_base (374)..(374): a, c, t, g, unknown or other
tcagactgtacagtcacgaccggtgctcgatttagagctcacgtattgggtttgggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggagcgtggtccagcctgggaatccctgagctctcctgtgtggcncctagactcaccttcagtagtatggcttcgctgggtccncagtgtccaggcaaggggctaggagtggctggggtattacttggctgacagaccaaatgacatancgagcggagtccgnggacggggcctagttccaaccatcctacccgaagggacaacttaccgaaagaccgaaccctctactactagacaaatgaaactaacgttgagagtacgaaggtacgtacggtcgtttattacgtgtcgtacgactcgacggagtacggacgtaaggtaaaacgtcgtaacgtactacgtacgttacccgtacgtaccgtacgtccgggg

SEQ ID NO: 413886 - DNA, 600 bp, Homo sapiens
  misc_feature: GZ8MTXP02GJRJ7.25.28.C06.1.454.CMB.2.raw
  modified_base (300)..(300): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatcgtggtggagtcgtgggggagcgtggtccagcctgggaactccctgagactctctgtgtggcgctagctcaccttcagtagttatggtcttcgtcgtgggtcccnccagtgtccaggcgaaggggctgggagtggcgtggggtagttacgttgggtctgaacagaaccaaaatgacatactcgacgcggtacgtccggtaggacggggcctattcaccactctaccgaggtacaattaccgaaagaccgaacctctactcgtagaactaaatacgaaactacgttagacgtagtacgagacgttacggtacgtttatacgtgtcgacgtacctagacggtagtacggacgtaaaggaaacgttcgtaagtctacgttaccgtacccgtacgaccttcggaccggg

SEQ ID NO: 413887 - DNA, 644 bp, Homo sapiens
  misc_feature: GZ8MTXP02JKXHY.25.28.C06.1.454.CMB.2.raw
tcagactgtacagtcacgaccggtgctcgatttagagctcacgtattgggtttgggggcagaagtctctctcagtcaggacacagcatggacatgagggtccctgctcagctcctgggactcctgctgctctggctccagctatcagatgtggacatccagatgaccaagtctccatcctcctgtctgctattctgtacggagacagactcaccatcacgttcggccgggtagagtcgagggactagttaggtaaattgtcgggacctggtactccagaccgaagaaaaccgagggtaaaacttcctaaaccctcctatactaccgtatctctactctactacttacgttcgacgttacgttcggtcctctacgtatcgacggcggtagtacgggttcgggtacgtaggaactaagttacttacctactcgtaactaaccgatacgacgtaccgacgtccgtacgtacgacgtacgtagtagtacgttacgtacgtaacttaacgtttaacttaacgttaacgttaaacgttaaagttaacgtaacgtaacggtacggtacggtacggtacgttacggtaccggaccggtaacggaacggtaacggtaacgaacgtaacgtaacgtaaacgtacgtacggtacg

SEQ ID NO: 413888 - DNA, 612 bp, Homo sapiens
  misc_feature: GZ8MTXP02IO6IP.25.28.C06.1.454.CMB.2.raw
  modified_base (201)..(201): a, c, t, g, unknown or other
tcagactgtacagtcacgaccggtgctcgatttagagctcacgtattggggtttgggggcagaagtctctctcagtcaggacacagcatggacatgagggtccctgctcagctcctgggactcctgctgctctggctcccagctatcagatgtggcatccagatgaccaagtctccatcctcctgtctgcatctgttgganacagacgtcacatcacgttggccgggcgagtcgaggggctaagttaggtaaatttgttcggcctaggtatcgaagcaaagaaaccgaggggtaaacttccctaaacctcctatactctatgactgctactcctattcgacgttacgtttcggggtacccttgtacgtattccgagtccggacgtagggtgggtcgtagggactagtactcgactctacactatcacgcacgtcctcgacgtacgccgtagagtatgtacgactaatttacttactagttaactaaaagttcgaactacggttaccgacggttacggtaacgttccgggttacccggaccggtaaacggggtacccgtaaggggtaacggaaccgtaacgtaaccgtaaaaccggtacggtttacggtacgg

SEQ ID NO: 413889 - DNA, 606 bp, Homo sapiens
  misc_feature: GZ8MTXP02IHTFI.25.28.C06.1.454.CMB.2.raw
  modified_base (178)..(178): a, c, t, g, unknown or other
  modified_base (196)..(196): a, c, t, g, unknown or other
  modified_base (264)..(264): a, c, t, g, unknown or other
  modified_base (278)..(278): a, c, t, g, unknown or other
  modified_base (296)..(296): a, c, t, g, unknown or other
  modified_base (305)..(305): a, c, t, g, unknown or other
  modified_base (388)..(388): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagnggtgtccagtgtcaggcncatcgtggtggagtcgtggggggagcgtggccaggccgtgggaactcctgagactctctgtgtggccnctagactcaccttnagtagttatggctttcgntcgggtccncagtcgccaagggcaaggggtctgggagtgggcgtttaggggtatttacgtggtactggaacagaaccaaaatcgaacatacncgaacgcgggtatccggtaggacgggcctataccacatcacgaggacaactacaagacgtaacctctatacagacaaatacgaaactaatacgaagacgtagaacggtacgtacggtacgtttatacgtgtacgtacgtacgtacgacggtagtacggtacgtaaaggtaaaacgttcgtaacgtctacctacgtacccgtcgtaccgtcggaccggg

SEQ ID NO: 413890 - DNA, 765 bp, Homo sapiens
  misc_feature: GZ8MTXP02IF6LV.25.28.C06.1.454.CMB.2.raw
  modified_base (258)..(258): a, c, t, g, unknown or other
  modified_base (273)..(273): a, c, t, g, unknown or other
  modified_base (282)..(282): a, c, t, g, unknown or other
  modified_base (304)..(304): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttggctgaactgggttttcctcgttgcttcttttaagaggtgtccagtgtcaggcgcatcgtggtggagtcgtggggggagcgtggtccagccgtgggaatccctgagctctctgtgtggcncctagactcaccttnagtagttanggctttcgtcgtcggggtcccnctagtcgaccgagggacgaggggctagggagtggcgtggggtatttacgtggtctagaacagaacctaaagtcgaactatacgtaccgacggtcgggtacgtccggtaggggacggggtcctattaccaaccctacgtccgtaccggaacggtaacctaaacgtaacccgaaaacgtaacccgtaaacccttacgttaacttacgtaacgaaacgtaaaacgtaacggtaaaaccttaaacgttacggaacggtaacggtacgggtaaacggttaacgttaaccgggtttaccgttttaacgttaccggttacggttaccggtaaccggtaacccgtacggtaacgggtaacgggtaacgggttaaacggtaaaacggggttaaaacgttaccggttaacgttacccgttaccgttaacccgtttaccccggtaccggttacccgtaccggggtaccgggg

SEQ ID NO: 413891 - DNA, 735 bp, Homo sapiens
  misc_feature: GZ8MTXP02JR15J.25.28.C06.1.454.CMB.2.raw
  modified_base (300)..(300): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaacgtccctgagactctcctgtgtggcgctagctcaccttcagtagttatggcttcgtctgggtcccnccagtgtccagggcgaaggggctgggaggtgggcgtggggatttacgttggtctgacagaccaaagtgactatatcgacggcgggagtcccgggtagggacggggggtccctaagtttcccgaaccctacttcccgtacccgaacgggggaacctaaacgtttacccgaaaggtaacccgtaaacccccttacttaacttaccgttacgaaacctaaaagttacggaaaacctaacgtttaggaagggtaacggtacggaacgggtaacgttaccggggttaaccgttttaacgtttacgtcggtacggtaccgtaacccgtccggtaaacggggtaggttacggggtaccgttaaaaggggtaaaaacgttcggtaaacgttccgtaccgttaccgttcccggttaccggtaacccgttccggttacccggggg

SEQ ID NO: 413892 - DNA, 621 bp, Homo sapiens
  misc_feature: GZ8MTXP02JLONQ.25.28.C06.1.454.CMB.2.raw
  modified_base (303)..(303): a, c, t, g, unknown or other
  modified_base (364)..(364): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggaggcgtggtccagcctgggaagtccctgagactctcctgtgtggcgcctagactcaccttcagtagttatggctttcgtctgggtccncagtgtccaggcaaggggctggagtggctggggattctggtctgacagaccaatgacatancgacgcgggatccggtaggacgggggcctattcaccactccgtaccgagggacaacgttaccaaagacgaacccttactaatctagactaaatacgaaactaacgttagaagagtacggaggtaacgtaccggtacgtttacgttacgtgtacggaccgtaccgtcggacgggtaggtacggtaccgtaaagggtaaaacgttcggtaacgtcgttaccgtacgttaccccggtaccgtacccggtcggtccggggg

SEQ ID NO: 413893 - DNA, 701 bp, Homo sapiens
  misc_feature: GZ8MTXP02JIR7C.25.28.C06.1.454.CMB.2.raw
  modified_base (265)..(265): a, c, t, g, unknown or other
  modified_base (291)..(291): a, c, t, g, unknown or other
  modified_base (369)..(369): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttggctgaactgggttttcctcgttgctcttttaagaggtgtccagtgtcaggcgcatcgtggtggagtcgtgggggagcgtggtccagcctgggatcctgagactctctgtgtgcgctagctcacttnagtatatggcttcgtcgtcgggtccncagtcgtccgagggcgaaggggctggacgtgggcgtggggtatttacgttggtactgaacagaaccaaagtgacatancgacggcgggtacgtccggtagggacggggtcccgtaatttcccgaaccgtactccgtacccggaagggaacctaaacgtttacccgaaaagtaacccgtaaaccccttcgttaactaccgtacgtaaaccgtaaaacttaacgaaaaccttaaacgttaggaaacggtaacggtaccggaagggtaaccgttaccggttaaccgtttttaacgtaacgttgggttacgaccgtacccgttggaaacggtagggttacggtaacgttaaagggtaaaacgttcgtaacgtccgtacgttacgttacccgtaccgtaccggtacggtccgggg

SEQ ID NO: 413894 - DNA, 680 bp, Homo sapiens
  misc_feature: GZ8MTXP02GLYES.25.28.C06.1.454.CMB.2.raw
  modified_base (260)..(260): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcncctagactcaccttcagtagttatggctttcgtcgtcgggtcccgccaggtcgtccagggcaaggggctgggagtgggctggggagtttacgttggtctggacagaaccaaatgaacatatcacggcgggagtccggtagggacgggggcccaagtttccaaccctatccgtacccgaagggaaccaaacgttacccgaaagacgaacccctactaactcctagaccaaaagttacgaaacctaaacgttaggaaggtaacggtaccggaaggtaacgttaaccgggttaccgttttaagtttaaccgtggtacgtaccggtacctacgaagggtacggtacgggtacgtaaagggtaaaaacggttcggtaagttcgtaccgtacgtttccccggtaccgtaccgttcggtaccggggg

SEQ ID NO: 413895 - DNA, 676 bp, Homo sapiens
  misc_feature: GZ8MTXP02JLVZI.25.28.C06.1.454.CMB.2.raw
  modified_base (307)..(307): a, c, t, g, unknown or other
tcagactgtacagtcacgaccggtgctcgatttagagctcacgtattgggtttgggggaggaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtctgggggaggcgtggtccagcctgggaagtccctgagactctcctgtgtggcgcctagactcaccttcagtagttatggcttcgcgtggtccgcagtgtccnggcaggggctggagtgggctggggagtttacttggtctgacagaccaaatgacatatcacgcggacgtcgtgagggggcgattcacccatctcccagggacaattcccaagacgaaccctactacgtactgtaccaaattacggaaactaaaccttgagaacggtcgtaacggggaattaacccgggtccggtttttaaactttaacgtttcgtacgggtacccggtaaccccgttaccgaaacggggtaacggggttaggggttacccggttaaacggggtaaaaaagggttaccggttaaccgggttacttacccggttacgttaccccccggttcgggtaaccccgtccccgggtttaacgggggg

SEQ ID NO: 413896 - DNA, 732 bp, Homo sapiens
  misc_feature: GZ8MTXP02IF10O.25.28.C06.1.454.CMB.2.raw
  modified_base (278)..(278): a, c, t, g, unknown or other
  modified_base (306)..(306): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcggtgggggagcgtggtccagccgtgggaactcctgagctctctgtgtggccgcctagactcaccttnagtagttatggtctttcgcgtggtcccncagtcgccagggcaaggggctgggagtggcgtggggtatttacgtggctgacaagaaccaaagtgaactatacgtccgacggtcggggacgttcccggtaggggaccgggggtacccttattacccaacccgtaacgttcccgtaacccggaacggggaacctaaacgttaacccgaaaacggtaacccgtaaacccccttacgttaactaccgtacgaaacctaaaacgttacggaaaaccttaacgttaggaacggtacggttaacggaaggtaacgttaaccgggttacgttttaagttaccgtaggtacgtaccgtaaccgtacggtaaggtacggttacggtaccgtaaaagggtaaaacgttcggttaacgttccgttacgttacccgttacccgtaccgtaccgttccggtaccggggg

SEQ ID NO: 413897 - DNA, 574 bp, Homo sapiens
  misc_feature: GZ8MTXP02H3K4E.25.28.C06.1.454.CMB.2.raw
  modified_base (263)..(263): a, c, t, g, unknown or other
  modified_base (287)..(287): a, c, t, g, unknown or other
  modified_base (304)..(304): a, c, t, g, unknown or other
  modified_base (396)..(396): a, c, t, g, unknown or other
  modified_base (413)..(413): a, c, t, g, unknown or other
  modified_base (417)..(417): a, c, t, g, unknown or other
  modified_base (440)..(440): a, c, t, g, unknown or other
  modified_base (445)..(445): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaacttgggttttcctcgttgctcttttaagaggtgtccagtgtcaggcgcatcgtggtggagtcgtgggggagcggtggtccagccgtgggaacgtccctgagactctcctgtgtggcncctagactcaccttcagtagttanggctttcgctgggtccnctagtgtccgagggcgaaggggctagggagtgggtcgtaggggtactttacgtggtctggacagaaccaaatgacatatcgacgcgagtcgngacggggccagtccacnctcncgaggacaatccaagacaacctnacttnagacaatacgaactaactgagacgtagaaggtacgtacggtcgttaattgtgacgtcgaccttgaacgtggtacgacgtaaggtaaaaggtcgtaagtctacgtacttccgtaccgacgttcgaccggg

SEQ ID NO: 413898 - DNA, 576 bp, Homo sapiens
  misc_feature: GZ8MTXP02FIT26.25.28.C06.1.454.CMB.2.raw
  modified_base (302)..(302): a, c, t, g, unknown or other
  modified_base (377)..(377): a, c, t, g, unknown or other
  modified_base (453)..(453): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagtagttatggcttcgtctgggtcccnccagtcgtccagggcgaagggggctggagtggcgtggggtagttacgttgggtctggacagaccaaatgacatancacgcggagtccggtggacggggccatccaccatctacgaggacaactaccaagacgaaccctctatctgacaaanagaaacaacgttagaagagtcgaggtatacggtacgtttatacgtgtcgcgtacctcgaggtagtacggacgtaaggaaaagtcgtaagtctacgtacttcccgtacgtaccgtcgtccgggg

SEQ ID NO: 413899 - DNA, 667 bp, Homo sapiens
  misc_feature: GZ8MTXP02HT4KI.25.28.C06.1.454.CMB.2.raw
  modified_base (260)..(260): a, c, t, g, unknown or other
  modified_base (274)..(274): a, c, t, g, unknown or other
  modified_base (283)..(283): a, c, t, g, unknown or other
  modified_base (300)..(300): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttggctgaactgggttttcctcgttgcttcttttaagaggtgtccagtgtcaggcgcatctggtggagtcgtgggggagcgtggtccagccgtagggaactccctgagactctcctgtgtggcnctagactcaccttnagtagttanggcttcgtctgggtccncctagtcgtccaggcgaaggggctgggagtggcgttggggactttacgtggtctagacaagaccaaaagtcgaactaatagtccgaacgggtcggggtaacgttcccggtaggggaaccgggggtccctaatttaccaaacccgtacttcccgtacccgaagggtaacctaaacgttacccaaaagtaccgtaaaccctctaactcgtagactaaatacgaaactaacgttagaagacgtacgagtaacgtacggtaccgttttataacgtcgtacgaccgtaccgttacgacggtaggtacggacgtaaaggtaaaacgtcgtaagttcctacgtaccgttacccgtcgtaccgttcggaccgggg

SEQ ID NO: 413900 - DNA, 737 bp, Homo sapiens
  misc_feature: GZ8MTXP02I9ON0.25.28.C06.1.454.CMB.2.raw
  modified_base (280)..(280): a, c, t, g, unknown or other
  modified_base (288)..(288): a, c, t, g, unknown or other
  modified_base (310)..(310): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatcgtggtggagtcgtgggggaggcgtggtccagccgtgggaacgtccctgacgactctcctgtgtggcgcctagactcaccttnagtgttanggtcttcggtcgtcgggtcccncctaggtcgtcccgagggccgaagggggtctgggagtgggcgttgggtagttacgttgggtctagaactagaacctaaagtgaactaattacgtaccgaacgggcgggtacgtccgggtaggacgggggccctattaccacccatccgtaccggaagggtaaacctaaacttaccgaaaacggtaaccgtaaaccccgttcttaaacgtccgtaggtaaacctaaaagttacgaaaccgttaaacgttacggtaacggaaacggttaccgggaaagggtaacggttaaccgggttaaccgttttacgtttaacgtcggttaacggtaccgtacgtaccgtagggtacggtacggtacggtaaacggtaaaacggtacgtaacgtcgttacctacgttacccggtaccggtaccgtccggttacgggg

SEQ ID NO: 413901 - DNA, 682 bp, Homo sapiens
  misc_feature: GZ8MTXP02I42SD.25.28.C06.1.454.CMB.2.raw
  modified_base (181)..(181): a, c, t, g, unknown or other
  modified_base (260)..(260): a, c, t, g, unknown or other
  modified_base (273)..(273): a, c, t, g, unknown or other
  modified_base (298)..(298): a, c, t, g, unknown or other
  modified_base (376)..(376): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtntccagtgtcaggcgcatctgggtggagtcgtgggggagcgtggtccagcctgggactcctgacgctctcctgtgtggcnctagactcacttnagtatatggcttcgtctcgggtccnccagtgtccgagggcaaggggctggagtggcgttggggatttacgttgggtctagaactagacctaaatgaacattanccacggcgggtacgtccggtagggaacgggggcctaagtttccacctacgttccgtaccgaacggggaaacctaaagttacccgaaaacgtaaccgtaaaccccttacttaacgtactacgaaactaaagtacgaaaacttaacgtagaacggtaggtacgaacgggtaacgttaccggttacgtttaagttaccgtagtacgaccgtaccctaggacgggtacgttggaccgttaaggggaaaacgttcggtaacgttcccgtacgttaccgttcccgtaccggtacccgttacggtcccggggg

SEQ ID NO: 413902 - DNA, 647 bp, Homo sapiens
  misc_feature: GZ8MTXP02II580.25.28.C06.1.454.CMB.2.raw
  modified_base (177)..(177): a, c, t, g, unknown or other
  modified_base (263)..(263): a, c, t, g, unknown or other
  modified_base (277)..(277): a, c, t, g, unknown or other
  modified_base (303)..(303): a, c, t, g, unknown or other
  modified_base (492)..(492): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaactgggttttcctcgttgcttcttttaagnggtgtccagtgtcaggcgcatcgtggtggagtcgtggggggagcgtggtccagccgtgggaagtccctgagactctctgtgtggcnctagactcaccttnagtagttatggtcttcgctgggtccnccgagttcgtccagggtaccgaaggggtctagggagtgggcgtaggggtactttacgtggtcctagacagaccaaaagtgaactatactccgaacgtcggggtacgtcccggggtaggggacggggtccctaatttccaaaccattccgaccgagggaactaaacgttaccaaagaccgtaaacccttntaactcgtagaacctaaataacgtaaacgtaacgttaggagtaagtcgaaggtacgtacggttacgtttatacgtgtcgcgtaactcggaggtaggtcgtacgtaaaggtaaaagtcgtaagtctacgtacgttccgtccgtacgtcggtacggg

SEQ ID NO: 413903 - DNA, 694 bp, Homo sapiens
  misc_feature: GZ8MTXP02HCR45.25.28.C06.1.454.CMB.2.raw
  modified_base (201)..(201): a, c, t, g, unknown or other
  modified_base (227)..(227): a, c, t, g, unknown or other
  modified_base (311)..(311): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccactcctcctgtctgcatctgttgganacagagtcactatcacttggccgggngagtcgaggggcagttaggaaatttgttcggccttggtatcagactaacgaaaccgaggggtaaaacttccctaaacctcctanatctatgctgctaacttcctaatttcgaccttaaggttttcggggtacccttcgttaccgaatttccgaacggtcgggtaccgtagggttcgggggttactacgggggaactaaacgtaactttcccgaacttccttaccaaccctaattccgaacggacctaacggccttggaccacggtaccctagggtaaaacgtacttcgggttagaacccctttaaaatttacgtttaaaccttaggttaaaccttaaaaagtttgaaaccgttaggtaccggtaaccggtagggttaaacgttccgggttaccgggaacccggaagggaacccgtaagggttacgaaaccgttacggaacctaaaacggtaccgtttaaggtaccgg

SEQ ID NO: 413904 - DNA, 614 bp, Homo sapiens
  misc_feature: GZ8MTXP02F488I.25.28.C06.1.454.CMB.2.raw
  modified_base (492)..(492): a, c, t, g, unknown or other
  modified_base (550)..(550): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagccgtggggaagtccctggagactctctgtgtggcgcctagactcaccttcagtagtatggcttcgtcgtcgggtccgccagtcgtaccagggcgaaaggggctggaggtggctggggatttacgttggtctgaacagaaccaaagtgacatatacacgcgggagttccggaggacgggggtcccgtattccaccgtatccgtaccgaagggaacaaacttaccgaaaacgacgtaaaccctctaactactacgacctaaaagtanaaaactacttagaagagtacgaggtactacgggtacctttattacgtgtcgcgtaccngaggagtggacgtaaggaaaagtacgtaagtctcgtaaacgtcccgtacgaccctcgtccgggg

SEQ ID NO: 413905 - DNA, 747 bp, Homo sapiens
  misc_feature: GZ8MTXP02IRQM9.25.28.C06.1.454.CMB.2.raw
  modified_base (302)..(302): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtggggagcgtggtccagcctgggaagtccctgagactctcctgtgtgcgcctagactcaccttcagtagttatggtcttcgtcgtgggtcccnccgtaagtcgtcccgagggtcgaagggggtctaggggagtgggcgtttggggtagtttacgtttgggtactaggaaccaggaacccaaaagtcgaactatactaccggaacgccggggaagttccggagggacgggggtaccctattacccgaacctaacgttcccgacccggtaaacggggaacctaaacgtttaaccccgaaaagtaaccgtaaaccccttacgtaaacttcgtaacgaactaaaacttacggaaaactaaacgttagaaacgtagtacggaagggtaacgttaccgggttacgttttaacgttacgtcgtacgtaccggtaaccgttcggaaacggtaggttaggtaaccggtaaaaggtaaaaacggttcgtaaacgttccgtaccttacccggtttaccgtacccgtaaccgtttccggggtacccgggg

SEQ ID NO: 413906 - DNA, 544 bp, Homo sapiens
  misc_feature: GZ8MTXP02IPICX.25.28.C06.1.454.CMB.2.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtcctccatcctccctgtctgcatctgttggagacagagtccaccatcacgttggcccgggcgagtcgaggggcattaggaaatttagtttggccttggtatcgagaccaacgaaaccgaggggtaaactttccctaaacctcctacactctatgctgactatcctattcgtctagtttcgggtccctctcgtagttcaggcgtcgagtcggggtgtgggactagtacttcactctacacatcagcacgctgcgtacgcctagagtgttggtcaacctaatttacttaacgtattaattaaaattgaactagtcgacgtgtacgtcgttacgaccgacggtacgaaggtacgaacgtacacgaacgtagtcgtag

SEQ ID NO: 413907 - DNA, 606 bp, Homo sapiens
  misc_feature: GZ8MTXP02J28X1.25.28.C06.1.454.CMB.2.raw
  modified_base (369)..(369): a, c, t, g, unknown or other
  modified_base (387)..(387): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggccagcctgggaactccctgagactctcctgtgtgcgctagactcacttcagtagttatggcttcgtctgggtccgccagtgtccaggcaaggggctggaggtggcgtaggggtgtttacgtggtctaggacaggaccaaagtgacatancgacgcgggagttccggnggacgggcctatcacactccgtacgacggaactaactacgaacgactaaccctactactactagactaaatacgaactaagttagaagtagtacgacggtacgtacggtacgtttacttacgtacgtacgtccgtaccgtagacggaggtacggacgtaaacgggtaaaacgtcgtaacgtactacgtaccgttacccgtaccgtaccgtacggtcggg

SEQ ID NO: 413908 - DNA, 644 bp, Homo sapiens
  misc_feature: GZ8MTXP02INMVJ.25.28.C06.1.454.CMB.2.raw
  modified_base (270)..(270): a, c, t, g, unknown or other
  modified_base (299)..(299): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctgggtggagtcgtgggggagcgtggtccagcctgggaactcctgagctctcctgtgtggcgctagctcacttnagtagttatggtcttcgtcgtcgggtccnccagtcgtccagggcaggggctggagtggcttggggtatttacgtggtctagacagaccaaatgacattacgtcacggcggggtagtcccggtagggaccgggggtcccgtatttccaacctactcgtacccgagggaacaacttacccgaaagaccgtaaaccctctactctagacaaatgaaactacgttaggagagtacgaggtacgttacggtcgtttagttacgtggtacgtacggtacctagaacgggtacggtacggtacgttaaagggtaaaacgttacggttaacgttcttaccgtaccgtttacccggtaccggttaacccgtacggtccggggg

SEQ ID NO: 413909 - DNA, 645 bp, Homo sapiens
  misc_feature: GZ8MTXP02GKSS0.25.28.C06.1.454.CMB.2.raw
  modified_base (213)..(213): a, c, t, g, unknown or other
  modified_base (285)..(285): a, c, t, g, unknown or other
tcagactgtacagtcacgaccggtgctcgatttagagctcacgtattgggtttgggctgagctgggttttcctcgttgctcttttaagaggtgtccagtgtcaggtgcagctggtgcagtctgggggagcgtggtccaccctgggaggtccctgagactctcctgtgcagcctctggattcatcttcaacacctatgcaatgcactgggtccnccaggcctccgaggcaaggggctgggagtgggtggctaggttattcatatgataggaaactaaataaaagtntgttagactcggtaggcgggcattcgaccgtctaccagacgacagactaccgaaagaagacggtgtatcctaccaaaatcaaaacacctagagactccgaaggaccacgctagtagttaattacgtgtcgacgaagaggtaacgtcgggcgacgacgggtacccgacccccgaagggtaacgtaccgggctaaccgttacgttcccggaactagtaacgggactacgttacgggagggggaccggaaaacgggaccccgagggtacctagtccgttcctcccgttcgtccgacccctaccgaaccggtaaacgggccctaacggttccccggtaccctttcccccgcgggtccctccccg

SEQ ID NO: 413910 - DNA, 792 bp, Homo sapiens
  misc_feature: GZ8MTXP02JHGGL.25.28.C06.1.454.CMB.2.raw
  modified_base (199)..(199): a, c, t, g, unknown or other
  modified_base (415)..(415): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgaccaagtctccatcctcctgtctgcatctgttganacagatcaccatcacgttcggccggagagtcgaggggctaagttagggtaaatttagttgggccttgggtaactacgaggacaaacggaaaccgaaggggtaaaactttcccctaaacctcctacaacttctaattcggacttcgacctacttacccttagtttccggtacttaacggtttttccggggtacccccttgtaccgttactttaccgngggtccggtacgtggggttcggggtactacggggaactaagttacttaccctaacttcctaacccaactaacgttccgaaacgttacccgaacttcccgacggtaccgtaaccggacccgtttaaagggaaaaccgtttggttacgggtttaaccgtaaccgttttaaaaacgttttaccgttaaaactttaaacgggtttaaaaccctttaaaaaagtttacggaaaacccgttaaacgggtacccggtttaaaccgggttacgggttaacgttaacccggggttcccggaaaaccccggggttaaggaaacccggtaaagggtaccggtaaacctaaaaggttaaacccggaaaaacgttccggtaacggtccgg

SEQ ID NO: 413911 - DNA, 582 bp, Homo sapiens
  misc_feature: GZ8MTXP02GUKOZ.25.28.C06.1.454.CMB.2.raw
  modified_base (259)..(259): a, c, t, g, unknown or other
  modified_base (372)..(372): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcncctagactcaccttcagttagttatggctttcgtctgggtccgccagtgtccaggcgaaggggctggagtggcgtggggagtttacgtggtctgacagaccaaagtgacatancacggcggagtccggtggacgggggccattccaccatctccgagggacaattccaaagacgaaccctctactctagacaaatagaaactaacgttagacgagtacgaggtacgtaacggtacgtttattactgtcgacgtaccgtcgacggtagtaggacgtaggtaaaagtcgtaagtcgtactacttcccgtcgtaccgtcgtcgggg

SEQ ID NO: 413912 - DNA, 819 bp, Homo sapiens
  misc_feature: GZ8MTXP02I9F72.25.28.C06.1.454.CMB.2.raw
  modified_base (262)..(262): a, c, t, g, unknown or other
  modified_base (285)..(285): a, c, t, g, unknown or other
  modified_base (303)..(303): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggaggcgtggtccagccgtgggaactcctgagactctctgtgtcggcnctagactcacttcagttagttangtcttcgtcgtcgggccncaggtcgtccgagggacgaacgggggctaggggaggtcgggtcggttaggggtaacgtttttacggttcgggtaccttggaaaccgtaaggaaaacccaaaagttacgaaactaaacggttactaacccggacgggtacggggtacggttcccgggtaagggggaccggggggaccccttaagtttaccccgaaacctaaacggtttccctaaccccgggtaaagggggaaaccttaaacctttaaaccccgaaaagggtaaacccgtaaaaccccctttagtaacttacccggtaaagtaaaactaaaacgtaaacgtaaaacgttaacgttaagggaacgggtaaacggtaacggtaaacggtaaacggttaaccggtttaacgtttaacgttaccgtagtaccggtaacccgtacgtaacggaaacgggtacgtacggtaaacgtaaaaacggtaaacgttacgtaacgtacctaaccgtacccgttacccgtacgtaccgtacgggtaccgg

SEQ ID NO: 413913 - DNA, 581 bp, Homo sapiens
  misc_feature: GZ8MTXP02IQ4CG.25.28.C06.1.454.CMB.2.raw
  modified_base (207)..(207): a, c, t, g, unknown or other
  modified_base (286)..(286): a, c, t, g, unknown or other
  modified_base (326)..(326): a, c, t, g, unknown or other
  modified_base (376)..(376): a, c, t, g, unknown or other
  modified_base (471)..(471): a, c, t, g, unknown or other
tcagactgtacagtcacgaccggtgctcgatttagagctcacgtattgggtttttggggggaagaggaagactgacggtcctcccaggagttcaggtgctgggcaccttgggcacgggggaggcgtggtccagcctgggaagtccctgagactctcctgtgtggcgcctagactcaccttcagtagttatggcttcgtctgggtccnccagtgtccaggcaaggggctgggagtggctgggagttacttggtctgacagacaaatgacatatcacgcggagtccgngaggggccatcacatctccaggacatccaagagaaccctntatctgacaaatgaaactaactgagagtaccgagatacgtcgttatctgngacgactcgagagtgacgtaggtaaaagtcgtagtctacgtacttcccgtacgtccgtacgtcggggccacgggccacccgtgtccaccgttccncctcacgcctccaccgacgggcccacgtccgtccgtcccctcggcccgtcctcgcctccgacgtaccgccaccgtcggtcggggacaccggcggcccggccgtcggtccg

SEQ ID NO: 413914 - DNA, 562 bp, Homo sapiens
  misc_feature: GZ8MTXP02GJOWK.25.28.C06.1.454.CMB.2.raw
  modified_base (200)..(200): a, c, t, g, unknown or other
  modified_base (345)..(345): a, c, t, g, unknown or other
  modified_base (435)..(435): a, c, t, g, unknown or other
tcagactgtacagtcacgaccggtgctcgatttagagctcacgtattgggtttggggcagaagtctctctcagtcaggacacagcatggacatgagggtccctgctcagctcctgggactcctgctgctctggctccagctatcagatgtggcatccagatgacccagtctccatcctccctgtctgccatcgtgttganacagatcacatcacttggccggtgagtcagggcattggaaacttgttggctggtatcagtcaagaaaccaggggtaaacttccctaaacctcctactattcctatcgacctgctatccctatttcgactaagtttcgggcccctntaccgattccgagcggctaggtcgggtacaggggactaagtaactttccgacttcacacctatccagcagcctgccaagcctagaacgtntacgtactactaacttattactagtaataaagttcgaacgtacgtacgtaccggtacgtacgtacggtaccgaccgtaacggtaccgaacggtacgaacgtacgtaacgaaacggtacgtacggtcg

SEQ ID NO: 413915 - DNA, 705 bp, Homo sapiens
  misc_feature: GZ8MTXP02JHC9S.25.28.C06.1.454.CMB.2.raw
  modified_base (276)..(276): a, c, t, g, unknown or other
  modified_base (304)..(304): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggaggcgtggtccagccgtgggaactccctgagactctcctgtgtggcgcctagctcaccttnagtagttatggctttcgtctgggtcccncagtcgtccgaggcaaggggctggagtggcgtggggtatttacgttggtctgaacagaaccaaatcgaactatatacgacggcggtacgtccggtagggacgggggcctaattccacctacgtccgtacccgaagggaacctaaacttacccgaaagacccgaacccttactaacgtacctacgaaactaaagtacgtaaaacctaacgttagaagggtaacgttaccggaaggtaacggttaccgggttaccgttttaaacgttacgttacggtacggtaccgtacccgttaggaacggggtaggttacgggtaacgtaaaaccgggtaaaagttccggtaaacgttaccgttacgtaaacccgttcccggtaccggtaccccgttcgggtacccggggg

SEQ ID NO: 413916 - DNA, 640 bp, Homo sapiens
  misc_feature: GZ8MTXP02F3JL4.25.28.C06.1.454.CMB.2.raw
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagtagttatggctttcgtctgggtccgccagtgtccagggcaaggggctgggagtggcgtggggatttacgttggtctgacagaaccaaatgaactatactcgacggcgggtacgtcccggtgggacgggggtcctaatttcccgaaccctactccgtacccgaacgggaacctaaacttacccgaaagaccgtaaacccctcttactaccgtagactaaaagtacgaaactaacgttaggaagtacgtacggaaggtacgtacggttaccgtttagttacgtgtacgtcgtaccgtcgacggtagtaggacgtaaggaaaacgtcgtaagtctacgtacgttcccgtacgtaccgtcggtacggg

SEQ ID NO: 413917 - DNA, 727 bp, Homo sapiens
  misc_feature: GZ8MTXP02IMMK5.25.28.C06.1.454.CMB.2.raw
  modified_base (271)..(271): a, c, t, g, unknown or other
  modified_base (280)..(280): a, c, t, g, unknown or other
  modified_base (300)..(300): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaactccctgagactctctgtgtggcgctagactcaccttnagtagttanggctttcgtcgtgggtcccnccagtgtccagggcaaggggctgggagtggcgtggggtagtttcttggtctgaacaggaaccaaaatgaactatatccgaacggcgggtagtcccgtagggacgggggccctattccaaccaactcctaccgacgggaactaacttaacccgaaacgacgtaaccccttactaacttacctagaacctaaaagtacgaaaacctaacgttaggaaggtaacggtacggaacggtaacgttaccgggttacccgttttaagttaaccgttggtacggtacccggtaacccgttaccgggaacgggtaacggttacggggtaaccgttaaaacgggggtaaaaacgttaccgggttaacggttacccttaccgttaaacccgtttcccccggtacccggttaaccccgtttccgggtaaccccgggggg

SEQ ID NO: 413918 - DNA, 346 bp, Homo sapiens
  misc_feature: GZ8MTXP02FKAA2.25.28.C06.1.454.CMB.2.raw
  modified_base (343)..(346): a, c, t, g, unknown or other
tcagactgtacagtcacgaccggtgctcgatttagagctcacgtattgggtttgggggaagaggaagactgacggtcctcccaggagttcaggtgctgggcaccttgggcacgggggaggtgtgtcacaagatttgggctctgggcaccgtgggcatgggggaggtgtgtcacaagatttgggccagggcaccctggtcaccgtctcgtcagcttccaccaagggcccatcggtcttcccctggcgccctgctccaggagcacctctggggcacagcggccctggctgcctggtcaaggactacttccactgtacagtctgagcggctggcaaggcgcatagnnnn

SEQ ID NO: 413919 - DNA, 654 bp, Homo sapiens
  misc_feature: GZ8MTXP02HUINZ.25.28.C06.1.454.CMB.2.raw
  modified_base (245)..(245): a, c, t, g, unknown or other
  modified_base (270)..(270): a, c, t, g, unknown or other
  modified_base (278)..(278): a, c, t, g, unknown or other
  modified_base (294)..(294): a, c, t, g, unknown or other
  modified_base (391)..(391): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcgtgggggagcgtggtccagcctgggaactcctganctctctgtgtgcgctagctcacttnagtagtanggcttcgctgggtccncagtcgtaccagggcaaggggtctgggagtgggacgtggggatttacgttggtctagactagaccaaatgaacatatcgacggcgggagttccgggnggacgggggtcctacttaccaccctactaccgtaccgaacggtaactaactaaccgaaacgtaaccgtaacccttactactacgtacgaactaaatacgtaaactaacgttaggaaggtacgtacggaaggtacgttaccggttacgtttaacgttacgtcgtacgtaccgtaccgtacggtacggtaggtacggtacgtaaacggtaaaacgtcgttaacgtcgtaccgtaccgttacccggtaccgtaccgttcggtcggg

SEQ ID NO: 413920 - DNA, 588 bp, Homo sapiens
  misc_feature: GZ8MTXP02GLS60.25.28.C06.1.454.CMB.2.raw
  modified_base (296)..(296): a, c, t, g, unknown or other
  modified_base (364)..(364): a, c, t, g, unknown or other
  modified_base (422)..(422): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagccgtgggaatccctgagactctctgtgtggcgctagctcaccttcagtattatggcttcgtctgggtccnccagtcgtccagggcaaggggctggagtggctggggtattcgttggtctgacagaccaaatgacatancacgcggagtcgtggacggggccatcacatctccgaggacactacaagacgaaccctntactactagactaaatagaactaacgttagagagtacgaggtacgtacggtaccgtttattacgtgtcgtacgtaccgtacgacggtaggtacggtacgtaaggtaaaacgttcggtaacgtcctacgtacgttaccccgtacggtacccgttcggtacccggggg

SEQ ID NO: 413921 - DNA, 635 bp, Homo sapiens
  misc_feature: GZ8MTXP02JVP37.25.28.C06.1.454.CMB.2.raw
  modified_base (303)..(303): a, c, t, g, unknown or other
  modified_base (382)..(382): a, c, t, g, unknown or other
  modified_base (423)..(423): a, c, t, g, unknown or other
  modified_base (448)..(448): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcagatgcaactggcggaggtcgggggagcgtggtccaggccgggggaatccctgagactctcctgtgcagtgtccgcgtccctaccttccgtcgtttggctattcacgtgggcccncgaggcctccgaggcaaagggctgggaggtggggtggcggtcagtagtggggtggatagggaaatatggcctatttttngacagtacctcggtggaacgggcctactcacatccacgagngcagccacaaacgtactacctttanctgactaagttaacgaaaccgtggaactacctacggacgaacgaccggtcttaggttacttaacttcgtcggccgggtcggggtactacggaaaacggtacggtacgggggttccggggaccgttacgtaacgggctaagggtcgggaaccggccggtagggggacccgaaaggggtccctaagggg

SEQ ID NO: 413922 - DNA, 586 bp, Homo sapiens
  misc_feature: GZ8MTXP02JD09Z.25.28.C06.1.454.CMB.2.raw
  modified_base (303)..(303): a, c, t, g, unknown or other
  modified_base (428)..(428): a, c, t, g, unknown or other
tcagactgtacagtcacgaccggtgctcgatttagagctcacgtattggggtttgggggcagaagtctctctcagtcaggacacagcatggacatgagggtccctgctcagctcctgggactcctgctgctctggctcccagctatcagatgtggcatccagatgaccaagtctccatcctcctgtctgcatctggttggagacagatcaccatcacttggccgggcgagtcgaggggctagttaggtaaattgttcggcctggtatcagacaagaaacagggtaacttaccctaactcctanatctatgctgactactcctagtttcgacgttacggtttcggggtcccttctacggtacttcggacggtcggacgtgggtcgggttcagggactagtactctactctacaccatccgagcacgcgnaccgagtcgtagtagtagttgtactacttaatttacgtaactacgttaaactaaaagtttcgaaacgtacgtcgtacgtaggtacgttacgggtcccggaaccgaacgggaaccgtaagggtacgaacgtaacgtaacgaaaaccgtcggtggtaccg

SEQ ID NO: 413923 - DNA, 518 bp, Homo sapiens
  misc_feature: GZ8MTXP02JCBD2.25.28.C06.1.454.CMB.2.raw
  modified_base (247)..(247): a, c, t, g, unknown or other
  modified_base (284)..(284): a, c, t, g, unknown or other
  modified_base (307)..(307): a, c, t, g, unknown or other
  modified_base (381)..(381): a, c, t, g, unknown or other
  modified_base (406)..(406): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgaccaagtctccatcctccctgtctgcatctgttggagacagagtcaccatcacttgccgggcgagtcagggcattggaaattnttggctgtatcagcagaaacaggaaatcctaactctnatctatgctgcatcctatttcgntaagtttcggggtcccttctcgtaattcgacgcggacaggtgggtctggggacagtaattcactctcacatccngcagcctgcagcctagagtatgttnactaacttagttactagtaactaaaattcgaactagtcgaacccgtggtaactcggttccgacccgtaaggaccgtaaggtcggaactacgtacaaaccggtaatcggtacg

SEQ ID NO: 413924 - DNA, 826 bp, Homo sapiens
  misc_feature: GZ8MTXP02HKGV6.25.28.C06.1.454.CMB.2.raw
  modified_base (311)..(311): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggaggcgtggtccagccgtgggaacgtccctgacgactctctgtgtggcgctagctcacttcagttagttatcggtctttcggtcgtcggggtcccnccgtaggtcgtccgagggcgaagggggctggggagtgggcgttaggggtagtttacgttgggtcctggaactaaggaaccctaaaagtcgaaactaattagtaccgaacgggccggggtaacggttcccgggtaggggaccgggggtaccctaacgtttcccgaaaccctaacgttcccgtaacccggtacggggtaaacctaaaacgtttaccccgaaaaacggtaacccggtaaaacccccttacgttaaacgtaccgttaacgaaaaccgtaaaacgtttaaaccggaaaacctttaaaacggtttacggaaagggtacggtaaaccgggtaacgggttaacgttaaccggggttaccgtttttaaacgttaccgttagggttacccgtaaccggtaccgtacgggaagggttaccggtaggggtaaccttaaaaggggtaaaacgttacggttaacgtaccgttaccgttaaaccgttccccggtacgtacccggttacggtacccggggg

SEQ ID NO: 413925 - DNA, 671 bp, Homo sapiens
  misc_feature: GZ8MTXP02IMOU4.25.28.C06.1.454.CMB.2.raw
  modified_base (269)..(269): a, c, t, g, unknown or other
  modified_base (303)..(303): a, c, t, g, unknown or other
tcagactgtacagtcacgaccggtgctcgatttagagctcacgtattggggtttggggggcagaagtctctctcagtcaggacacagcatggacatgagggtccctgctcagctcctgggactcctgctgctctggctccagctatcagatgtggcatccagatgaccaagtcctccactcctcctgtctgctatctggttggagacagacgtcaccatcacgttggccgggcgagtcgaggctagttaggaaatttgttggctggtancagacaagaaacgagggtaaacttccaacctctntatctatgctcgactactcctatttcgacgttacggtttcggggtccttcgtacgtacttcggcggcggcgtaggttcggggtctacgggaactacgttacttacctactacaccactagtaccgacgaccgtacgccgttacgaccgtacgtaccgtaaggtaagttacggtttacgtactaacgttaaactttacgttaaacttaacgttaaacgtttaaaaacgttgtaaacgttaacgggtaccggttaacggtcgggttaacggttaccggttacccggggaaccggttaaacgggtaaccgggtaaacgggttacgaaaccggttaacgtaaaaccggtaaacggtacgtaacgggtaccgg

SEQ ID NO: 413926 - DNA, 627 bp, Homo sapiens
  misc_feature: GZ8MTXP02GD8I6.25.28.C06.1.454.CMB.2.raw
  modified_base (302)..(302): a, c, t, g, unknown or other
  modified_base (385)..(385): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggagcgtggtccagcctgggaactccctgacgactctctgtgtgcgctagctcacttcagtagttatggtcttcgtcgtcgggtcccncctagtcgtccgagggtcgaagggggtctggggagtgggcgtaggggtattacgttggtctaggacagaaccaatgacatacncgacgcggtatccggtaggacgggggtccattccacgatccgtaccgaggaactaataccgaaacgaccgtaaaccctctactacgtcgaaactaaatacgaaactaacgttagaacgacggtaccgaaggtaacgtacggtacgtttatacgtgtcgacgtaccgtcgacggtggtacggtacgtaaaggtaaaacgtcgtaagtctacgtaccgttccgtaccgtaccgtcggtacgggg

SEQ ID NO: 413927 - DNA, 609 bp, Homo sapiens
  misc_feature: GZ8MTXP02JBI6U.25.28.C06.1.454.CMB.2.raw
  modified_base (261)..(261): a, c, t, g, unknown or other
  modified_base (276)..(276): a, c, t, g, unknown or other
  modified_base (285)..(285): a, c, t, g, unknown or other
  modified_base (381)..(381): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggaggcgtggtccagcctgggaactccctgagactctcctgtgtggcncctagactcaccttnagtagttanggtcttcgtcgtcgggtccgccagtcgtccagggcgtaaggggctaggagtgggcgtggggtagttacttggtctgacagaccaaatgaacattanaccgacggcgggtacgtccggtaggacgggggcctattccacctatctccaagggacaacttaccgaaacgacgtaaccctctagtaccagacctaaatacgaaactagttacgagtacgacggaggtaactacgggtacttatacgtgtgtacgacctgacggagtcggacgtaaggaaacgttacgtaagtcctacgtaccttccgtactaccgtcggtaccgggg

SEQ ID NO: 413928 - DNA, 662 bp, Homo sapiens
  misc_feature: GZ8MTXP02FYRCW.25.28.C06.1.454.CMB.2.raw
  modified_base (256)..(256): a, c, t, g, unknown or other
  modified_base (271)..(271): a, c, t, g, unknown or other
  modified_base (303)..(303): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggagcgtggtccagcctgggaatcctgagctctctgtgtggcncctagactcaccttnagttagttatggctttcgtcgtcggggtcccnccaggtcgtccgagggcgaagggggctagggagtggcgtaggggtatttacgttggtctgaacgagaaccaaagtgaactatactcgaacggcgggacgtccggtgggacgggggcctaattccaacctatcccgtaccgaacgggaacctaaacgttacccgaaaagaaccgtaaaccccttacttactactacgaacctaaaatacgaaaactaaacgttgaaaggacgtaccgaaggtacgttaaccggttacgtttattaacgtcgtacgaccgtaccgtacgaggtaggtacggtacgtaaaggaaaagttcgtaacgtcgtactacgttcccgtacgtaccgtcggtacgggg

SEQ ID NO: 413929 - DNA, 741 bp, Homo sapiens
  misc_feature: GZ8MTXP02H82LM.25.28.C06.1.454.CMB.2.raw
  modified_base (266)..(266): a, c, t, g, unknown or other
  modified_base (282)..(282): a, c, t, g, unknown or other
  modified_base (310)..(310): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggcctaacttgggttttcctcgttgcttcttttaagaggtgtccagtgtcaggcgcatctgggtggagtcggtgggggaggcgtggtccagccgtgggaactccctgacgactctctgtgtggcncctagacctcaccttnagtagttatggcttcgtcgtcgggtccnctagtcgtccaggcgaaggggctgggagtggcgtggggtatttcgtggctaggaacagaacaaatgaactaatacgtacgaacggggtcggtagggttccccggtagggggacccggggggtaccctaacttcccaaccgtacgtacccgtacccggaaacggggtaacctaaaccgttaacccgaaaacgtaaaccggtaaacccccttagtactaccgtacgaaactaaaagtacgtaaaacctaacgttaggaagtacggtacggaacggtaacgtaccgggttacgtttaacgtttacggtgttcggacccgttaccgtacggtaagggtacggtagggtaacggttaaagggtaaaacgtttcggtaacgttccgtaccgtaaccgtttcccggtaccgacccggttcgggtacccggggacccgg

SEQ ID NO: 413930 - DNA, 584 bp, Homo sapiens
  misc_feature: GZ8MTXP02FQWLM.25.28.C06.1.454.CMB.2.raw
  modified_base (297)..(297): a, c, t, g, unknown or other
  modified_base (366)..(366): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctctgtgtggcgcctagactcacttcagtatatggcttcgtctgggtccnccagtcgtccaggcgaaggggctgggagtggcgtgggattacgttggtctgacagaccaaatgacatancgacggcggagtccggtaggacgggggcctaattccaccatctaccgacgggaacaacgttaccaaacgacgaaccctactactcagacaaatacgaactaactagagagtagaggacgtacggtacgtttatacgtgtcgcgacgtcgacggaggtcgtacgtaaggaaaacgttcgtaacgttcgtactacgttcccgtcgaccgtcggtaccggg

SEQ ID NO: 413931 - DNA, 604 bp, Homo sapiens
  misc_feature: GZ8MTXP02JCF4M.25.28.C06.1.454.CMB.2.raw
  modified_base (273)..(273): a, c, t, g, unknown or other
  modified_base (301)..(301): a, c, t, g, unknown or other
  modified_base (371)..(371): a, c, t, g, unknown or other
  modified_base (387)..(387): a, c, t, g, unknown or other
  modified_base (436)..(436): a, c, t, g, unknown or other
tcagactgtacagtcacgaccggtgctcgatttagagctcacgtattggggtttggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcgtgggggagcgtggtccagccgtgggactcctgagctctctgtgtggcgctagactcaccttnagtagttatggcttcgtctcgggtcccncagtcgtccagggcaaggggctgggagtggcgtgggtattcgtggtctgacagaaccaaatgaacatacncgacgcgggatccggnggacgggcctaatccacatctccgaggacaataccaaagacgaaccctntactactagaacaaatacgaaactaacgttagaagtagtacggaaggtacgtacggtacgtttattacgtgtacgtacgtaccgtaggacggtacgtacggacgtaaagggtaaaacgttcgtaacgttactacgtaccgttcccgtaccgtaccgtacggtccgggg

SEQ ID NO: 413932 - DNA, 661 bp, Homo sapiens
  misc_feature: GZ8MTXP02GE1JW.25.28.C06.1.454.CMB.2.raw
  modified_base (225)..(225): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgaccaagtctccatcctcctgtctgcatctgttggagacagagtcaccatcacttgccgggngagtcaggcattggaaattattggcctggtatcagcaagaaaccaggggtaaacttcctaaacctcctacatcgtatgcttgcatcctatttcgctaagttttcggggacccccgttcttccggtaattccgaacggcgggtcgtacgggttggggtaccgtggggaaccgtagtaattacctactaccttaccaccctactccgtacgaccgtacgacccgttggacctaagtccccgtaggtaaagtagttacgttagtaaccgttaaacctttaattaaccgttaaggttaaaccttaaaaaaagtttcgtaaaccctaagggtaccgtacccggttaggtaaacgttccggtttacccgggacccgtaaacgggggtaacccgtaaaaggggtcggaaacctagtaaccgaaaacgtaaccgtggtaaccgg

SEQ ID NO: 413933 - DNA, 585 bp, Homo sapiens
  misc_feature: GZ8MTXP02FE0U1.25.28.C06.1.454.CMB.2.raw
  modified_base (175)..(175): a, c, t, g, unknown or other
  modified_base (299)..(299): a, c, t, g, unknown or other
  modified_base (367)..(367): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagnggtgtccagtgtcaggcgcatctggtggagtcgtgggggagcgtggtccagcctgggaatccctgagactctcctgtgtggcgcctagactcacttcagtagtatggcttcgtcgtgggtcccncagtgtccaggcgaaggggctggagtggcgtgggagttacgttggtctgacagaccaaatgaacatancacggcggagtccggtggacggggccattcacatctccgaggacaataccaaagacgaaccctctatactagacaaatagaaactaagtagaaggagtcgaagggtattaaccgggtccgtttaatacgtgtacgtaccgacccgtgaacggagttacggacgtaaggaaaagtcgtaacgtctactacgttccccgtacgtaccgtcggtaccgggg

SEQ ID NO: 413934 - DNA, 717 bp, Homo sapiens
  misc_feature: GZ8MTXP02I4NS6.25.28.C06.1.454.CMB.2.raw
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggaggtcgtggtcccaggcccgtggggaacgtcccctggacgacctctccttagtggtcggcgcctagacctccaccttcagttagttatggtccttcgtcgtcgggtcccgcctaggtcgtccgagggccgaaggggctgggagtgggcgtggggtagttcgttggtctgacagaacaaatgactatactaccacgggcgggacgtccggtagggaccgggggtccgtattcccaaccctactccgtacccgaacggggtaactaaacgttaacccgaaagtaacccgtaaaccccttccttaaataccgtacgtaaaccgaaaacttacgaaaacctaacgttaggaaggtaagtaaccgggtaaggtaacgttaaccgggttaccgtttaagttacgtacgttcgtaccgtacccgttaggacgggtaaggtacggtacgtaaaaggtaaaacgttcgtaacgtctacgtacgttcccgtacgtaccgtacggtccgggg

SEQ ID NO: 413935 - DNA, 563 bp, Homo sapiens
  misc_feature: GZ8MTXP02FH83T.25.28.C06.1.454.CMB.2.raw
  modified_base (302)..(302): a, c, t, g, unknown or other
  modified_base (372)..(372): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccaggcctggggaagtccctgagactctcctgtgtggcgcctagactcaccttcagtagtatggcttcgtctgggtccncagtgtccagggcaaggggctgggagtggcgtggggattacgttggtctgacagaaccaaatgaacatancacggcggagtccggtggacggggccattccaccatctccgagggacaattaccaagacgaaccctctatctagacaaatagaaacaacttagaagagtcgaggatacggtcgttatacgtgcgcgacctcgaggagtcggacgtaaggaaaagtcgtaagtctactacgtcccgtacgaccgtcgtcggg

SEQ ID NO: 413936 - DNA, 674 bp, Homo sapiens
  misc_feature: GZ8MTXP02IBL5W.25.28.C06.1.454.CMB.2.raw
  modified_base (263)..(263): a, c, t, g, unknown or other
  modified_base (309)..(309): a, c, t, g, unknown or other
  modified_base (409)..(409): a, c, t, g, unknown or other
  modified_base (480)..(480): a, c, t, g, unknown or other
tcagactgtacagtcacgaccggtgctcgatttagagctcacgtattggggtttgggggggagaggagcccagcactagaagtcggcggtgtttccactcggtcatcagcactgaacgcagcggactcaccatggagtttgggctgaacttgggttttcctcgttgcttcttttaagaggtgtccagtgtcaggcgcatcgtggtggagtcgtggggggagtcgtggtccagccgtgggaacgtcctgagctctctgtgtgcncctagctcaccttgagtagttatggtcctttcgtcgtgggtacccnccgtaggtctcccgagggccgaaggggctgggagtcgggctggggtatttcgtggtctaggacaggacctaaagtgacatactcgacggcgacgttcggngggacggggtccatccaacctactccgtcccgaagggtaccaaacttccgaaaacggaccgtaaccccttntaacgtctacggaacctaaagtacgaaacctaagtacgaaggtacggtaccgaaggtacgttaccgggtaccgtttttaactacgttcggacgtaccgtacgttaaccggaggtacggtacggtacgtaaaagggtaaaacgttcgttaacgtccctaacgtacgtttccccggacgtacccgtggacccgggg

SEQ ID NO: 413937 - DNA, 711 bp, Homo sapiens
  misc_feature: GZ8MTXP02G66DV.25.28.C06.1.454.CMB.2.raw
  modified_base (261)..(261): a, c, t, g, unknown or other
  modified_base (275)..(275): a, c, t, g, unknown or other
  modified_base (305)..(305): a, c, t, g, unknown or other
  modified_base (394)..(394): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcgtgggggagcgtggtccagcctgggaacgtccctgagactctctgtgtggcnctagactcaccttnagttagtatggtcttcgtcgtcgggtaccnctagtcgtcccaggggccgaaaggggctgggagtgggcgtggggtatttcgtggtctaggaactaaggaaaccaaagtcgactattacnccgaacggccggagttcccggaggacgggggaccctaatttcccaaaccctaactccgtacccgaagggtaacctaaacttacccgaaaacgaaccgtaaaccccttacgttaactcgttacgaaacctaaaagtacgaaaaccgttaaagttaggaaggaacggtacggaaggtaacgttaaccgggttaccggttttaattaccgttaggtacgtaccggtaccgtacggtaaacgggaggttacggaacgtaaagggtaaaaacgttcgtaaacgtctacgttacttcccggtacgtacccgttcggaccgggg

SEQ ID NO: 413938 - DNA, 691 bp, Homo sapiens
  misc_feature: GZ8MTXP02G8RJH.25.28.C06.1.454.CMB.2.raw
  modified_base (177)..(177): a, c, t, g, unknown or other
  modified_base (314)..(314): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagnggtgtccagtgtcaggcgcatcgtgggtggagtcggtggggggagtcgtggtcccaggccgtgggaactcctgagactctctgtgtggccgctagactcaccttcagttagttatggtctttcgtcgtcgggtcccncagtcgtcgagggtcgaaggggctggaggtggcgtaggggtagtttcgtgggtctgacgaagaacaaatcgactatactcgaacggcgggacgttcggagggacggggcctatccgaccatccctacggaacgggtaacaaacgttaccgaaaacggtaacctaaccccttactacttactaacggaaactaaaacgtacgtaaaaccgtaagttacgggaaggtacggtaaccggtaaggtaaaccggttaccggttaaccgttttaattaccgtggttaccggacctaccgttacgagggtacggtacggtacgtaaaggtaaaacgttcgtaacgttactacgtaccttcccgtacgtaccgttcggaccgggg

SEQ ID NO: 413939 - DNA, 733 bp, Homo sapiens
  misc_feature: GZ8MTXP02JGBJY.25.28.C06.1.454.CMB.2.raw
  modified_base (287)..(287): a, c, t, g, unknown or other
  modified_base (296)..(296): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgctcttttaagaggtgtccagtgtcaggcgcatctggtggagtcgtgggggaggcgtggtccagccgtaggggaacgtccctgacgtacctctccgtgtggtcggccgctagactcacccttnagtagttanggtcttcgtcgtgggtcccgcagtgtccgaggcgaaggggctggagtggcgtgggtattcgtggtctagaccagaaccaaatcgaacatatccgaacggcgggtacgttcccggaggggacggggccctaattccgaacctactccgtaccgaacgggaactaaactttacccgaaagtacccgaaccccttctaacgtcctaacgaacctaaaagttacgaaaaccttaccgttaggaacggtagtacggaacgggtaagttaccggttaccttttaagttacccgtagtccggtacccgtaacccggtacgtaaacgggggtacgtaacggggtacgtaaaaacggggtaaaacggttccggttaaacggtaccttacccggtaacccgtttacccccgggttacgggtacccctttacgggggtaccccggggg

SEQ ID NO: 413940 - DNA, 730 bp, Homo sapiens
  misc_feature: GZ8MTXP02HCNZC.25.28.C06.1.454.CMB.2.raw
  modified_base (179)..(179): a, c, t, g, unknown or other
  modified_base (317)..(317): a, c, t, g, unknown or other
  modified_base (347)..(347): a, c, t, g, unknown or other
  modified_base (388)..(388): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaaggnggtgtccagtgtcaggcgcatcgtgggtggagtcggtggggggaggcggtggtccaggccgtggggaactccctgacgctctcctggtgtggctctagactctaccttcagttagttatggtcttcgtcgtgggtccncagtcgtaccgagggacgaggggtctaggnggtggcgtggggtatttcgtggtctagacagaactaaacgngtaactatacgtccgaacggtcggggagttcccggggtaggggaccgggggtacctaacttcccgaaacctacgtacccgtacccggaagggtaaacctaacgttaacccgaacggacctaaacccgttctaactcgtagaaactaaacgtaacgaaaccttaaagtaggaacgtaacgggtaccggtaagggtaccgttaaccggttacgttttaacgttagtcgtacggtacgtacccgtaggtaagggacggtcgggtaaaccgtaaggggtaaaacgttcggtaacgttccgtaccgttaccggtttcccggaccgttacccggttcgggtcccgggg

SEQ ID NO: 413941 - DNA, 754 bp, Homo sapiens
  misc_feature: GZ8MTXP02H0787.25.28.C06.1.454.CMB.2.raw
  modified_base (281)..(281): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtgggtggaggtcgtggggggaggcgtggtccaggccgtgggaatccctgagactctcctgtgtggcgctagactcaccttnagtagttatggtctttcgtcgtcgggtcccgcctaggtcgtcccgagggccgaaagggggtctagggaggtgggccgttagggggtacgtttacgttgggtcctaggacgtaagaacctaaaagtgacaatactaccgacgcggggtacgttcccggtagggacgggggacctagttacccaacctactccgtacccgaaggggtaaacctaaacgttacccgaaaagtaaccgtaaccccttactaactaccgtagaaacctaaaagtacgaaaacctaacgttaggaaggtaacggtacgagggtaacgttaaccgggtccgttttaacttacgtcgtacggtacccgtacccgttaggaacgggtacggtacgggtaaccgtaaaggggtaaaaacgtttccggttaacgttccttaaccggttaccgtttaccccggtacccgttaacccggttaccgggtcccggggg

SEQ ID NO: 413942 - DNA, 619 bp, Homo sapiens
  misc_feature: GZ8MTXP02GRIG2.25.28.C06.1.454.CMB.2.raw
  modified_base (258)..(258): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagccgtgggaactccctgagctctcctgtgtggcnctagactcaccttcagtagttatggcttcgtcgtgggtccgcctagtcgtccagggcaaggggctggagtggcgtggggagttacgttggtctgaacagaccaaagtgacagtatcgacgcgggagtccggtggacgggggtccattaccaccgatcctccgaagggactaagttacccgaaagaccgtaaccctcgtactactcgaacaaagtacgaactaacgttagagacgtacgaacggtatacggtaccgtttattcgtgtacgtcgtaccgtcgacggtaggtacggacgtaaaggaaaacgttcgtaacgtaccgtacgttaccgttcccgtaccgtaccgttcggtaccgggg

SEQ ID NO: 413943 - DNA, 572 bp, Homo sapiens
  misc_feature: GZ8MTXP02JFMF2.25.28.C06.1.454.CMB.2.raw
  modified_base (312)..(312): a, c, t, g, unknown or other
  modified_base (353)..(353): a, c, t, g, unknown or other
  modified_base (362)..(362): a, c, t, g, unknown or other
  modified_base (366)..(366): a, c, t, g, unknown or other
  modified_base (402)..(402): a, c, t, g, unknown or other
  modified_base (406)..(406): a, c, t, g, unknown or other
  modified_base (416)..(416): a, c, t, g, unknown or other
  modified_base (429)..(429): a, c, t, g, unknown or other
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatgacccagtctccatcctcctgtctgcatctgtggagacagatccaccatcacgttcggccgggcgagtcgaggggctagttggtaaaattgtttcggccttggtactcgagacaaagaaaccgagggtaaactttccctaaacctcctnatctatgctgctatcctacttcgctaagtttcgggcccttntcgtatcgngcgngtaggtggtctagggactagtattcactctcactancgancagcctgacncgtactagaagtnttggtacacttaacttacttacttagtaaacgtaaaagtttgaacgttacggtacgtaacccgtggtacgttccgggttaccggaacccggtacggtaacgaacgggtaggaacctagtaaccgaaaacgtacgtcggtacgg

SEQ ID NO: 413944 - DNA, 542 bp, Homo sapiens
  misc_feature: GZ8MTXP02FF5IO.25.28.C06.1.454.CMB.2.raw
  modified_base (259)..(259): a, c, t, g, unknown or other
  modified_base (366)..(366): a, c, t, g, unknown or other
  modified_base (480)..(480): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcacatctggtggagtcgtgggggaggcgtggtccagcctgggaatccctgagactctcctgtgtggcncctagactcaccttcagtagtatggcttcgtctgggtccgcagtgtccaggcaaggggctggagtggctggggagttacgttgggtctgacagaccaaatgacatancagcggagtcgtggacggggcattccacatctcgaggacaatcaagacgacctctatctgacaaatagaactaactgaagagtacgagatacggtcgttatactgtcgcgtacncgaggagtcggacgtaaggaaaacgtgtaacgtctactacgtcccgtacgaccgtcgtcggg

SEQ ID NO: 413945 - DNA, 609 bp, Homo sapiens
  misc_feature: GZ8MTXP02JV39Y.25.28.C06.1.454.CMB.2.raw
  modified_base (263)..(263): a, c, t, g, unknown or other
  modified_base (277)..(277): a, c, t, g, unknown or other
  modified_base (304)..(304): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggaggcgtggtccagccgtgggaacgtccctgagactctcctgtgtggcncctagctcaccttnagtagttatggcttcgtcgtgggtccnccagtcgtccagggcgaaggggctagggagtggcttggggagtttacgttggtctgacagaaccaaatgacatatcgacggcgggagtccggtaggacgggggccaagtttccaacccgtactccgtaccgaagggactaattacccgaaagaccgaaaccctcgtactctagacaaatagaaacaacgttgaagagtacgaggtagtacggtacgtttattacgtgtcgcgaccgtcgaggagtcggtacgtaaggaaaacgtacgtaagtctacgtacgttcccgtacgtaccgtcgtcgggg

SEQ ID NO: 413946 - DNA, 638 bp, Homo sapiens
  misc_feature: GZ8MTXP02JJAZ8.25.28.C06.1.454.CMB.2.raw
  modified_base (274)..(274): a, c, t, g, unknown or other
  modified_base (299)..(299): a, c, t, g, unknown or other
  modified_base (372)..(372): a, c, t, g, unknown or other
  modified_base (390)..(390): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaactccctgagactctcctgtgtggcgctagactcaccttnagtattatggcttcgctgggtcccncagtcgccagggcgaaggggctggagtggcgtggggatttacgtggtctggacagaacccaatcgaacattancgacggcggtagttccgngggacggggcctagtcagtcatcgtacgacggacaacgttaccaacgacgaaccctactactactcgaactaaatacgtaactaacttagaagtagtacggaaggtaacgtaacgggttaccgtttaagttaacgttcggttacgaccgtaccgtacggtacgggtaaggttacgggaacgttaagggtaaaacggtaacgttaacggtccttacgtaaccgtttcccgtacccggtaccgttccggg

SEQ ID NO: 413947 - DNA, 648 bp, Homo sapiens
  misc_feature: GZ8MTXP02F3KI9.25.28.C06.1.454.CMB.2.raw
  modified_base (175)..(175): a, c, t, g, unknown or other
  modified_base (259)..(259): a, c, t, g, unknown or other
  modified_base (273)..(273): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagnggtgtccagtgtcaggcgcatcgtggtggagtcgtgggggagcgtggtccagccgtgggaatccctgagctctcctgtgtggcncctagctcaccttnagtatatggcttcgtctgggccaccgtagtgtccaggcaaggggtctggagtggctgggactttacgttggtctgaacagaacctaaagtgaactatactcgacggcggagtcccggtggacgggggcctaattccgaacctactccgtaccgaacgggtaactaaacgttacccgaaagaaccgtaaccccttactactacctagaactaaacgtacgaaactacgttagacgtagtacgaaggtactacggttactttaacgtacgtcgtacgaccgtaccgtagaacgggtagtcggtacgtaaacgggtaaaacgttcggtaacgttcctaccgtaccgttaccccggtacgtacccgtacggtcccgggg

SEQ ID NO: 413948 - DNA, 616 bp, Homo sapiens
  misc_feature: GZ8MTXP02GMK16.25.28.C06.1.454.CMB.2.raw
tcagactgtacagtcacgaccggtgctcgatttagagctcacgtattgggtttgggggcagaagtctctctcagtcaggacacagcatggacatgagggtccctgctcagctcctgggactcctgctgctctggctcccagctatcagatgtggcatccagatcgacccagtcctccatccctccctgtctgcatctgttggagacagagtcacatcacgttcggccgggcgagtcgaggggctagttaggtaaatttgttggcctggtatcagacaagaaaccgagggtaaacttccctaacctcctacatcctatgctgcactcctattcgactacggtttcggggtaccctcgtcgtacttcgacggtcggacgtagggtggggtacgtggggactaagtactttccgacttctacaccatcacgtcacgtcctgacctacgccgtagtaagtcgttacggttacaaccttaaacgtttacttaacgttaacgttaaaacttaaaagtttcgaacgtaacgttcgggtaaccggttggtacggttcggttacccgggacccgaagggtaccgaagggtacgaactaacgtaccgaaaacggtacgtcgtacgg

SEQ ID NO: 413949 - DNA, 654 bp, Homo sapiens
  misc_feature: GZ8MTXP02JOSTD.25.28.C06.1.454.CMB.2.raw
  modified_base (216)..(216): a, c, t, g, unknown or other
  modified_base (263)..(263): a, c, t, g, unknown or other
  modified_base (285)..(285): a, c, t, g, unknown or other
  modified_base (297)..(297): a, c, t, g, unknown or other
  modified_base (348)..(348): a, c, t, g, unknown or other
  modified_base (521)..(521): a, c, t, g, unknown or other
  modified_base (643)..(643): a, c, t, g, unknown or other
tcagactgtacagtcacgaccggtgctcgatttagagctcacgtattggggtttgggctgagctgggttttcctcgttgctcttttaagaggtgtccagtgtcaggtgcagctggtgcagtctgggggagcgtggtccacccgtgggaggtccctgagactctcctgtgcagcctctggattcatcttcaacacctatgcaatgcacgtgggtccnccaggctccgaggcgaaggggctggagtgggtgctagttattcatangataggaaactaaataaaagtntcgtagactcgnggcggactattccgaccgtctaccgagagacagataccaaagaagacggtntactaccctacaaatcaaacacgtgacgtacgtaccggaaggaccgacggtcttaggttacgttaacttaccgtggtacggacggtaacggacggtaccggtcggggcgtacgtaacggggtcccgtaccccgaaaggggtaaacgtccggtacttaaccgttagtcccgaanagttacgggaactcggttacgggagggggaaccaaacgggggccacgggtcacgttccggtcctccttacgccgcccgtaccgaacggtaaccggcctacgttccccggtccttcccccggnggccctccccg

SEQ ID NO: 413950 - DNA, 676 bp, Homo sapiens
  misc_feature: GZ8MTXP02GH91O.25.28.C06.1.454.CMB.2.raw
  modified_base (261)..(261): a, c, t, g, unknown or other
  modified_base (274)..(274): a, c, t, g, unknown or other
  modified_base (304)..(304): a, c, t, g, unknown or other
  modified_base (375)..(375): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagccgtgggaactccctgagactctcctgtgtggcncctagctcacttnagttagttatggtcttcgtcgtcgggtccncctagtcgtccagggccgaaggggctggagtggctggggattacgttggctgacagaaccaatgacatacncgacggtcgggagtccggtaggacgggggtccctatttccgaaccgtaactccgtaccgaacggggaactaaacgttacccgaaacggaaccgtaacccttacgtactaccgtagaacctaaaatacggaaacttaacgttaggaaggtaacggtaccggaaggtacgtaacggttaccgtttaacttacgtcggtacgtaccgtaccgttacgacgggtaggtacggtacgtaaagggtaaaacgttcggtaacgttccgtacgtaccgttcccggtacgtaccgtacggtacccggggg

SEQ ID NO: 413951 - DNA, 615 bp, Homo sapiens
  misc_feature: GZ8MTXP02I2R2G.25.28.C06.1.454.CMB.2.raw
  modified_base (267)..(267): a, c, t, g, unknown or other
  modified_base (310)..(310): a, c, t, g, unknown or other
  modified_base (542)..(542): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcggtgggggaggcggtggtccagccgtgggaatcccgtgagctctcctgtgtcggcnctagactcaccttcagtagttatgtctttcgtcgtcgggtccncagtcgtccaggcgaaggggctggagtggcgtgggtagtttacttggtctgaacagaaccaatgaacatacgtcgaacggcggtagtccggtggacggggtcctattccactatcctacgaggaactaacttacccgaaagaccgaaccctctactactgaacaaagtacgaaactaacgtagagaagtcgaaggtacgtacgggtcctttagttacgtgtacgacgtaccncggaggtacgtcggaacgtaaggaaacgttcgtaagtcgtactaccgtccgtaccgtaccgtcggtaccgggg

SEQ ID NO: 413952 - DNA, 701 bp, Homo sapiens
  misc_feature: GZ8MTXP02I1FWT.25.28.C06.1.454.CMB.2.raw
  modified_base (158)..(158): a, c, t, g, unknown or other
  modified_base (301)..(301): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttggctgaactgggttttccncgttgctcttttaagaggtgtccagtgtcaggcgcatctggtggagtcgtgggggagcgtggtccagccgtgggaactccctgagcctctcctgtgtcgcgctagactcaccttgagtagttatggcttcgtcgtcgggtccnccgagtcgtccgagggtccgaagggggtctgggagttcgggcgtttaggggtacgtttaccgttggggtacctaggaaccgtaaggaaacccctaaaagttcggaacctaaactttacgaccccggaacgggtccgggggaacgtttccccggggaggggaccgggggtccctaagtttcccaacccgtagtccgtacccgaaggggtaaccaaacgttacccgaaagacccgtaaacccttcttacactacgaactaaagttacgaaactacgttagagtagtacgaggtacgtaccgggtactttagtactggtacgtcgtaccgtgaacgggtagtacggtacgtaaaggtaacgttacgtaagtactacttacgtcccgtacgccgtcggtccggg

SEQ ID NO: 413953 - DNA, 681 bp, Homo sapiens
  misc_feature: GZ8MTXP02IXVYB.25.28.C06.1.454.CMB.2.raw
  modified_base (202)..(202): a, c, t, g, unknown or other
  modified_base (229)..(229): a, c, t, g, unknown or other
tcagactgtacagtcacgaccggtgctcgatttagagctcacgtattgggtttgggggcagaagtctctctcagtcaggacacagcatggacatgagggtccctgatcagctcctgggactcctgctgctctggctcccagctatcagatgtggcatccagatgacccagtcctccatcctccctgtctgcatctgttgganacagatcaccatcacgttcggccgggngagtcgagggctagttaggaaatttagttcggacctggtaactcgaacgacaaggaaaacccgaggggtaaactttacccaaaccttcctactattacctagtcgtctacgactacttccgtaacttttcgaccgttaacgtttttccggggtcccttctcggttaacttcgacggcggtacgtagggttcggggtcgtaggggaactacggtaatttccactctacctacccaattcaaacggtctaaccggtcccgtacgaccgtacgaccgtaaggtagtacgtttacggttaacgtaaccttaaacgtttaactttaaccgttaaagttaaaacttaaaagttacgtaaacggttacggtaccggtaacggtacggttacgttacggtacccggaccggaacggtaacgtaacggtacgaactacgtaacgaaacgtacgtacggtcg

SEQ ID NO: 413954 - DNA, 795 bp, Homo sapiens
  misc_feature: GZ8MTXP02G9SJQ.25.28.C06.1.454.CMB.2.raw
  modified_base (304)..(304): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagcctgggaagtccctgagactctcctgtgtggcgcctagactcaccttcagtagttatggtctttcgtcgtgggcccnccagtcgccgagggcgaaggggctgggagtgggcgtggggtagtttacgtggactggaaccaagaaccccaaaatgaactagtacgtccgaacggcgggtacgttcccgggtgggacggggggaccctagtttacccgaacccgtaacgttcccgtaacccggtaacgggggtaaacctaaacgtttaacccgaaaacggtaaacccggtaaaccccctttacgttaaacgttccttaacggaaacccgtaaaacgttaaacggtaaaacccgttaaacgtttacgggaaacgggttaacgggttaaccgggaaagggttaacggtttaaacccggggttacgttttttaaacggttaccgttagggttaccgtaccgggtaacccgtttacggaacggggtaggttacgggtaacgttaaaacgggggtaaaacgttacggtaacgttaccgtacgtaccgttcccggtacgtacccgtcggtaccgggg

SEQ ID NO: 413955 - DNA, 758 bp, Homo sapiens
  misc_feature: GZ8MTXP02G0PVP.25.28.C06.1.454.CMB.2.raw
  modified_base (261)..(261): a, c, t, g, unknown or other
  modified_base (332)..(332): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggaggcgtggtccagccgtgggaactccctgagactctcctgtgtggcncctagactcaccttcagtagttatggcttcgtctgggtccgccagtcgtccagggcgaaggggctaggggnggtggcgtagggtagtttacgttggtctagaacgtaagaacctaaagtcgaactagtacgtaccggacgggtcgggtacggtccgggtacggggacggggtacctacttaccaacctacgtacccgtaccggaaaggtaacctaaaccgttaacccgaaaacgaacccgtaaacccttacgttaactacgtaaccgtaaaactaaaacgttaacgtaaaccgttaagttaggaacggtaacggtaacggtaacggttaccgttaaccgggtttacgttttaacgttacggtcggtaccgtaccggtaaccgttaggtaacggggtacggttacgggtaaacgttaaaacgggtaaaacggttcgttaacgttaccgttaccgttaccgttaccccggtacccggttaccggtacggggtacccggg

SEQ ID NO: 413956 - DNA, 647 bp, Homo sapiens
  misc_feature: GZ8MTXP02HNXD4.25.28.C06.1.454.CMB.2.raw
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgctcttttaagaggtgtccagtgtcaggcgcatctgggtggaggttcgtggggggaggcggtggtccaggccgtggggaagtccctgacgactctcctgtggtggcgctagactcaccttcagtagttatggtctttcggtcgtgggtccgccaggttgtcccgaggtcgaaggggctgggacgtgggcgtggggtagttacgttgggtctgacagaacccaaatgacatataccgacgcgggtacgtccggtaggaccgggggcctaagttccacccacttccaccgaacgggactaaacgttaccgaaacgaaccgtaaaccctccttaagtccgtagactaaatagaaacttaacgttgaagtacgtagacgtagtacggtcgtttatacgtcgacgcgaccgttagacggtagtcggacgtaaggtaaaacgtcgtaacgtactacgtaccgtcccgtccggtacttcgggtaccgggg

SEQ ID NO: 413957 - DNA, 724 bp, Homo sapiens
  misc_feature: GZ8MTXP02HCZCA.25.28.C06.1.454.CMB.2.raw
  modified_base (265)..(265): a, c, t, g, unknown or other
  modified_base (278)..(278): a, c, t, g, unknown or other
  modified_base (287)..(287): a, c, t, g, unknown or other
  modified_base (306)..(306): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcgtgggggaggcgtggccagccgtagggaacgtccctgagactctctgtgtggcnctagactcacttnagtagttanggcttcgtcgtgggtcccncagtcgtccagggcgaaggggctgggagtggcgtggggtatttacgtggtctagaacagaaccaaagtcgaactatactccgaacggcgggtagtccggtagggaacgggggccctattcccgaacctacgtcccgtaccggaagggtaacctaaacgttaacccgaaaagtaaccgtaaaccccttacgtaactacgtacgaaactaaaattaacgaaaaccttaacgttaggaaacgggtaacgttaccggaaggtaacgttaaccgggttaccgttttaattaccgtagttacggtaccgtaccgtacggtaacggtaaggttacggggtacgtaaacggggtaaaacgttaacggtaacgttaccgtaccgttaccgttacccggttacccgtaccgttacccggtaccggggg

SEQ ID NO: 413958 - DNA, 612 bp, Homo sapiens
  misc_feature: GZ8MTXP02H5H7B.25.28.C06.1.454.CMB.2.raw
  modified_base (189)..(189): a, c, t, g, unknown or other
  modified_base (197)..(197): a, c, t, g, unknown or other
  modified_base (202)..(202): a, c, t, g, unknown or other
  modified_base (258)..(258): a, c, t, g, unknown or other
tcagactgtacagtcacgaccggtgctcgatttagagctcacgtattgggtttgggggcagaagtctctctcagtcaggacacagcatggacatgagggtccctgctcagctcctgggctcctgctgctctggctccagctatcagatgtggcatccagatgaccaagtctcatcctcctgtctgcatntgtggaanacagntacactatctacgtcggcggagagtcgaggtatagtaggtaattcgttcgctgtancgagacgaaagtaaaccgtaaggtaacctacctaactactgactctagtctctctctactactacttacgtacgttacgttcggtccgtacgtacgtacgtcgtacgcgtcgtaggtacggtacgtacggacgtaacgtaactactactactacctactactacgacgtacgacgacgtacgacgacgtacgtagtagtagttacgttacgtaacttaacttaacttaacttaacgttaaacttaaacgtaacgtaacgtacgtacgtacggtacggtacggttacggtaccggtaccggtaacggtaacggtaacggtacgaacgtacgtaacgtaaacgtaacgtacgtacg

SEQ ID NO: 413959 - DNA, 625 bp, Homo sapiens
  misc_feature: GZ8MTXP02I8KVO.25.28.C06.1.454.CMB.2.raw
  modified_base (266)..(266): a, c, t, g, unknown or other
tcagactgtacagtcacgaccggtgctcgatttagagctcacgtattggggtttgggggggagaggagcccagcactagaagtcggcggtgtttccactcggtcatcagcactgaacgcagcggactcaccatggagtttgggctgaactgggttttcctcgttgcttcttttaagaggtgtccagtgtcaggcgcatctgggtggagtcggtgggggaggcggtggtccagccgtgggaagtccctgagactctctgtgtggccnctagactcaccttcagtagttatggtcttcggtctcgggtcccgccagtcgtccgagggccgaaggggctaggaggtggcgtggggtattacgttggtctgacagaaccaaatgacatatcgacgcgggaacgtccggtgggacggggcctattccaaccactccgtaccgacgggaactaacgtaccaaagaccgaaccctactactctagacaaatacgaaactaacgttagagagtacgaaggtacgtacggtacgtttattacgtgtacgtcgtaccgtgacgggagtacggtacgtaaaggtaaaagtacggtaagtcgtactacgttcccgtaccgtaccgtcgtaccggggg

SEQ ID NO: 413960 - DNA, 815 bp, Homo sapiens
  misc_feature: GZ8MTXP02IXCW3.25.28.C06.1.454.CMB.2.raw
  modified_base (318)..(318): a, c, t, g, unknown or other
  modified_base (411)..(411): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcagatgcaactgggcggaggtcggggggagcggtggtccgaggccggggaagtccctggagtacctctccgtgtgctagtcgtccgcgtccctaccgttccgttcgtttgctattcacgtcgggtcccnccaggcctaccgaggtacgaagggcgtgggaggtggggtggcggtcaagtaggtggggtagggtatagggtaataagtgtacctattttaagngactagtaccgtcgtgggaacggtccgacttaccaccgtactccgtaaccgaggggacgaccgtacggtccctaaaccgtaaaaccgtaaaacccgtttaccctttttaaacggtcccgtaacggtaaacttaaaacgttttaaacccgggaaaaaacccgggtttaggaaaccgttaaccgttacccgggtaaaaccggaaccgtacccggggttacttacggttaacgtttaacggtttaaccgtcggggtaccggggttaaccggggttcgttaaagggaaaccgggtaaaccggtcggggggttaacccggggtccgtaccggtaaaccgggcgtaaacgggttcggggaaccggttcccggggaaggggtacccgaaaacgggggtacccgttaacggg

SEQ ID NO: 413961 - DNA, 859 bp, Homo sapiens
  misc_feature: GZ8MTXP02GLDQ8.25.28.C06.1.454.CMB.2.raw
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggagcgtggtccagccgtgggaacgtccctgacgactctcctgtgtggcgcctagctcaccttcagttagttatcggtctttcgtcgtcggggtcccgcctaggtcgtcccgaggggacgaagggggctaggggacgtgggccggttaggggtagtttccgttggtactgaacgaggtaaacccaaagttgaactattaacgtccgaacgggtcgggtaacggttcccgggtaggaccgggggtaccctaagtttccaaccctacgttaccgtacccggaaggggtaacctaaaacttacccgaaaagtaccccggtaaaaccccttaccttaaccgttaccggttaaacgtaaaaccgttaaaacgttaaaccgtaaaacccgttaaacgttaacgggtaaacgggtaacgggttaaccggtaaacgggttaacccgggtttaaacccgggtttaaccggtttttaaaccggttaccggttacggttacccgggtaacccgttaacccggtacgggtaaacgggggtacgggttaacgggtaaacggttaaaacggttaaaacgggtttaccggttaacgtttaccgttaccggttaccccggttacccggttacccggtacccggtttacccgggggtacggggg

SEQ ID NO: 413962 - DNA, 680 bp, Homo sapiens
  misc_feature: GZ8MTXP02FNU7C.25.28.C06.1.454.CMB.2.raw
  modified_base (306)..(306): a, c, t, g, unknown or other
  modified_base (357)..(357): a, c, t, g, unknown or other
  modified_base (381)..(381): a, c, t, g, unknown or other
tcagactgtacagtcacgaccggtgctcgatttagagctcacgtattggggtttggggggggagaggagcccagcactagaagtcggcggtgtttccactcggtgatcagcactgaacgcagcggactcaccatggagtttgggctggaactggggttttcctcgttgctctttttaagaggtgtccagtgtcaggcgcatctggtggagtcgtgggggaggcgtgggtccagcctggggaagtccctggagactctcctgtgtggcgcctagactcacttcagtatatggcttcgctggggtccncagtgtcaggcgaaggggctggaggtggcgtgggtagttacgtttggtcgngacgagaacctaatagactatacncgacggcgggacggtccggtagggacgggggcctacttccaaccactccgtaccgaacgggaactaaacttaacccgaaacgaaaccgtaaacccctacttactacgtacgaaacgtaaaactaaacgtaaactaaacgtaggtaacggaggtaccggtaagggtaacggttaaccggttaccgtttaagttacgttgacggtaccgtacctacggtacggacggtacgggacgtaaacggaaaacgttacgtaacgtactacgtaccgttacccggtaccgtacccgtcggtacgggg

SEQ ID NO: 413963 - DNA, 578 bp, Homo sapiens
  misc_feature: GZ8MTXP02H6E81.25.28.C06.1.454.CMB.2.raw
  modified_base (314)..(314): a, c, t, g, unknown or other
  modified_base (387)..(387): a, c, t, g, unknown or other
  modified_base (393)..(393): a, c, t, g, unknown or other
  modified_base (402)..(402): a, c, t, g, unknown or other
  modified_base (445)..(445): a, c, t, g, unknown or other
  modified_base (497)..(497): a, c, t, g, unknown or other
  modified_base (514)..(514): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtgggtggaggtcgtggggggaggtcgtgggtccaggccgtgggaacgtccctgagactctcctggtgtggcgcctagctcacttcagtagttatggtcttcgcgtgggtcccncaggtcgaccgagggacgaaggggctggggagtggcgtgggtattcgtggtctgacagaccaaagtgacatancgacgnggacgtcgnggacgggcctatcacatcacgagactaatccaaagacaacctnatcagacaaaatcgaaactagtagagtagtagaagacttacggtactttaancgtagcgcgactgaggngacggtacgtaaaggtaaagtcgtaagtccgtactaccgttcccgaccgtaccgttcggccggg

SEQ ID NO: 413964 - DNA, 579 bp, Homo sapiens
  misc_feature: GZ8MTXP02JM1E2.25.28.C06.1.454.CMB.2.raw
  modified_base (193)..(193): a, c, t, g, unknown or other
  modified_base (301)..(301): a, c, t, g, unknown or other
  modified_base (375)..(375): a, c, t, g, unknown or other
  modified_base (400)..(400): a, c, t, g, unknown or other
  modified_base (441)..(441): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcncatctgggtggagtcgtgggggagcgtggtccagcctggggaatccctgagactctcctgtgtggcgcctagactcacctcagtagttatggcttcgtcgtgggtccncagtgtccgaggcgaaggggctggagtggacgtgggtagttacgttggtcctgacagaaccaaagtgactatancacgcggacgtcggtgagggggccnttacacactcgtacagggacaacgtaccaagacgaaccctntactactagataaactagaactaactgagagtacgaggacgtacgtacgtttattaacgtgtcgacgactacgaggacgttggacgtaaggtaaacgtaggtaacgtctaactctacccgtcgtaccgtacgtcgggg

SEQ ID NO: 413965 - DNA, 761 bp, Homo sapiens
  misc_feature: GZ8MTXP02INT7X.25.28.C06.1.454.CMB.2.raw
  modified_base (276)..(276): a, c, t, g, unknown or other
  modified_base (305)..(305): a, c, t, g, unknown or other
  modified_base (382)..(382): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatctggtggagtcgtgggggaggcgtggtccagccgtgggaacgtccctgagactctctgtgtggcgcctagactcaccttnagtagttatggcttcgtctcggggtcccnccagtgtccagggcaagggggctgggagtggcttggggtatttacgttgggtctgaacagaccaaatgaacattacncacggcgggagtcccggtagggacggggcccgatttccgaaaccacgtcctacccgaaaggggtacctaaacgtttacccgaaaacggtacccgaaacccctttacctaacttaccgtaacgtaaaccgtaaaagtaaacgtaaaaccgttaaacgttaagggtaaacgggtaacggtaccggtaaacgggtaaccggtttaacccggggtttacccgtttttaacgtttaccgttggttaccggtacccgtaccgttacggaacggggtaacggttacgggtaacggttaaaacggggtaaaacgtttaccggttaacgttacccgttacgttacccggtttaccccgtaccggtaccccggttaccgggtaccgggg

SEQ ID NO: 413966 - DNA, 615 bp, Homo sapiens
  misc_feature: GZ8MTXP02JI7B4.25.28.C06.1.454.CMB.2.raw
  modified_base (276)..(276): a, c, t, g, unknown or other
  modified_base (284)..(284): a, c, t, g, unknown or other
  modified_base (304)..(304): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctgggtggagtcgtgggggagcgtggtccagcctgggaatccctgagactctctgtgtggcgcctagactcaccttnagtattanggtcttcgtcgtcgggtccncagtcgccagggcaaggggctgggagtggcgttgggacgtttactgggtctgaacagaacctaaaatgaacattacgaccgaacgcggggtaacgttccgggaggacgggggcccttaattcccaaccctagtcctaccgaacgggaaccaaattacccgaaaggaccaaccctactaatctagaacaaatacgaaaacagttagaagagtagaaggatacggtactttatacgtgacgacgactagacggtagacgtacgtaacgtaaaagtcggtaagtctactacgtccgtacgaccgtcgtccgggg

SEQ ID NO: 413967 - DNA, 667 bp, Homo sapiens
  misc_feature: GZ8MTXP02GRZXN.25.28.C06.1.454.CMB.2.raw
  modified_base (274)..(274): a, c, t, g, unknown or other
  modified_base (284)..(284): a, c, t, g, unknown or other
  modified_base (306)..(306): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcggtgggggagcgtggtccagccgtgggaacgtcctgagctctctgtgtgcgctagctcaccttnagttagttancggtcttcgtcgtcgggtcccnctaggttcgaccgagggtccgaaggggctgggagtcgggcgttaggggtatttacgttggactaggaactagaacctaaaagtgaaactagtactcgaacgggtcggggagttcccggagggaccgggggtaccctaattcccgaaaccctacgtccgtaccggaagggaaactacgttaaacccgaaagaacccgtaacccttctacttacgacgaactaaaataccgaaactaacgtgaaggtacgacggagtacgttacggttactttagttacgtgtcgactaccgtaggaggtagcggtacgtaaaggtaaacgtcgtaacgtcctactaccgtcccgtacgtacctcgggaccgg

SEQ ID NO: 413968 - DNA, 622 bp, Homo sapiens
  misc_feature: GZ8MTXP02IC0NE.25.28.C06.1.454.CMB.2.raw
  modified_base (280)..(280): a, c, t, g, unknown or other
  modified_base (288)..(288): a, c, t, g, unknown or other
  modified_base (310)..(310): a, c, t, g, unknown or other
  modified_base (421)..(421): a, c, t, g, unknown or other
  modified_base (481)..(481): a, c, t, g, unknown or other
  modified_base (485)..(485): a, c, t, g, unknown or other
tcagactgtacagtcacgaccggtgctcgatttagagctcacgtattggggtttggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggaggtcgtggggggagcgtggtccaggccgtgggaacgtccctgagtactctcctgtgtgcgctagctcaccttnagtgttancggtcttcgtcgtcgggtaccncctaggtgtacccgagggcgaaggggctgggagttcgggcttggggtaagtttctgggtcctaggacaggtaacccaaaattgaacatatccgaacgcggagttcccgggngggacgggcctatccaccacgtccgacgaacggactaaactaccgaaagacctaaccctntacncagaactaaataacaactagtagagagtcggagtacgttcgtactttagcgtcgcgtactacgtcgaggtacgtcgaacgtaaacggtaacgtacgtaacgtactacgttaccgtcccggtaccgacggtcggacgg

SEQ ID NO: 413969 - DNA, 693 bp, Homo sapiens
  misc_feature: GZ8MTXP02FZR8F.25.28.C06.1.454.CMB.2.raw
  modified_base (359)..(359): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatcgtgggtggagtcggtggggggaggtcgtggtccagccgtaggggaactccctggacgtacctctccgtggtgtcggcctcctagacctctaccttcagttagttagtgggtctttcggtcgtcgggtccgcctagtcgtccgagggcgaaggggctaggnggtggcgtaggggtacgtttacgttggtctagaactagaacctaaatcgaactatactccgacggcggggacgtccggtagggaccgggggcctattaccgacctacgtccgtaccgacgggtaactaactaccgaaacgacgtaaccctactactactacgaacaaagtacgaaactaagtacggaaggagtaccggaaggtacgttaccgggtacgtttatacgtcgtacggaccgtacgtacggaaggtaggtacggtaacgtaaaacggtaaaacgttcgtaacgtacctacgtacccgttacccgtaccgaccgttcggtaacccgggg

SEQ ID NO: 413970 - DNA, 562 bp, Homo sapiens
  misc_feature: GZ8MTXP02JNS1O.25.28.C06.1.454.CMB.2.raw
  modified_base (301)..(301): a, c, t, g, unknown or other
  modified_base (365)..(365): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtgggtccagcctggggaactccctgagactctcctgtgtggcgcctagactcaccttcagtagttatggcttgtctgggtccncagtgtccaggcaaggggctggagttgctgggattactggtactgacagaccaaatgacatacncgacgcggagtcgaggacgggtctatcacactctacgagactaactacaacgacaacctactaatactacgacaataagaactaacgtagagagtacgacgagtacgtacgttacttacgtacgtgtacgacgacgacgagacgacgtaacgaaagtacgtaacgtactactactaccgtaccgtaccgtacgtcgg

SEQ ID NO: 413971 - DNA, 777 bp, Homo sapiens
  misc_feature: GZ8MTXP02IFJDQ.25.28.C06.1.454.CMB.2.raw
  modified_base (262)..(262): a, c, t, g, unknown or other
  modified_base (276)..(276): a, c, t, g, unknown or other
  modified_base (308)..(308): a, c, t, g, unknown or other
tcagactgtacagtcacgaccggtgctcgatttagagctcacgtattggggtttggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggagtcgtggggggagcgtggtccagccgtgggaactcctgagactctctgtgtggcncctagctcaccttnagtagttatcggtctttcggcgtcggggtccncctagtcgtaccgagggccgaagggggctaggggacggttcggggtcgttaggggtacgttttacgttggggtccttaggaacctaaggaaacccctaaaagttgaaactattaacgtacccgaacgggcggggtaacggttcccgggtagggggaaacgggggtccccctaagtttccccaaacccgtacgttacccgtacccggaaaggggtaaaccctaaacgtttacccgaaaaacggtaacccgtaaacccctttacgtaaccgttactacgaaaccgtaaaaattaccggaaaacgttaaacgtttaggaaggtaacggtacggaagggtaacgttaaccggtttacgttttaagttacgtacgtacgtaccggtacgtcgaaggtacggtaggtaacgtaaagggtaaaactcgttaacgtcctacgtaccgttcccggtaccgtccgttaccggtcggggg

SEQ ID NO: 413972 - DNA, 570 bp, Homo sapiens
  misc_feature: GZ8MTXP02ILX2J.25.28.C06.1.454.CMB.2.raw
  modified_base (264)..(264): a, c, t, g, unknown or other
  modified_base (279)..(279): a, c, t, g, unknown or other
  modified_base (305)..(305): a, c, t, g, unknown or other
  modified_base (371)..(371): a, c, t, g, unknown or other
  modified_base (384)..(384): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctgggtggagtcgtggggggaggcgtggtccagcctggggaagtccctgagactctcctgtgtggcncctagactcaccttnagtagttatggcttcgtctgggtccncagtgtccagggcaaggggctggagtggctggggatttactggtctgacagaaccaaatgacatancacgcggatccgnggaggggcctatcacatctacaggacataccaagacgaaccctctatctagacaaatacgaaactaacttagagagtcgaaggactacggtacgtttaattacgtgtacgcgacgtacgaggagtacggacgtaaggaaaagtcgtaagtctacgtacgttcccgtaccgtaccgtacgtacgggg

SEQ ID NO: 413973 - DNA, 779 bp, Homo sapiens
  misc_feature: GZ8MTXP02FUNYE.25.28.C06.1.454.CMB.2.raw
  modified_base (265)..(265): a, c, t, g, unknown or other
  modified_base (280)..(280): a, c, t, g, unknown or other
  modified_base (310)..(310): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcacatggagtttgggctgaactgggttttcctcgttgctcttttaagaggtgtccagtgtcaggcgcatctgggtggagtcggtgggggaggcgtggtccaggccgtgggaacgtccctgacgactctcctgtgtggcncctagactcaccttnagttagtatggtcttcgtcgtcgggtcccnccaggtcgtaccgaggggacgaagggggctaggggaggttcgggcgttaggggtacgttttacggtttagggtcctagaaccgaagtaaccctaaaagtcgaaactactaacgtaccgacgggtcgggtacgtccggggtaagggaccgggggtccctaatttaccgacctacgtccgtaccggaaacgggtaacctaacgttacccgaaaacggaacccttaacccttactacgtactacggaaacctaaaagtaaccgtaaaacgtacgttaggaacgaacggttaacggaaggttaaccgttaaccggggtttccttttaaagtacggttacggtacgtaacccggacgtacgggaaggggtacggttaacgggtacgttaaaaacggggtaaaacgttcgggttaaccttacgtaccgttaaccgttcccccggtaacggtaccccgtacggggttacccggggg

SEQ ID NO: 413974 - DNA, 596 bp, Homo sapiens
  misc_feature: GZ8MTXP02HGUTN.25.28.C06.1.454.CMB.2.raw
  modified_base (196)..(196): a, c, t, g, unknown or other
  modified_base (447)..(447): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcncatctggtggagtcgtgggggagcgtggtccagcctgggaatccctgagctctctgtgtgcgcctagactcaccttcagtagttatggctttcgtctcgggtcccgccagtgtccagggcgaaggggctagggagtggcgtggggtagtttacttgggtctgactagaaccaaatgaacatatcgacgcggagtccgtggacgggggccagtcaccatcctaccgaggacaactaccaaagacgaaccctntactctagacaaatacgaactaacgttagagtagacgagacgttacggtacgtttaattacgtgtacgtaccgtacctacgacggtagtaggacgtaaggtaaaagtcgtaacgtctactacgttcccgtcgtaccgttacgtccgggg

SEQ ID NO: 413975 - DNA, 739 bp, Homo sapiens
  misc_feature: GZ8MTXP02H6YWO.25.28.C06.1.454.CMB.2.raw
  modified_base (301)..(301): a, c, t, g, unknown or other
  modified_base (323)..(323): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatcgtggtggaggtcggtgggggaggcgtggtccaggccgtagggaacgtcccgtgacgtactcgtcctggtggtggccgactagctcaccttcagtacgttanggtcttcgtacgtcgggtcccnccgagtcgtccgagggcgaaggggctagggaggtgggcgtaggggtatttacgtgggtctacggaacgaagaacccaaaagtcggaaacctaagttacgtaccggaacggtcgggggtaaacggttccggggtaggggaccgggggtacctacgttacccaacctaacgttcccaccggaaacgggtaaactaaacgttacccgaaaaggtaccctaaaccctcgtaactcgtacgaaactaaacgtacgaaaacctagttaggagtaacggtaccggaaagtacggttaaccggtacgttttaagacgttcggtacgaccgtaaccgttaggacggtaaggtacggtacgtaaaaggtaaacgtcgtaagtacccgtacgtacgttacccgtacgtacccgttcgggacccgggg

SEQ ID NO: 413976 - DNA, 625 bp, Homo sapiens
  misc_feature: GZ8MTXP02JXBAT.25.28.C06.1.454.CMB.2.raw
  modified_base (305)..(305): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaacgtccctgagactctcctgtgtggcgcctagactcaccttcagtattagtggctttcgtcgtgggtccnccagtgtccagggcgaaggggctgggagtgggcgtgggagtttacttggctgactagaacctaaagtgacatacgtcacggcggacgtccggtggacgggggacctagttaccaaccctacgtaccgtacccgaagggtaactaaacttacccgaaacgaacgaacccctctaactctacgacaaatacgaaactaactagagagtacgaaggacgtacggtaccgtttattacgtgtacgtacgaccgtagacggtagtcggacgtaacggtaaaacgtcgtaagtctactacgttacccgtcgtaccgtcgaccgggg

SEQ ID NO: 413977 - DNA, 636 bp, Homo sapiens
  misc_feature: GZ8MTXP02FGVB9.25.28.C06.1.454.CMB.2.raw
  modified_base (300)..(300): a, c, t, g, unknown or other
  modified_base (348)..(348): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaatccctgagactctcctgtgtggcgcctagactcaccttcagttagtatggtcttcgtctgggtccnccagtgtccaggcaaggggctggagtggctgggtagttacgttggtcngacagaacctaatgactatactacgacgtcgggaagtccggtaggacgggggtctagttcccaacgtactctacccgtagggaactaacgttacccgaaagaccgaacccttactaacgtaccgttagaactaaataggaaactaagtttaggaagtacgtacgggaagtaacgttacggtacgtttaagtacgtgtcgacgtaccgtgtaggagttcggacggtaaggaaaacgttcggtaacgtcgttacgtaacgttccccggtacgaccgttacgggaccgggg

SEQ ID NO: 413978 - DNA, 607 bp, Homo sapiens
  misc_feature: GZ8MTXP02JQLRW.25.28.C06.1.454.CMB.2.raw
  modified_base (216)..(216): a, c, t, g, unknown or other
  modified_base (284)..(284): a, c, t, g, unknown or other
  modified_base (343)..(343): a, c, t, g, unknown or other
  modified_base (370)..(370): a, c, t, g, unknown or other
tcagactgtacagtcacgaccggtgctcgatttagagctcacgtattgggtttgggctgagctgggttttcctcgttgctcttttaagaggtgtccagtgtcaggtgcagctggtgcagtctggggggaggcgtggtccacccgtgggaggtccctgagactctcctgtgcagcctctggattcatcttcaacacctatgcaatgcactgggtccnccaggctccaggcaaggggctgggagtgggtgctagttattcatatgataggaaactaaataaaagtntagttgactcgtggcggccattccacgtctaccagagacagataccgaagaagacggtntataccacaaatacaacaactgaacgntccggaaagaccacggacttagtcgttaattactgtagacgagagacgtcggggcgcgacggtccgaccccgaggtaaaccgtcggactacgtagtcccgagactacggacctagtcggacgggggacgaaacgggacgacggtcaacgtccgtccttaccgtctcgaccctaccgaacccgtaacggacccgtaccggttcccggtacccgtttccccccggcggtccccgtcccg

SEQ ID NO: 413979 - DNA, 675 bp, Homo sapiens
  misc_feature: GZ8MTXP02HJGVG.25.28.C06.1.454.CMB.2.raw
  modified_base (293)..(293): a, c, t, g, unknown or other
  modified_base (312)..(312): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcaccatggagtttgggctgaacttgggttttcctcgttgcttcttttaaggaggtgtccagtgccaggcgcatcgtggtggagtcgtggggggagcgtggtccagccgtgggaactccctgacgcttctcctgtgtggccgcctagacctcaccttcagtagttanggtcttcgtctgggtcccnccaggtcgtccgagggcgaaagggggcctagggagtgggtctggggtagtttacgtggtctgaaacgtaggaacccaaaatcgaacattacgcgaacggcggtacgtccggtagggacggggcctattaccgaccatcctaccgaagggactaaacttacccaaggtaaccaccctcgtactactacgaaataaatacgaaactaacgttgaacggtactacgggaacggtaacgttaccggttacgtttaaatttcgtagttacgacccgtacctacggaggtacggtggtacgtaaacgggtaaaagtcggttaacgtacctacgttaccctccggtaccggtaccgttcggacccggggg

SEQ ID NO: 413980 - DNA, 698 bp, Homo sapiens
  misc_feature: GZ8MTXP02GEBZP.25.28.C06.1.454.CMB.2.raw
  modified_base (177)..(177): a, c, t, g, unknown or other
  modified_base (279)..(279): a, c, t, g, unknown or other
  modified_base (312)..(312): a, c, t, g, unknown or other
  modified_base (394)..(394): a, c, t, g, unknown or other
tcagactgtacagtcacgaccggtgctcgatttagagctcacgtattgggtttgggctgagctgggttttcctcgttgctcttttaagaggtgtccagtgtcaggtgcagctggtgcagtcgtggggggagcgtggtccacccgtgggaggtccctgagactctcctgtgcagcctntggattcattccttacaaccacctagtgacaatgcacgtcgggtcccgaccgaggcctccgaggacggaaggggctgggaggtgggtggactagtttacttnaatatcgaagtaggaaaacttaaagtaaaagtnttaggttacgacgtccgggtggccgggtacctattcccgaccgttcaccgagaagacagactacgaaagacgtaggtattanacccaccaaaatcaaaacctacgtgacgacgtaccgaaggaacgtcgtcgttagtacgttaactgtggtacgagacggagtacccgggtgggacccggtcgacggttcccccgtaccggaaggtaaccgggttccaccttaacttcgtacccgataagtacgactgttacggggagggaaccgaaacgggtccgacgttacgtagtttccccgacgtttcccccacgtccccgtaccctaacccggaccggtaacccgtccctacccggttccccgttcccccgtcccgcggtacccccgtccg

SEQ ID NO: 413981 - DNA, 745 bp, Homo sapiens
  misc_feature: GZ8MTXP02F3T5Z.25.28.C06.1.454.CMB.2.raw
  modified_base (174)..(174): a, c, t, g, unknown or other
  modified_base (300)..(300): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagnggtgtccagtgtcaggcgcatctggtggagtcgtgggggagcgtggtccagcctgggaactccctgagactctcctgtgtggcgcctagactcaccttcagttagtatggcttcgtctgggtcccncagtcgtccgaggcgaaggggctggagtgggcgtggggtactttacgttgggcctaggaccaggaaccaaaagtgaactatacgtccgaacgggcggagtcccggtaggaccgggggtcctaattccaacccgtatccgtaccgaacggggaactaacgttaacccgaaaggaaccgtaaaccctactacgtactagaacctaaaacgtacgaaaactaacgttaggaaacggtaacgttaccggaaagggtaacgttaaccgggttaccgttttaacgttaaccgttagggtacggtaccggtaacccgtacggtaaacggggtaacggttacgggtaaccggttaaaacggggtaaaaacggttccggttaaacggttaccgttaaccggttaaaccggtttcccccggttaaccggtacccggttaccggggtaaccggggg

SEQ ID NO: 413982 - DNA, 755 bp, Homo sapiens
  misc_feature: GZ8MTXP02IPK8E.25.28.C06.1.454.CMB.2.raw
  modified_base (195)..(195): a, c, t, g, unknown or other
  modified_base (266)..(266): a, c, t, g, unknown or other
  modified_base (315)..(315): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcncatctgggtggagtcgtgggggaggcgtggtccaggccgtgggaactcccgtgacgctctcctgtgtggcncctagactcaccttcagttagttatggtcctttcgtcgtcgggtccccncctaggtcgtcccgagggcgaagggggctaggggaggtgggcgttaggggtattttaccgtggtctagactagaaccaaatgaactatactccgaacggcgggtacgtccgggtaggggacggggccctaatttccgaaaccctagttcctacccggaagggtaaacctaaacgtttaacccgaaaacggtaacccgtaaaccccttctaaacgttaccgtaacgtaaaccctaaaagttaacggaaaacctaaccgtttagggaaggtaacggttaccggaaggttaacgttaccgggttaccgttttaagttaccgtggtaccgtaccgtacccgttagggacgggtaacggttacggacggttaaaagggtaaaacgttcggtaacgttccgttaacgttaccgttacccggtaccgttacgttccgggtacggggg

SEQ ID NO: 413983 - DNA, 789 bp, Homo sapiens
  misc_feature: GZ8MTXP02JM0S6.25.28.C06.1.454.CMB.2.raw
  modified_base (299)..(299): a, c, t, g, unknown or other
  modified_base (337)..(337): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatcgtggtggagtcgtgggggaggcgtgggtccaggccgtgggaacgtccctaggagtaccttcgttcctggtggtcggccgtcccttagacctccaccctttnagttagttatcgggtctttacggcgttcggggtccccncctaggtcgtacccgagggaccgaagggggtcttggggaggttcgggacgttagggggtacgttttacgttcgggtctaggaaaccgagaaaccctaaagtcgaactacgttacgtccgaaccgggtcgggtacgtccgggtaggggaccgggggtcctactttacccgaacccgtacgttccgtaacccggaaggggtaaacccttaaacgttaaacccgaaaacgggaaacccgttaaaacccccgtttcgttaacctaccgtaaacggtaaaacctaaaacgttaacgtaaaaccgttaaacggttaacggaagggtaaacggtaccggtaaacggtaaccgtttaccggtttacgtttacgtacgtcgtacgtaccgtacgtaggacggtacggtacggaacgtaagtaacgtgtaacgtctacgtaccgtccgtacgtcgtcggcgg

SEQ ID NO: 413984 - DNA, 587 bp, Homo sapiens
  misc_feature: GZ8MTXP02JG07Y.25.28.C06.1.454.CMB.2.raw
  modified_base (318)..(318): a, c, t, g, unknown or other
  modified_base (321)..(321): a, c, t, g, unknown or other
  modified_base (579)..(579): a, c, t, g, unknown or other
tcagactgtacagtcacgaccggtgctcgatttagagctcacgtattggggtttgggggcagaagtctctctcagtcaggacacagcatggacatgagggtccctgctcagctcctgggactcctgctgctctggctcccagctatcagatgtggcatccagatgacccagtctccactccctccctgtctgcatcgtgttggagacagacgtcaccatcacttcggccgggcgagtcgaggctagtagtaaattgttggcctggtatacgagacgaagaaaccgagggtaactcctaacctctactatctatgctcnctntcctatttcgacgttacgtttcgggtcccgttctacgtacttccgaggcggtagtaggtcgggtcgtacgggactagtaacttccactctacacgtatcacggtccacgccgtgaccgtcgtccgtaaggaattgtattcgaacttaactttatacgtaattaaactaaagttcacggttacgtaccggtaccgtagggtactccgggtaccgaccgggagttaacggaaggtcggaacacgttaacgaaacgtcggngttaccgg

SEQ ID NO: 413985 - DNA, 668 bp, Homo sapiens
  misc_feature: GZ8MTXP02JR707.25.28.C06.1.454.CMB.2.raw
  modified_base (304)..(304): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtgggtcccagcctgggaagtccctgagactctcctgtgtggcgcctagactcaccttcagtagttatggctttcgtctgggtcccncagtgtccaggcaagggggctgggagtcgggctggggactttacgttggcctgacagaacctaaatgactaatatcgacgggcggtagtcccggtggacgggggtcctaattaccaacccactcgtacccgaagggaaccaaacgttacccaaagaccgaaaccccttacgtaactacttcgaacaaagttacgaaactaacgttagggaacgtaggaccgtaagggtacttaaccgggtccgttttaagttacctggttcggaccgtaacccgttcgaaacgggtagggttcggaacgtaaagggtaaaaacgttagtaagttaccgtactacgtttacccgtcggtacccgtcggtcggggg

SEQ ID NO: 413986 - DNA, 717 bp, Homo sapiens
  misc_feature: GZ8MTXP02JLD6D.25.28.C06.1.454.CMB.2.raw
tcagactgtacagtcacgaccggtgctcgatttagagctcacgtattggggtttgggggggagaggagcccagcactagaagtcggcggtgtttccactcggtgatcagcactgaacgcagcggactcaccatggagtttggctgaacttgggttttcctcgttgcttcttttaagaggtgtccagtgtcaggcgcatcgtggtggagtcgtgggggagtcgtggtccaggccgtgggaacgtcccgagagtacctctccgtgtgtcggcctcgtagactctaccttcagttagttagtggtcctttcgtcgtacggggtccacctaggtcgtccgagggtacgaaggggtctaggagtgggcgttggggtactttacgttggtactgaacctaggaaccctaaatcggaacctagtacgtaccgacgggtccgggtacggttcccgggaagggacgggggtcccttaacgttcaaaccccgtagttacccgtaccgaaacggggacttaaaccgttacccgaaaagtaacccgtaacccttacgtacgtacctacgaaacgtaaataacggaaacttaacgtagagtacgtagacgtacgtacggttacgtttagtaccgtgtacgaccgtacgtacgaggtacgttacggacgttaaaggtaaacgtcgtaagtccctaacgtcgttacccgtccggtaaccgtcgtacccgggg

SEQ ID NO: 413987 - DNA, 628 bp, Homo sapiens
  misc_feature: GZ8MTXP02I9Q2C.25.28.C06.1.454.CMB.2.raw
  modified_base (258)..(258): a, c, t, g, unknown or other
  modified_base (480)..(480): a, c, t, g, unknown or other
tcagactgtacagtcacgaccggtgctcgatttagagctcacgtattggggtttggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggagcgtggtccagcctgggaagtccctgagctctcctgtgtggcnctagactcacttcagtagttatgggcttcgtcgtgggtccgccgagtgtcccaggcaaggggctggagtcggctgggtgttactggctgacagaccaaatgacatatcacggcgggtagtccggtaggacgggggtcctagttcgacccaacgttccgtaccaaacggggactaacttacccgaaaaggtaccaacccttactactacgtacgaacttaaanacgaaaactaacgttaggaggaaagtaccgaaggtacgtaccgttaccgttttattaccgtggtacgtacgcccgtagtacggtaggagtcgtaaaagggaaagttacggtaagttctactacgtacccgtcgaccgtcgtaccgggg

SEQ ID NO: 413988 - DNA, 692 bp, Homo sapiens
  misc_feature: GZ8MTXP02IUAQ0.25.28.C06.1.454.CMB.2.raw
  modified_base (263)..(263): a, c, t, g, unknown or other
  modified_base (287)..(287): a, c, t, g, unknown or other
  modified_base (306)..(306): a, c, t, g, unknown or other
tcagactgtacagtcacgaccggtgctcgatttagagctcacgtattgggtttggggggagaggagcccagcactagaagtcggcggtgtttccactcggtgatcagcactgaacgcagcggactcaccatggagtttgggctgaactgggttttcctcgttgcttcttttaagaggtgtccagtgtcaggcgcatcgtgggtggagtcgtgggggagcgtggtccagccgtgggaactccctgacgactctctggtgtggcncctagctcaccttcagttagttanggtcttcgtctcgggtccncagtgtccagggcgaaggggctggagtggcgttggggtatttacgtggtctgaacgtagaaccaaagtgacatacgtccgacggcgggagttccggtggacgggggtccctattccacctacgtcctaccgaagggtaacaagttaccaaagacgtaaccctctaactcgtagactaaactacgaaactaagttacgaagtacgtacgaacggtaacgttaccggtacggttttaacttacgtacggttacgtaccggtaacccttaggtaaacggtacgggtacggggttacgttaaaacggggtaaaaacgtttcgggttaacgttacgttacccgttaccgtttaccccggtaccggtaacccgtttcgggttaacccggggg

SEQ ID NO: 413989 - DNA, 716 bp, Homo sapiens
  misc_feature: GZ8MTXP02F4MK2.25.28.C06.1.454.CMB.2.raw
  modified_base (261)..(261): a, c, t, g, unknown or other
  modified_base (302)..(302): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatctggtggagtcgtgggggaggcgtggtccagccgtgggaactccctgagactctcctgtgtggcncctagactcaccttcagtagttatggcttcgtctgggtccnctagtcgtccaggcgaaggggctggagtggctgggatttacgtggtctaggacagacccaaatgaactatatcgaacggcggtacgtccggtaggaacgggggtccctaatttccgaacctactccgtacccgaaggggaaacctaaagttacccgaaaggaacctaaaccccttacttaactaccgtagaactaaaacgttacgaaaacctaacgtttacggaaggtaacggttacggaaacggtaacgttaaccgggtttaaccgttttaacgttaaaccgttggtacgtacccgaaccgttacggaacggggtaacggtacgggtacgttaaaacgggtaaaaacggttaccgttaaggttaccttaccgtaccgtttaccccggtacgtaacccgttcggtaaccggggg

SEQ ID NO: 413990 - DNA, 737 bp, Homo sapiens
  misc_feature: GZ8MTXP02IO0O4.25.28.C06.1.454.CMB.2.raw
  modified_base (260)..(260): a, c, t, g, unknown or other
  modified_base (282)..(282): a, c, t, g, unknown or other
  modified_base (299)..(299): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaacttgggttttcctcgttgcttcttttaagaggtgtccagtgtcaggcgcatctggtggagtcgtgggggagcgtggtccagcctgggaacgtccctgagctctctgtgtggcnctagctcaccttcagtagttanggcttcgtctgggtccncagtgtccgaggcgaaggggctggagtgggctggggtagtttactgggtctgacgagaacctaaatgaacagtatcgacggcgggtaacgtccggtgggacgggggtccctagtttaccaaccgaactccgtaccgaacggggaactaaacgttacccgaaaacgaaccggtaaaacccccgttacgttaacttaccgttacgaaactaaaacgttaacggtaaaaccctaaacgtttagggaaacggtaaacgggtaccggtaaagggtaaacggttaaacccgggttaaccggttttaacgtttaaacccgttggtacggtacccgtacccgttaccggtaacgggtaacggtacgggtaccgtaaagggtaaaaacggttcggtaacgtacgttaccgtacgttacccgtaccgtaacccgttcgtacccggggg

SEQ ID NO: 413991 - DNA, 610 bp, Homo sapiens
  misc_feature: GZ8MTXP02JV9GL.25.28.C06.1.454.CMB.2.raw
  modified_base (262)..(262): a, c, t, g, unknown or other
  modified_base (276)..(276): a, c, t, g, unknown or other
  modified_base (284)..(284): a, c, t, g, unknown or other
  modified_base (303)..(303): a, c, t, g, unknown or other
tcagactgtacagtcacgaccggtgctcgatttagagctcacgtattgggtttgggggggagaggagcccagcactagaagtcggcggtgtttccactcggtgatcagcactgaacgcagcggactcaccatggagtttgggctgaactgggttttcctcgttgctcttttaagaggtgtccagtgtcaggcgcatcgtggtggagtcgtgggggagcgtggtccagccgtgggaacgtccctgagtctctcctgtgtggcncctagctcaccttnagtattanggtcttcgtctgggtcccncctagtcgtccagggcgaaggggctgggagtggcgtggggtatttacgtgtctagacagaaccaaatgacatatcgacgggcgaggtccggtggacggggccagttaccaccactccgtacgacggtaactaacttaccgaagaccgtaaccctactactctacgacaaatagaactactagagacgtacgagtagtaccggtacgtttatacgtgtcgacgtaccgtagacggtaggtacggtacgtaacggtaaaacgtcgtaagtactacgtaccgttcccggtccgtaccgtacggtccgggg

SEQ ID NO: 413992 - DNA, 739 bp, Homo sapiens
  misc_feature: GZ8MTXP02IRNAZ.25.28.C06.1.454.CMB.2.raw
  modified_base (177)..(177): a, c, t, g, unknown or other
  modified_base (281)..(281): a, c, t, g, unknown or other
  modified_base (306)..(306): a, c, t, g, unknown or other
  modified_base (398)..(398): a, c, t, g, unknown or other
tcagactgtacagtcacgaccggtgctcgatttagagctcacgtattggggtttgggggggagaggagcccagcactagaagtcggcggtgtttccactcggtgatcagcactgaacgcagcggactcacatggagtttgggctgaacttgggttttcctcgttgcttcttttaagnggtgtccagtgtcaggcgcatcgtggtggagtcggtgggggagcggtggtccaggccttaggggaactccctgagactctctgtgtgcgcctagactcaccttnagtagttatgcttcgtcgtggtccnctagtgtccgaggccgaaggggtctagggaggtcggcgttaggggtactttacgttgggccttgacgaagacctaaaagtcgaactattacnccgaacgggccggggtaagtcccggtaggggacgggggtccctaagtttccaacctacgtcccgtaccgaagggtaaccaaacgttacccaaaagtaccgtaaacccctcgttaactccgtaagaactaaaacgtacgtaaacgttaacgtacgggaaggtaacggttaacggaaacgggttaaacggttaccggtttaacgtttaacttacgtacggtacggtaccgtaacgtacggtacgggtaacggacggttaaacggtaaaacggtaaaacggttacgttaacgttacccgttaccgtaccggttacccgtaccggttaccgtccgggtaccgggg

SEQ ID NO: 413993 - DNA, 661 bp, Homo sapiens
  misc_feature: GZ8MTXP02IVYU0.25.28.C06.1.454.CMB.2.raw
  modified_base (209)..(209): a, c, t, g, unknown or other
  modified_base (275)..(275): a, c, t, g, unknown or other
  modified_base (296)..(296): a, c, t, g, unknown or other
  modified_base (312)..(312): a, c, t, g, unknown or other
  modified_base (319)..(319): a, c, t, g, unknown or other
  modified_base (394)..(394): a, c, t, g, unknown or other
tcagactgtacagtcacgaccggtgctcgatttagagctcacgtattggggtttttggggggaagaggaagactgacggtcctcccaggagttcaggtgctgggcaccttgggcacggggggaggcgtggtccagcctgggaagtccctgagattctcctgtgtggcgcctagactcaccttcagtagttatggcttcgtctgggtccnccagtgtccaggcaaggggctggagtggctgggattactggtctgacagacaatgacatatcacgnggagtcgtgagggcatcacanctcaggacatcaaganaaccctntatcagacaaatgaaactaacttgaagtagtaccgaggtactacggtactttataccgtgtcgcgactgaacggngtaggactaaagggtaaaagtcgtagtctacacgtttcccgtacgtaccgttcggtacggggaccgaacgggcccgtaaacccgtcggttacccgacccggttcttaccccgtacgtaccggccctttacccgaaccgtaaaccggggtcccctaacgttcccgggtttacccttcccccgtcggccccgtacccggttccgcccgtacgacggaccgcccgtaccggtcggtacgggactacggacggtcccggtccggtcggccg

SEQ ID NO: 413994 - DNA, 529 bp, Homo sapiens
  misc_feature: GZ8MTXP01CN67A.52.72.G06.1.454.CMB.2.raw
  modified_base (363)..(363): a, c, t, g, unknown or other
  modified_base (439)..(439): a, c, t, g, unknown or other
  modified_base (454)..(454): a, c, t, g, unknown or other
tcagcgcagtacgacacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctctggtaccaacaataccccggcaaacgtccccaaactcatgatctttgagtcagtgatcggcccgcaggggtttctcatcgcttccctccggctccgaatctgggcngcacggcctccctgaccatctctggctcaggctgagcgagctgattatactgcagctcatatacaaactagaaacngttagggtgttcggnggccggtaacaaaccgtgaccgtcctacgttcaggttcccaagggcctcgccccgtggttcaaccgttcgtcccg

SEQ ID NO: 413995 - DNA, 555 bp, Homo sapiens
  misc_feature: GZ8MTXP01DTJFH.52.72.G06.1.454.CMB.2.raw
  modified_base (323)..(323): a, c, t, g, unknown or other
  modified_base (334)..(334): a, c, t, g, unknown or other
tcagcgcagtacgacacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgactattggtacttataattctgtctctggtaccaacaataccccggcaaagtcccaaactcatgatctttgagtcagtgatcggcccgntaggggtttcncatcgcttcctccggctccgaagtctaggcaagcaccggcctcccctgacccatcctctgggcctccgaggctgaggacgaggctgattatactgcagtctacatataacaaacgaagtaaacacgttgggtacgttcgggcggaaccgggaacaaacgtcgaccgtaccgtcgttaccgcgcccgaaggcctcgccccctggcctaacttcgttaacccc

SEQ ID NO: 413996 - DNA, 553 bp, Homo sapiens
  misc_feature: GZ8MTXP01A4JQQ.52.72.G06.1.454.CMB.2.raw
  modified_base (227)..(227): a, c, t, g, unknown or other
  modified_base (328)..(328): a, c, t, g, unknown or other
  modified_base (337)..(337): a, c, t, g, unknown or other
  modified_base (366)..(366): a, c, t, g, unknown or other
tcagcgcagtacgacacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaaccngcaatgactatttggtaacttataattctgtctcctggtaccaacaataccccggcaaagtccccaaactcatgatctttgagtcagtgatcggcccgcgnggggtttcncatcgcttcctccggctccaagtctggcngcgacggcctccctgaccatctctgggctcgaggcctgacggacgacgctgattatactgcagctacaatataacaaacacgaaactaccgttagggtcgttcgggcgggtaacggaaccgaacgtcgacccgtacgtaccgttcgcgacccgaagtcctcgccccctcggttccaacttcgtcccg

SEQ ID NO: 413997 - DNA, 808 bp, Homo sapiens
  misc_feature: GZ8MTXP01DO1C4.52.72.G06.1.454.CMB.2.raw
  modified_base (212)..(212): a, c, t, g, unknown or other
tcagcgcagtacgacacgaccggtgctcgatttagctacgactgcaagggaaagggggggggtctcaggaggcagcgctctcgggacgtctccaccatggcctgggctctgctattcctcaccctcctcactcagggcacgagggtcctgggcccagtctgccctgactcagcctgcctcgtgtctgggtctccgtggacagtcgatcaccntctctgcacgtggaaccagacaatgactagttaggtaacttattattctagtctctacggtaaccaacaactaccccggacaaaccgtaccccaaactcatgtattcttagagtcaggtcgacgtccggcccgtacggttacgggggtttctacgtacgtccgtcctttaccccggtcccggtacctaccgtaacgttccgtacgggactccggaccgtacccgggtccccttaccccgacgtacccgttactcccgttcggtcgggccttaccggacggtcgttacgggaacgggtacgtacggtcgttaacggtactttaaacgttccgtcgggacgtacgtaccttacctaaaagttaaacctaaaacgtaaaccgtaaacggttaaaccgttacgggttttacggggggttaccggggtttacccggggaaccggggggtaaacccggtaaccgttaaaccggtttcccgggaaccccggttaaccgtacccggttaccgttacccggttaaccccggtaacgggtccccggtccccggttaccccggttccgggttacctttaaccccgtttccgggttttaacccccccg

SEQ ID NO: 413998 - DNA, 547 bp, Homo sapiens
  misc_feature: GZ8MTXP02JWXYB.52.72.G06.1.454.CMB.2.raw
  modified_base (336)..(336): a, c, t, g, unknown or other
  modified_base (440)..(440): a, c, t, g, unknown or other
tcagcgcagtacgacacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaacgtccccaaactcatgatctttgaggtcagtgatcggcccgcgtaggggtttcncatcgcttcctccggtctccaagtctggcagccacggccctcctgaccatctcgtgggcctcccgaggctggaggaccgaggtctgattacttactgcagctanatataacaaacagaaactcgttagggtgttcggcggtaccgggacaaacgtcgaccgtacctacgtcacgcccaaggcctcgcccccgtacggtccacgtcttcccg

SEQ ID NO: 413999 - DNA, 533 bp, Homo sapiens
  misc_feature: GZ8MTXP02GIVDE.52.72.G06.1.454.CMB.2.raw
  modified_base (252)..(252): a, c, t, g, unknown or other
  modified_base (361)..(361): a, c, t, g, unknown or other
tcagcgcagtacgacacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattntgtctctggtaccaacaatacccggcaaagtccccaaactcatgatctttgagtcagtgatcggcccgcaggggtttctcatcgcttcctccggctccaagtctaggcngcacggcctccctgaccatctctggctcagctgagcgagctgattattatgcagctacatataacaaacaagaaaactacgttaggtagttcggacgggtaccgggaacaaacgtgacccgtacgttaccgacacgacccaaggcctcgccccctggtaccactcgttcccg

SEQ ID NO: 414000 - DNA, 513 bp, Homo sapiens
  misc_feature: GZ8MTXP02HKRQM.52.72.G06.1.454.CMB.2.raw
  modified_base (328)..(328): a, c, t, g, unknown or other
  modified_base (354)..(354): a, c, t, g, unknown or other
  modified_base (439)..(439): a, c, t, g, unknown or other
tcagcgcagtacgacacgaccggtgctcgatttagctacgactgcaagggaaaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctctggtaccaacaatacccgcaaagtccccaaactcatgatctttgagtcagtgatcggccgcgagggtttcncatcgcttcctccgctcagtctggcngcacggcctccctgaccatctctggcctccaggcctgacggacgaggctgtattattactgcagtctcatatacaaacagaaacncgttaggtgttcggcggtcggaccaaactcgaccgtctacgcacgccaaggctcgcccctcggccactctcccg

SEQ ID NO: 414001 - DNA, 530 bp, Homo sapiens
  misc_feature: GZ8MTXP02F3ZAM.52.72.G06.1.454.CMB.2.raw
  modified_base (357)..(357): a, c, t, g, unknown or other
tcagcgcagtacgacacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataatctgtctctgtacaacaatacccggcaagtccccaaactcatgatctttgaggtcagtgatcggcccgcgtaggggtttctcatcgcttcctccggctcagtctggcngcacggcctccctgaccatctcgtgggcctcgaggctgacggacgagctgattattactgcagctacataataacaaaacagaaacgtacgttgggtacgttcggcggacgggaccaaacgtcgaccgtctacgtcacgacccaagcctcgcccctacgtccacgtcttcccg

SEQ ID NO: 414002 - DNA, 544 bp, Homo sapiens
  misc_feature: GZ8MTXP02FPQIZ.52.72.G06.1.454.CMB.2.raw
  modified_base (303)..(303): a, c, t, g, unknown or other
  modified_base (430)..(430): a, c, t, g, unknown or other
  modified_base (433)..(433): a, c, t, g, unknown or other
tcagcgcagtacgacacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcatggaaccagcaaatgaactagttggtacttataattctgtctctggtaccaacaataccccggacaaacgtaccccaaactcaangatctttgagtcagtgatcggcccgcagggtttctcgatcgctcctccgctcaagtctggcacgcacggcctcccgtagaccactctctggcctcaggctgagaccgaggctagattagtactgcanccntaatataacaaacagaaactacgtggtgtcggcggacggacgaaatcgaccggttctacgtaccacgacccgaagtctcccggccccctcggtaccacttccgtttccccg

SEQ ID NO: 414003 - DNA, 749 bp, Homo sapiens
  misc_feature: GZ8MTXP02H55NI.52.72.G06.1.454.CMB.2.raw
tcagcgcagtacgacacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacatttggtacttataattctgtctctgtaccaacactacccgacaaacgtaccccaaatcatgattctttgagtcgagtacgacgtccgggcccgtacggtaggggtttctacgacgtccggtcttccccgtcccggccttaccgaacgttcgtgggaccacggcccgtaccgggccccctcccgttacgaacccctacttcccgtcccgtcggggtaccccttcccggaacgggttcccggtagggtaaaccgggggacgacggggtaccttacgggtaatttttaaccgtacttcggctaacggttcctaaccgttaataaaccttaaaactaaaacgaaacggttaaaaccgttaccgggtttaggggttcgggttaccggggaaccgggtaaaccgggaaaaccgtaaacggtaacccggtaccgtaaccgttacccgacgtacccgaaaccgaaccggtacccgtacccgtacccccggttcggttaccctacccgttcccgttaccccg

SEQ ID NO: 414004 - DNA, 628 bp, Homo sapiens
  misc_feature: GZ8MTXP02JZQ6U.52.72.G06.1.454.CMB.2.raw
  modified_base (280)..(280): a, c, t, g, unknown or other
  modified_base (326)..(326): a, c, t, g, unknown or other
  modified_base (370)..(370): a, c, t, g, unknown or other
  modified_base (441)..(441): a, c, t, g, unknown or other
  modified_base (448)..(448): a, c, t, g, unknown or other
tcagcgcagtacgacacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgcctccgtatctgggtctcctggacagtcgatcaccatctcctgcactggaaccagcaatgacattggtacttataattctgtctctggtaccaacaataccccgganaaacgtccccaaactcatgatctttgaggtcagtgactcggcccgngacggggtttctcatcgacttccctccggctccgaagtctggcngcacggcctcctgaccatctctagggctcccgaggcctgaggacgtaggctagattatacgtgctagctanacttaanaacaaaacgaacgtaaaacgtcgttagggggttcgttacggggacggtacgggggtaaaacccaaacgtttccgggaaaccccgttccgtaacccggtaccgtaaacggtaccccgaaaacgggtcccgttacccgggtcccccccgtacggggtacccctaacgttcccgtttccccgg

SEQ ID NO: 414005 - DNA, 591 bp, Homo sapiens
  misc_feature: GZ8MTXP02G9SSQ.52.72.G06.1.454.CMB.2.raw
  modified_base (198)..(198): a, c, t, g, unknown or other
  modified_base (327)..(327): a, c, t, g, unknown or other
  modified_base (340)..(340): a, c, t, g, unknown or other
tcagcgcagtacgacacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccagcaatgactattggtacttataattctgtctctgtaccaacactaccccgcaaacgtccccaaactcatagactctttagaggtcagtgactcggcccgngtaggggtttccntactccgtcttcccgtccggtcctacccgaagtcgtaggcacgcctacgggccctcccgtagaccctgtccctcgttggccctccgaggtctgggacggacgaggtctagtatttacgtactggacagtctactataacaaacaaaccgtaagaaaccgtagtgggttcgtacgggcggacggaacaacgtcgacccgtctaccgcacgacccgaagtccaccgtccccgtacgtacaccctcgttccccg

SEQ ID NO: 414006 - DNA, 685 bp, Homo sapiens
  misc_feature: GZ8MTXP02JQS5T.52.72.G06.1.454.CMB.2.raw
  modified_base (277)..(277): a, c, t, g, unknown or other
  modified_base (341)..(341): a, c, t, g, unknown or other
  modified_base (405)..(405): a, c, t, g, unknown or other
  modified_base (422)..(422): a, c, t, g, unknown or other
tcagcgcagtacgacacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaaccagcaatgacattggtacttatatctgtctcctgtaccaacaataccccgnaaacgtccccaaatcatgatctttaggagtcagtcgatccggacccgtcgtaggggtttttccncgtactcgtcttccccgtaccggcctaccaacgttctggcacgcgaccggtccctccctgaccnctctcgtggctcccggnggtcgaggacggacggacggtcgtagttacttacgttacgtcgaccgtacgtacctactaaactaaacgtaaaaccgaaaacgtaaacggtaaaccgttcgggtttacggggtaccgggttaccggggaaccgggtaacccggaaaacccgtaaccggtacccggtaaccccggttacccgtaaccgaccgtaccggacccgtaaccggtccctacccccggtacccccgttacggtacccttaccgttacccgtttaccccg

SEQ ID NO: 414007 - DNA, 646 bp, Homo sapiens
  misc_feature: GZ8MTXP02GAOO0.52.72.G06.1.454.CMB.2.raw
  modified_base (282)..(282): a, c, t, g, unknown or other
  modified_base (327)..(327): a, c, t, g, unknown or other
  modified_base (445)..(445): a, c, t, g, unknown or other
tcagcgcagtacgacacgaccggtgctcgatttagctacgactgcaagggaaaggggggggtctcaggaggcagcgctctcgggacgtctccaccatggcctgggctctgctattcctcaccctcctcactcagggcacggggtcctgggcccagtctgccctgactcagcctgcctccgtgtctgggtctcctggacagtcgatcaccatcctcctgcactggaaccagcaatgacattggtacttataattctgtctctgtaccaacaactaccccgganaaacgtaccccaaactcatgatcttgagtcagtgatccggcccgngtaggggtttctcagtcgcttctccccggctccaagtctggcagccacggccctcctcgacctatctctcgggctcccgaggctaggagacgaggcttagtacttagtacttgacgancttaccaattaaacctaaacaaaacccaaagtaaaaccgtaccggtttaggggttacggttccggggacccggggtaccggggaaaacctaaaaccgttcggtaaacccccgttcctaacggtaccgaccgaaccccgaaacggcccgttaaccgccccccgttaacggtcccaaccgtttccgtcccgtttaaccccccg

SEQ ID NO: 414008 - DNA, 617 bp, Homo sapiens
  misc_feature: GZ8MTXP02F581O.52.72.G06.1.454.CMB.2.raw
  modified_base (338)..(338): a, c, t, g, unknown or other
  modified_base (378)..(378): a, c, t, g, unknown or other
  modified_base (407)..(407): a, c, t, g, unknown or other
  modified_base (493)..(493): a, c, t, g, unknown or other
tcagcgcagtacgacacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaaccagcaatgactattggtacttataatctgtctctgtaccaacaactacccgacaacgtaccccaaactcatgatcttgaggtcagtgacgtccggcccgcgtagggtttcncgatcgtccttccgtcccggtactccgtaagtcgtcgacncggccaccgggtccctcccctgaaccctntccctcgtcggtctccgacggcgtaggacggacgagctagtactttagttacgtgacgtatactctaaataaactaaaccgaaaanaacggtaaaactcggttgggtacgttcgggacggtacggaaaccaacgtcgtaccgtaccgtacgtacgaccgaaccgaacgtcgtaccccgtcccgtaccggtacctccgttccgttccccgg

SEQ ID NO: 414009 - DNA, 681 bp, Homo sapiens
  misc_feature: GZ8MTXP02GU5M5.52.72.G06.1.454.CMB.2.raw
  modified_base (210)..(210): a, c, t, g, unknown or other
  modified_base (253)..(253): a, c, t, g, unknown or other
  modified_base (325)..(325): a, c, t, g, unknown or other
  modified_base (335)..(335): a, c, t, g, unknown or other
  modified_base (363)..(363): a, c, t, g, unknown or other
  modified_base (454)..(454): a, c, t, g, unknown or other
tcagcgcagtacgacacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaaccntctcctgcactggaaccagcaatgactattggtaacttatatntgtctctggtaccaacactaccccggacaaagtaccccaaactcatgatctttgaggtcagtgatcggcccngtagggttcnatcgtcttccgtccgctctaagtctcgnacgcaaccggcctccctacgaccattccgttgcgggtacctcgaaggcgtaggacggacgaacgggtcctagttaattacggtttaaccgngacgtacgtacctacgtaaacgtaaactaaaaccgaaaacgtaaacgtaaaccggttacggttacggggttaccggtaacccgggggaaccggtaacccgggttaaaaccgtaaaccggtaccgtaacccgttaccgtaacccgtacccgaacccggtaaccccggtaaccgtcccgtaccccggtaccccgtaccggttaccgtacccgtttaccccgtttacccg

SEQ ID NO: 414010 - DNA, 612 bp, Homo sapiens
  misc_feature: GZ8MTXP01CJRES.3.33.C11.1.454.CMB.2.raw
  modified_base (207)..(207): a, c, t, g, unknown or other
  modified_base (273)..(273): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgactattggtnaatttaataaactattgtctcctggtaccagcagcacccaggcaaacgccccaaatcatgatttangagtcacaaagcggccctcgaggggtcccctgatcgcttctctgcctcaagtctggcaacacggcctcctcgacctctcgtcggctccagcctgagatgagctgattattactgacagcttcatagtgcaggactatacaaactacgtttcggttttaccggggcgggaacggggtaacccaaagtccgtcggtaacccgttcccgtaagggtaccgacgaaccccgaaacgggtcccgttccggtccccccttcgggtcctaacccttcccgtttccggttcccccctaaccccttcccgtaaccgtacggttcggccgttcccgttcgtaacccggg

SEQ ID NO: 414011 - DNA, 526 bp, Homo sapiens
  misc_feature: GZ8MTXP01DP6TP.3.33.C11.1.454.CMB.2.raw
  modified_base (206)..(206): a, c, t, g, unknown or other
  modified_base (272)..(272): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnatttataaactatgtctcctggtaccagcagcacccaggccaaaacgcccccaaatcatgatttangaggtcacaaagcggccctcagggtcccctgatcgcttctctgcctccaagtctggcaacacggcctccctgacccgtctctggctccagcctgagatgaggctgtattattactgcagctcatatgcagcatcaacacgttcgtttcggcggaggacaagctacgaccgtctaggtcacgcccgaaggcttcgccccttcggtcctcttccttcgttcccctaacccgtcctcgagtcgcgtcgttcgtcggg

SEQ ID NO: 414012 - DNA, 518 bp, Homo sapiens
  misc_feature: GZ8MTXP01BKZ2M.3.33.C11.1.454.CMB.2.raw
  modified_base (206)..(206): a, c, t, g, unknown or other
  modified_base (267)..(267): a, c, t, g, unknown or other
  modified_base (326)..(326): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgcccccaaatcatgattangagtcacaaagcggccctcgagggtccctgatcgcttctctgcctcaagtctggcaacncggcctcctcgaccgtctcgtggctccagcctgagggatgaggctgattatactgcagctcatatgcagcatacaacacgttgtttcgggcggacgggaccaagcgtagacccgtcctaggtcacgcccaaggcttcgccccttcgtctcttcgttcgttcccaaccctcgtcgacgtcgcgtcgttcgtgg

SEQ ID NO: 414013 - DNA, 582 bp, Homo sapiens
  misc_feature: GZ8MTXP01BEN40.3.33.C11.1.454.CMB.2.raw
  modified_base (226)..(226): a, c, t, g, unknown or other
  modified_base (241)..(241): a, c, t, g, unknown or other
  modified_base (303)..(303): a, c, t, g, unknown or other
tcagagacgcactccacgaccggtgctcgatttagagtgagctcgttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacattggtnattataaactatgtctctggtaccagcagcacccaggcaaacgcccccaaatcatgatttangagtcaacaaagcggcctcgacgggtccctgactccgcttctctcgccctaccaagtctgggcaaacgaccggcctccctgacccgtctcgtcgggctccgagcctgagatgagctagtattattactgcagctcatatgacaggctataccaaactaacgttcggttttacgggcgggaacgggaacccgaaaggttccgttacggaccccggttaaccgtaacgggttaacccgaacggacccccggttaaagggccccgttcccggtcccccccgg

SEQ ID NO: 414014 - DNA, 543 bp, Homo sapiens
  misc_feature: GZ8MTXP01BLQ2X.3.33.C11.1.454.CMB.2.raw
  modified_base (206)..(206): a, c, t, g, unknown or other
  modified_base (268)..(268): a, c, t, g, unknown or other
  modified_base (512)..(512): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgcccccaaatcatgatttangaggtcacaaagcggccctcaggggtccctgatcgcttctctgcctcaagtctggcaacacggcctcctcgacccgtctcgtgggcctacccgagcccgtggaggactggaggctgtattattactgcagctcatatgcagcatacaactacgttggttttcgggcgggacgggaccaagctacgaccgtcctagggtcacgccgaacggcttccgccccttggtcaccttcgttccgttcccnccctcctcgtacgtcgccgttcgttcgtggg

SEQ ID NO: 414015 - DNA, 514 bp, Homo sapiens
  misc_feature: GZ8MTXP01BCKQR.3.33.C11.1.454.CMB.2.raw
  modified_base (239)..(239): a, c, t, g, unknown or other
  modified_base (303)..(303): a, c, t, g, unknown or other
  modified_base (374)..(374): a, c, t, g, unknown or other
tcagagacgcactccacgaccggtgctcgatttagagtgagctcgttgggtttgggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactggaaccagcagtgacattggtnatttataaactatgtctcctggtaccagcagcacccaggcaaacgcccccaaatcatgatttangagtcacaaagcggcctgagggtccctgactccgcttctctgccctaccaagtctggcaaacgcgcctccngacccgtctctcgggctccgagcctgagatgaggctgattattacgtgtcagctcatagtgcaggcatcaactaactggttttcggcggagggaccaagcgttgacccgtctaggtcagcccgaaggtccttcgcccccg

SEQ ID NO: 414016 - DNA, 317 bp, Homo sapiens
  misc_feature: GZ8MTXP01CKXLB.3.33.C11.1.454.CMB.2.raw
  modified_base (311)..(317): a, c, t, g, unknown or other
tcagagacgcactccacgaccggtgctcgatttagagtgagctcgttgggtttggggaggtcacaaagcggccctcaggggtccctgatcgcttctctgcctccaagtctggcaacacggcctccctgaccgtctctgggctccagcctgaggatgaggctgattatactgcagctcatatgcaggcatcaacactgttttcggcggagggaccaagctgaccgtcctaggtcagcccaaggctgcccctcggtcactctgttcccgccctcctcgagtcgcgtctctgagcggctggcaaggcgcatagnnnnnnn

SEQ ID NO: 414017 - DNA, 534 bp, Homo sapiens
  misc_feature: GZ8MTXP01BY7FJ.3.33.C11.1.454.CMB.2.raw
  modified_base (242)..(242): a, c, t, g, unknown or other
  modified_base (303)..(303): a, c, t, g, unknown or other
  modified_base (426)..(426): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaagcccccaaatcatgatttangaggtcacaaagcggccctcgagggtccctgactccgcttctctgcctccaagtctggcaacacggccctccgtgacccgtctcgtcgggctccgagcctgaggatgagctgtattattacgngcagctcatatgcaggcatcaactaacgttcggtttcgggacggttaggaacccgaagcgttcgacccggttcctaggtccacgcccgaacgtcccgttcgtcccccg

SEQ ID NO: 414018 - DNA, 537 bp, Homo sapiens
  misc_feature: GZ8MTXP01BWWQ2.3.33.C11.1.454.CMB.2.raw
  modified_base (268)..(268): a, c, t, g, unknown or other
  modified_base (298)..(298): a, c, t, g, unknown or other
  modified_base (406)..(406): a, c, t, g, unknown or other
  modified_base (519)..(519): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctctggtaccagcagcacccaggcaaacgcccccaaatcatgatttangaggtcacaaagcggccctcaggggtcccngatcgcttctctgcctccaagtctggcaacacggcctcctcgaccgtctctgggcctccagcctgaggatgagctgattatactgcagctcatatgcaggcatcaacncgttgttttcgggcggtacgggaccaagcgtggacccgtccgtacggtcacgcccgaacggccttcgcccccgttcggtccaccttccgttcgttccccgcccctccgtccgngtcgcgtcgttcgtcggg

SEQ ID NO: 414019 - DNA, 523 bp, Homo sapiens
  misc_feature: GZ8MTXP01C26XJ.3.33.C11.1.454.CMB.2.raw
  modified_base (206)..(206): a, c, t, g, unknown or other
  modified_base (266)..(266): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaagccccaaatcatgatttangaggtcacaaagcggcctcagggtcccctgatcgcttctctgcctccaagtctggcaaacacggcctccctgacccgtctctgggctccagcctgagatgaggctgattattactgcagctcatatgcaggcatcaacacgttgttttcggcgtacggggaccaaagctgaccgtcctagggtcacgcccaaggccttgcccccttcggtccacttcgttcgttccccaaccctcctcgacgtcgcgtcttcgtcgg

SEQ ID NO: 414020 - DNA, 523 bp, Homo sapiens
  misc_feature: GZ8MTXP01BDKJY.3.33.C11.1.454.CMB.2.raw
  modified_base (206)..(206): a, c, t, g, unknown or other
  modified_base (268)..(268): a, c, t, g, unknown or other
  modified_base (481)..(481): a, c, t, g, unknown or other
  modified_base (496)..(496): a, c, t, g, unknown or other
  modified_base (506)..(506): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgcccccaaatcatgatttangaggtcacaaagcggccctcgaggggtccctgatcgcttctctgcctcaagtctggcaacacggcctccctcgaccgtctcgtgggcctcccagcctgaggatgaggctgtattattactgcagctcatatgcaggcatacaactacgttgttttcgggcggagggaccaagctgaccgtctagtcacgcccaaggcttcgccccttcggtcncttcgttcgttcccnccctcctcgngtcgcgtcgttcgtcgg

SEQ ID NO: 414021 - DNA, 506 bp, Homo sapiens
  misc_feature: GZ8MTXP01DDQ0M.3.33.C11.1.454.CMB.2.raw
  modified_base (205)..(205): a, c, t, g, unknown or other
  modified_base (266)..(266): a, c, t, g, unknown or other
  modified_base (394)..(394): a, c, t, g, unknown or other
  modified_base (461)..(461): a, c, t, g, unknown or other
tcagagacgcactccacgaccggtgctcgatttagagtgagctcgttgggtttgggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaagcccccaaatcatgatttangaggtcacaaagcggccctcaggggtcccctgatcgcttctctgcctccaagtctggcaacacggcctccctgaccgtctctgggctccagcctgaggatgaggctgattattactgcagctcatatncaggcatcaacactgttttcggcggagggaccaagctgaccgtctaggtcagcccaagcttgccccncggtcacttcttcgttcccgccctcctcgcgtgcgtcgttctcgg

SEQ ID NO: 414022 - DNA, 606 bp, Homo sapiens
  misc_feature: GZ8MTXP01C9ZG7.3.33.C11.1.454.CMB.2.raw
  modified_base (306)..(306): a, c, t, g, unknown or other
  modified_base (313)..(313): a, c, t, g, unknown or other
  modified_base (576)..(576): a, c, t, g, unknown or other
tcagagacgcactccacgaccggtgctcgatttagagtgagctcgttgggtttggggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctctgcatggaaccagcaagtgactagtttgggataattaataaactatgtctctggtaccagcagcaaccaggacaaacgccccaaatcatgattangagtcanaaagcgcctgacgggtccctgactccgcttctctcgccctaccaagtcgtggaccaaacgaccggccctacccgtgacccgtctcgtcgggcctccgagtcccgtagggacgtagtacggcgtagtaagttaatttaacgttcggtacgacggtaccgttacctaacttaacttgtaccgaggtacaactacaaacgtacgttaacggttttcgggttacggaacgggacgaaacgtcgttacgccgttaccgttaagggacncgaccgacggttacgtccgccccgttcccg

SEQ ID NO: 414023 - DNA, 541 bp, Homo sapiens
  misc_feature: GZ8MTXP01A9FIT.3.33.C11.1.454.CMB.2.raw
  modified_base (207)..(207): a, c, t, g, unknown or other
  modified_base (268)..(268): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgcccccaaatcatgattangagtcacaaagcggccctcgagggtccctgatcgcttctctgcctcaagtctggcaacacggccctccctcgacccgtctcgtgggcctccagccctgaggatgaggctgtattattactgcagctcatatgcagcatacaactcgttcggttttcgggcggtacgggaccaagcgtcgacccgtcgtaggtcacgcccgaaggccttccgccccgttcggtcctacttccgttcgttccccaaccctcctcgtacgtcgcgttcttcgtcgg

SEQ ID NO: 414024 - DNA, 519 bp, Homo sapiens
  misc_feature: GZ8MTXP01BFRTU.3.33.C11.1.454.CMB.2.raw
  modified_base (268)..(268): a, c, t, g, unknown or other
  modified_base (478)..(478): a, c, t, g, unknown or other
  modified_base (502)..(502): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaacgcccccaaatcatgatttangagtcacaaagcggcctcgaggggtccctgatcgcttctctgcctcaagtctggcaacacggccctccctcgacccgtctcgtcgggctcccgagcctgaggatgaggctgtattattactgcagctcatatgcagcatcaacacgttgtttcggcggagggaccaagctgaccgtctaggtcacgccgaaggcttcgccccttcggtcncttcgttcgttcccgccctctcgngtcgcgtcgttcgtcgg

SEQ ID NO: 414025 - DNA, 534 bp, Homo sapiens
  misc_feature: GZ8MTXP01B1GR5.3.33.C11.1.454.CMB.2.raw
  modified_base (243)..(243): a, c, t, g, unknown or other
  modified_base (305)..(305): a, c, t, g, unknown or other
  modified_base (331)..(331): a, c, t, g, unknown or other
  modified_base (446)..(446): a, c, t, g, unknown or other
  modified_base (451)..(451): a, c, t, g, unknown or other
tcagagacgcactccacgaccggtgctcgatttagagtgagctcgttgggtttggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccagcagtgactattggtnatttataaactatgtctctggtaccagcagcacccaggcaaacgccccaaatcatgatttangagtcacaaagcgcctgagggtcccngactccgcttctctcgcctaccaagtctggcaacgaccggccctccctgacccgtctcgtcgggctccgagccctaggaggtatggaggctgtattattactgcagctcattagngacgngtcactacaactaacgttcggttcggacggacgacgagcgttcgttaccgtcgtacgcgacgaccgacgtccgttccgtcccg

SEQ ID NO: 414026 - DNA, 587 bp, Homo sapiens
  misc_feature: GZ8MTXP01DHWW4.3.33.C11.1.454.CMB.2.raw
  modified_base (207)..(207): a, c, t, g, unknown or other
  modified_base (268)..(268): a, c, t, g, unknown or other
  modified_base (319)..(319): a, c, t, g, unknown or other
  modified_base (344)..(344): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnatttataactatgtctcctggtaccagcagcacccaggcaaacgccccaaatcatgattangaggtcacaaagcgccctgagggtccctgatcgcttctctgcctcaagtcnggcaacacgcctccctcgacccgtntcgtggctccagcctgaggatgagtctgtattattactgcagctacatatgacaggctaactactaacgtacgtttcggttttacgggacgggaacgggaccaaacgtcgtacgtacccgtaccgtaggtaccacggcccgaaacggtcccttcccggtccccccgttcgggtaccctcccgttcccttcccgttccccctaaccccttcccgtcgtacggtcgttccgttccgttcgtcggg

SEQ ID NO: 414027 - DNA, 514 bp, Homo sapiens
  misc_feature: GZ8MTXP01D4XLF.3.33.C11.1.454.CMB.2.raw
  modified_base (206)..(206): a, c, t, g, unknown or other
  modified_base (266)..(266): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaagccccaaatcatgatttangaggtcacaaagcggcctcagggtccctgatcgcttctctgcctcaagtctggcaacacggcctcctcgaccgtctcgtcgggctccagcctgagatgagctgattattactgcagctacatatgcaggcatacaactacgttggtttcggcggagggaccaagctgaccgtctaggtcacgcccaaggcttcgccccttggtccacttcttcgttccccaacctcctcgacgtcgcgtcttcgtcgg

SEQ ID NO: 414028 - DNA, 607 bp, Homo sapiens
  misc_feature: GZ8MTXP01D5IY0.3.33.C11.1.454.CMB.2.raw
  modified_base (279)..(279): a, c, t, g, unknown or other
  modified_base (399)..(399): a, c, t, g, unknown or other
  modified_base (424)..(424): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccggtctcctggacagtcagtcaccatctcctgcactggaaaccagcagtgactagtttgggtataatttaataaacttatcgttcctcctggtaccagcagcacccagacaaacgccccaaatcatgattangagtcaacgaaacgccggccctcgacgggtccctgactccgcttctctcgcctccaagttctacggacaacgaccggccctcccgtcgacccgtctcgtcggccctccagccgtggaagntgaggtctagtattactactgacgntctatatagtcgacgaggactaactactaaacgtacgggtttcggtttaccggggacgggtaacggaacgaacgtcgtacgtacccgtcgtacgcgacgaccgaacggtccttccgccccgttcggtcctacgttccgttccgttccccgtcctacctcggtgtcgttccgtcgttcgtcggg

SEQ ID NO: 414029 - DNA, 552 bp, Homo sapiens
  misc_feature: GZ8MTXP01ENA9O.3.33.C11.1.454.CMB.2.raw
  modified_base (242)..(242): a, c, t, g, unknown or other
  modified_base (303)..(303): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataaactatgtctcctggtaccagcagcaccaggcaaacgccccaaatcatgatttangagtcaacaaagcgcctgacgggtccctgactccgctttctctcgccctaccaaagttcgtagggaccaaaccgaccgggtcccttccccgtagtacccgttcctcgtggggcctccgagccctaggaggtatgagctagtattattactgcacgtctacatatgacaggcatacaactaacgttgtttcggcgggttaggaaccaagcgttgacccgtctacggcacgcccaaggtccttcgtccccg

SEQ ID NO: 414030 - DNA, 575 bp, Homo sapiens
  misc_feature: GZ8MTXP01D4SVN.3.33.C11.1.454.CMB.2.raw
  modified_base (206)..(206): a, c, t, g, unknown or other
  modified_base (268)..(268): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgcccccaaatcatgatttangaggtcacaaagcggccctcgaggggtcccctgatcgcttctctgcctcaagtctggcaaccacggccctccctcgacccgtctcgtgggcctcccgagcctgacggatgaggtctagtatttattactgcagctacatatgacgaggcatacaactacggttcggttttcgggcgggaacgggaccaagtccgtacgacccgtccgtacggtccacgcccgaaaggtcccttcggcccccgttcggtcctaccgttccgttccgttcccctaaccctcctcgtacgtcgttccgtcgttcgtcggg

SEQ ID NO: 414031 - DNA, 316 bp, Homo sapiens
  misc_feature: GZ8MTXP01A8O0J.3.33.C11.1.454.CMB.2.raw
  modified_base (312)..(316): a, c, t, g, unknown or other
tcagagacgcactccacgaccggtgctcgatttagagtgagctcgttgggtttgggaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggaggaccaagctgaccgtcctaggtcagcccaaggctgccccctcggtcactctcgttcccaccctcctcgagtgcgtctctgagcgggctggcaaggcgcatagnnnnn

SEQ ID NO: 414032 - DNA, 540 bp, Homo sapiens
  misc_feature: GZ8MTXP01EJ5US.3.33.C11.1.454.CMB.2.raw
  modified_base (207)..(207): a, c, t, g, unknown or other
  modified_base (266)..(266): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctctggtaccagcagcacccaggcaaacgccccaaatcatgattangaggtcacaaagcggccctgagggtccctgatcgcttctctgcctcaagtctggcaacacgcctcctcgacctctcgtgggcctccagcctgacggatgaggctgtattattactgcagtctcatatgcaggcatcaacgtacgttggttttcgggacggtacgggaccaacgcgtcgaccgtccgtaggtcacgcccgaacggccttcgcccccgttcggtcctaccttccttcgttccccaacccttcctcgtacgtcgcgttcttcgtcgg

SEQ ID NO: 414033 - DNA, 591 bp, Homo sapiens
  misc_feature: GZ8MTXP01DODJ4.3.33.C11.1.454.CMB.2.raw
  modified_base (227)..(227): a, c, t, g, unknown or other
  modified_base (242)..(242): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacattggtnaattataaactatgtctcctggtaccagcagcacccaggcaaacgccccaaatcatgtatttatgaggtcaacaaagcggcctcgacggggtccctgactccgcttctctcgccctaccaagtctggccaaaccgacggcccctccctgacccgtctcgtcgggcctccgagcccgtaggacggatggaggtctagtaatttacttacgtcgctaagcttacattagtgactacggctaataccaaactaacgtttacgggttttcgggacgggttaacgggaccgtaaggccgttcggacccgttccgtaaggttccacggcccgttaaggtcccgttccgtcccccg

SEQ ID NO: 414034 - DNA, 664 bp, Homo sapiens
  misc_feature: GZ8MTXP01CKE3G.3.33.C11.1.454.CMB.2.raw
  modified_base (208)..(208): a, c, t, g, unknown or other
  modified_base (218)..(218): a, c, t, g, unknown or other
  modified_base (268)..(268): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgactattggtnattataactntgtctcctggtaccagcagcacccaggcaaacgccccaaatcatgattangagtcacaagcggcctcgacgggtccctgactcgtcttctactcgccctacaagtctggaccaacgacggccctccgtcgacccgtctcgtcgggcctacccgagtccgtggagggatggacggtcttagtaatttacttacgcggacacgtcctagtaattagcgacgacggacctaactacgtaaacgttcgggtttacgggtttaccggggacgggaaccgggaaccacgtccggtacggtaccccggtcgtaacggtccgaaccgacccgtaacgggtcccgttacccggtcccccgttacggtaccccttccgttcccggtttccccgttacccctaaccccggttccgtaaccggttcggttccgttccgttaaccgtttcccgggtggg

SEQ ID NO: 414035 - DNA, 577 bp, Homo sapiens
  misc_feature: GZ8MTXP01A87DL.3.33.C11.1.454.CMB.2.raw
  modified_base (207)..(207): a, c, t, g, unknown or other
  modified_base (217)..(217): a, c, t, g, unknown or other
  modified_base (268)..(268): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactntgtctctggtaccagcagcacccaggcaaacgcccccaaatcatgatttangagtcacaaagcggccctcgagggtcccctgactcgtcttctctgccctcaagtctggcaacgacggccctccctcgacccgtctcgtcgggccctccgacgccgtagaacgggtatggaggtctaggtatttattactggacagctcatatgcgagcatacaactacgttggtttcgggacgggtaacgggaccaagtcgtacgtaccgtccgtacggtacacggcccaacggtccgttccgcccccgttcggtcctacgttccgttccgttccccaaccctcctcgtacgtcgttcgtcttcgtggg

SEQ ID NO: 414036 - DNA, 591 bp, Homo sapiens
  misc_feature: GZ8MTXP01ASTU7.3.33.C11.1.454.CMB.2.raw
  modified_base (206)..(206): a, c, t, g, unknown or other
  modified_base (266)..(266): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctctggtaccagcagcacccaggcaaacgccccaaatcatgatttangaggtcacaaagcggccctcgaggggtccctgatcgcttctctgcctccaagtctggaccaacaccggtcctcccgtcgaccgtctcgtgggcctccagtccctgaggatggagtctgtaattattactgcagctacatagtgcgaggcataccaactacggtttgggtttaccggggacgggtaacggggaccaaacggccgtacggtaccccgttcgtacgggtccacggccccgaaggcccttccgtcccccgttcgggtcctaccgttccgttccgttccccgcccttaccgtcgtacggtcgttccgtcgttccgtcggg

SEQ ID NO: 414037 - DNA, 543 bp, Homo sapiens
  misc_feature: GZ8MTXP01ATP7U.3.33.C11.1.454.CMB.2.raw
  modified_base (192)..(192): a, c, t, g, unknown or other
  modified_base (208)..(208): a, c, t, g, unknown or other
  modified_base (218)..(218): a, c, t, g, unknown or other
  modified_base (268)..(268): a, c, t, g, unknown or other
  modified_base (332)..(332): a, c, t, g, unknown or other
  modified_base (525)..(525): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagccctccctccgcgtccgggtctcctggacagtcagtcaccatctcctgcactggaaccngcagtgactattggtnattataactntgtctcctggtaccagcagcaccaggcaaacgccccaaatcatgatttangaggtcaacaaagccggcctcgacgggtccctgactcgcttctctgcctcaagtctggacaacncggcctccctcgaccgtctcgtcggctaccgagcctgagatggagtctgtattacttactgcagctacatagtgacagcatacaactcgttggtttcggacggacggaccagcgtacgaccgtcgtacggtcacgccgaacgccgttccgccccgttggtcctccgttccttccgttccccaaccctcctcgngtcgttcgtcttcgtcgg

SEQ ID NO: 414038 - DNA, 655 bp, Homo sapiens
  misc_feature: GZ8MTXP01AYJ8H.3.33.C11.1.454.CMB.2.raw
  modified_base (206)..(206): a, c, t, g, unknown or other
  modified_base (216)..(216): a, c, t, g, unknown or other
  modified_base (266)..(266): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggnattataactntgtctcctggtaccagcagcaccaggacaaacgccccaaatcatgattangaggtcaacaagcggccctcgacgggtccctgactcgcttctctcgcctcaagtctggaccaacgcggccctccgtcgacccgttctccgtcgggccctaaccgacgtccgtagggaacggtctacgggacgtcgttagtaactttacttacgtcgacgtacgtctactagtacgtcgacgtaaggctaacgtaccgtaaacgttcggggtttacgggtttaccggggacgggtaaacgggaacctaacggtccgttaccggtaacccgttacgtaacggtaccgaccggaaccccggaacgttccccgttccggtccccgttcggtacctaccgttccgttcccgttccctaaccgtcgtaacgtcgtcgttcgtcgttcgtaacggg

SEQ ID NO: 414039 - DNA, 523 bp, Homo sapiens
  misc_feature: GZ8MTXP01E1N16.3.33.C11.1.454.CMB.2.raw
  modified_base (268)..(268): a, c, t, g, unknown or other
  modified_base (484)..(484): a, c, t, g, unknown or other
  modified_base (507)..(507): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaacgccccaaatcatgatttangaggtcacaaagcggccctcaggggtcccctgatcgcttctctgcctcaagtctggcaacacggcctccctgaccgtctcgtgggcctccagcctgaggatggaggctgaattattactgcagctcatatgcaggcatacaaacacgttggttttcgggcggtagggaccaagctgaccgtctaggtcacgcccaaggcttcgccccgttcgtacncttcttcgttcccgcctcctcgngtcgcgtcttcgtcgg

SEQ ID NO: 414040 - DNA, 622 bp, Homo sapiens
  misc_feature: GZ8MTXP01BCSVO.3.33.C11.1.454.CMB.2.raw
  modified_base (227)..(227): a, c, t, g, unknown or other
  modified_base (242)..(242): a, c, t, g, unknown or other
  modified_base (304)..(304): a, c, t, g, unknown or other
  modified_base (311)..(311): a, c, t, g, unknown or other
  modified_base (331)..(331): a, c, t, g, unknown or other
  modified_base (465)..(465): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacattggtnattaataactatgtctctggtaccagcagcaccaggacaaacgcccccaaatcatgatttangagtcanaaagcgcctgaggggtcccngactccgcttctctcgccctaccgaaagtctggaccaaaccacgggccctcccgtacgacccgtctcgtcgggctccgagccctaggaggtatggaaggctaggtactttaacttacgtggactaacggcctanaattaagtcggaccgaaggccctaattaaccgtaaacctaacgtttcgggttttaccggggacgggaacggggtaaacccaaaggttccgttcggttaacccgttccgttacggggtaacaaccggacccgaaacgggtccttcccggtcccccccg

SEQ ID NO: 414041 - DNA, 555 bp, Homo sapiens
  misc_feature: GZ8MTXP01DRI62.3.33.C11.1.454.CMB.2.raw
  modified_base (207)..(207): a, c, t, g, unknown or other
  modified_base (270)..(270): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgactattggtnattataactatgtctcctggtaccagcagccaccaggacaaacgcccccaaatcatgatttangagtcacaaagcgccctcgagggtccctgatcgcttctctcgcctcaagtctggacaacacggcctccctcgaccgtctctcgggctcccgagcctggacggatgaggcttgtattattactgcagctacatatgacagcatacaaactcgttcggtttacgggcggaacgggaccaagtcacggtaccgtcgtacgtcacgcccgaaggtcccttaccggccccttcggtcctacgttccttccgttccccaaccctccgtcgtcgtcgttcggtcttcgtcgg

SEQ ID NO: 414042 - DNA, 521 bp, Homo sapiens
  misc_feature: GZ8MTXP01CPIFR.3.33.C11.1.454.CMB.2.raw
  modified_base (207)..(207): a, c, t, g, unknown or other
  modified_base (267)..(267): a, c, t, g, unknown or other
  modified_base (465)..(465): a, c, t, g, unknown or other
  modified_base (506)..(506): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgccccaaatcatgattangagtcacaaagcgcctcgagggtccctgatcgcttctctgcctcaagtctggacaaccacggcctcctcgaccgtctctgggctccagcctgaggatgaggctgattattactgcagctcatatgcaggacatacaactacgttggttttacgggcggagggaccaagcgtagaccgtccgtaggcacgcccaaggcncgtccccttcggtctacttcgttcgttccccgccctctcgngtcgcgtcttcgtgg

SEQ ID NO: 414043 - DNA, 563 bp, Homo sapiens
  misc_feature: GZ8MTXP01AHH3U.3.33.C11.1.454.CMB.2.raw
  modified_base (226)..(226): a, c, t, g, unknown or other
  modified_base (243)..(243): a, c, t, g, unknown or other
  modified_base (302)..(302): a, c, t, g, unknown or other
  modified_base (325)..(325): a, c, t, g, unknown or other
  modified_base (334)..(334): a, c, t, g, unknown or other
  modified_base (336)..(337): a, c, t, g, unknown or other
  modified_base (346)..(346): a, c, t, g, unknown or other
  modified_base (351)..(351): a, c, t, g, unknown or other
  modified_base (358)..(358): a, c, t, g, unknown or other
  modified_base (364)..(364): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggaaccngcagtgactattggtanattataactatgtctctggtaccagcagcaccaggcaaacgccccaaatcatgatttangagtcacaagcgcctgaggtccngactcgctncnnctacagtcngcacncgcctcnacctcncgtggctcagctgacgatgagctagtattactacgtgcgtagtctacatgtcgacgacggcctaagtaccaaaccgtcgtttcgggttttccggggaccgggttaacgggaaccctaacgggttccgttacggttaccccggttaaccgtacggtaaccaccggacccgttaacggtcccgttaacccggttcccccgg

SEQ ID NO: 414044 - DNA, 654 bp, Homo sapiens
  misc_feature: GZ8MTXP01BL4MG.3.33.C11.1.454.CMB.2.raw
  modified_base (244)..(244): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatcctcctgcactggaaccagcagtgactattgggtnattataactatgtctccgtggtaccagcagccacccgaggacaaccgaccccaatcatagtattagagagtacaacgaacggcccgtcccgtaggaccgggtccctagtacgttccccgtcctttactccgtccgtacccctaaccgtaaacgttccgacgggaccctaaacccgcccggtcccttaccgtacgtacccgtcgtccgtcgggcctaccgacgtccgtaggacgtagtggacgtctagtatttacttacggcgtcgtacgtctactattacgtcgacgacgtacctactaccgtaaccgtaacgtttcgggtttaccgggacgggacggtaacgacggttccgttccggttacccgtaacgtacggtccgaccggaccggacgtcccgttcccggtccccg

SEQ ID NO: 414045 - DNA, 570 bp, Homo sapiens
  misc_feature: GZ8MTXP01DCWZP.3.33.C11.1.454.CMB.2.raw
  modified_base (227)..(227): a, c, t, g, unknown or other
  modified_base (242)..(242): a, c, t, g, unknown or other
  modified_base (376)..(376): a, c, t, g, unknown or other
  modified_base (398)..(398): a, c, t, g, unknown or other
  modified_base (440)..(440): a, c, t, g, unknown or other
  modified_base (445)..(445): a, c, t, g, unknown or other
tcagagacgcactccacgaccggtgctcgatttagagtgagctcgttggggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggaaccngcagtgacattggtnaattataactatgtctctggtaccagcagcaccaggacaaacgccccaaatcatgattatgaagtcaacaaagccggcctcgaggggtccctgactccgcttctctcgcctaaccaaagttcgaggacaaaacnccggccctcccgtgaccccgtntcgtgggcctccgagcctagagatgaggctagattattacgngacanactactatagtagacgacgtactactactaactaacgttacggtttacgggtacgggaacggtaacgaacgttacgttcgttaccgtaaccgtacgtaacgacgaccgacgtccgttccgtcccg

SEQ ID NO: 414046 - DNA, 676 bp, Homo sapiens
  misc_feature: GZ8MTXP01DLW0V.3.33.C11.1.454.CMB.2.raw
  modified_base (209)..(209): a, c, t, g, unknown or other
  modified_base (231)..(231): a, c, t, g, unknown or other
  modified_base (266)..(266): a, c, t, g, unknown or other
  modified_base (414)..(414): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcaggtgactattggtnattataactatgtctctgtacngcagcaccaggacaaacgccccaaatcatgattangagtcacaaagccggcctcgacgggtccctgactcgcttctctcgcctacaagttctggaccaaccgaccggtcctccccgtcgtacccgtctcgtcgggccctcccgacgtccgtggacggagtggacggtcttgtatttacttacngtacagctacaattagtcgcgaggctaaatacctaaaccgtacggtttcggggttttaccggggacggggtaaaccgggaaccgtaaacggtccgtacggtaaccccgttaccgtacgggtaccgaaccggtaccccgtaaacgggtccccgttcccgggtccccccgttcgggttacctacccgtttcccgttccccgtttaccccctaaccccgttcccgttccggtacggtccgttcccgggtttccttccgggtcggg

SEQ ID NO: 414047 - DNA, 578 bp, Homo sapiens
  misc_feature: GZ8MTXP01AUC65.3.33.C11.1.454.CMB.2.raw
  modified_base (243)..(243): a, c, t, g, unknown or other
  modified_base (302)..(302): a, c, t, g, unknown or other
  modified_base (366)..(366): a, c, t, g, unknown or other
tcagagacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctctggtaccagcagcaccaggacaaacgccccaaatcatgattangagtcaacaaagcgcctcgacgggtccctgactccgcttctctcgcctacaagtctggcaaacnccggccctcctcgacccgtctcgtcgggcctccgacgcctaggaggatggaggtctagatttattacgtgaccagcttcaatagtcgacgaggcctaataccaaacgtcgttacggttttccgggacgggttaacgggtaaccgaagccgttcggacccggttaacgtacggtaaccgaccggacccggaacgtcccgttcccggtcccccg

SEQ ID NO: 414048 - DNA, 558 bp, Homo sapiens
  misc_feature: GZ8MTXP01C7VGS.3.33.C11.1.454.CMB.2.raw
  modified_base (207)..(207): a, c, t, g, unknown or other
  modified_base (272)..(272): a, c, t, g, unknown or other
  modified_base (396)..(396): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccggtctcctggacagtcagtcaccatctcctgcactggaaccagcagtgacagttggtnaattataactatgtctcctggtaccagcagccaacccaggacaaacgcccccaaatcatgattangaggtcacaaagcggccctcgagggtccctagactcgcttctctgcctcaagtctggacaacgacggcctccctgacccgtctcgtgggcctcccagcctgacggatgaggctagattattacngcagctacatatgcagcatactaactacgttggtttacggacggtacggaccagctgacccgtctacggtcacgcccaaggccttcggtccccttggtcctaccttccgttcccgttaccccgtcccctccgtccgtacgtcggttcgttccgttcgtcggg

SEQ ID NO: 414049 - DNA, 633 bp, Homo sapiens
  misc_feature: GZ8MTXP01AJ4JG.3.33.C11.1.454.CMB.2.raw
  modified_base (229)..(229): a, c, t, g, unknown or other
  modified_base (305)..(305): a, c, t, g, unknown or other
tcagagacgcactccacgaccggtgctcgatttagagtgagctcgttggggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcactggaaccngcagtgactagttggtatattataactatgtctctggtacagcagcaccaggacaaacgccccaatcatgatttanagagtacacgaagccggcctcgacggggtcctgactccgtcttctcgtcgcctaacctaacgtcgtacggaccaaccgaccggtcccctcccgtggtaccccgttctccgtcgggcctacccgacgtccgtaggacggtagtggacggtctaggtatttacttacggtgtcgtagtacctactagtacgtgacgacggactaactaccaacttaacggttcgggttttaccggggacgggttaacgggaaaccgtacggttaccgttcggaacccggttccgtacggtccgaccggtacccgaacgggtcccgttcccggtcccccgg

SEQ ID NO: 414050 - DNA, 684 bp, Homo sapiens
  misc_feature: GZ8MTXP01B7LEN.3.33.C11.1.454.CMB.2.raw
  modified_base (289)..(289): a, c, t, g, unknown or other
  modified_base (424)..(424): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgactagtttggtagtaatttaataaacttattcgtcctccgtggtaccagcagccaacccgaggaccaaaccgcccccaaatcatgtatttangagtacaacgaacggccggccctcggacgggtccctgactccgtcttctctcgtccctacgaagtcgtacggaccaaccgccggtccctccgtccgtacccgtctcgtcggccctaccgacgccgtaggacggtntgggacggtctagtatttactacgtgacacgtctactaattacgtcgacgaggactaactaccgtaaaccgttcggggtttcggggttttaccggggacgggtaacgggaaccgtaacggtccgtacggtacccgttccgtacggtaccgaccggacccgaacggtcccgttcccggtccccgttcggtaccctccgttcccgttcccgttcccctaacccttcccggtaacgtcggtccgttcctccgttcgtaacggg

SEQ ID NO: 414051 - DNA, 653 bp, Homo sapiens
  misc_feature: GZ8MTXP01BZR85.3.33.C11.1.454.CMB.2.raw
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcggtcaccatctcctgcactggatccaccggtgacgttgctacttataagtttgtctcctggtcctggtaaccaaaacacccaggacaaacgcccccaagattaatgtatttatgatgtcagtgatccggccctgtaggggtttctctattcgtcttttctggtctccaagtctggacaaccgaccggccctccctgacctatcctcgtcgggctccgagctaggagcgagctgtatttattctgacagtctacaactaccaaccgaacccggaccaacctacgttcgggttcggttgggtttacgggtagggtaacggggaccgtaaaggtccgttacggacccggttaccgtacgggtccgaacggtaccccgaacggtcccgtcccggtcccccgttcgggccctacccttccgttcccgttcccctaccccgttccgttacgttcgttcgcgttcctcgtcggacgggttcggcgttggaaccg

SEQ ID NO: 414052 - DNA, 548 bp, Homo sapiens
  misc_feature: GZ8MTXP01BBBT9.3.33.C11.1.454.CMB.2.raw
  modified_base (207)..(207): a, c, t, g, unknown or other
  modified_base (268)..(268): a, c, t, g, unknown or other
  modified_base (288)..(288): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaagcccccaaatcatgatttangaggtcacaaagcggccctnaggggtcccctgatcgcttctctgcctcaagtctggcaacacggcctccctcgacccgtctctgggcctccagcctggagactggaggtctgtattattactgcagctcatatcgcaggcatacaactacgttggttttcgggacgggtacgggaccaagctacggaaccgtccgtaaggtcacgcccgaacggcttccgccccttcggtcaccttcgttccgttccccaaccctccgtcgacgtcgcgtcgttcgtcgg

SEQ ID NO: 414053 - DNA, 633 bp, Homo sapiens
  misc_feature: GZ8MTXP01EUVV6.3.33.C11.1.454.CMB.2.raw
  modified_base (214)..(214): a, c, t, g, unknown or other
  modified_base (506)..(506): a, c, t, g, unknown or other
  modified_base (578)..(578): a, c, t, g, unknown or other
tcagagacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggcagtcagtcaccatctcngcactggaaccagcagtagactagttggtatattaataactatcgtctccgtagtacagcagccaccaagaaacaaaccgacccccaaatcatagtattagtgacgtacaaacgaaaggcccggtaccctacggtacgggggtcccctggacttcccccggtctttctccgtccgtacccttaaccaaacggttcgtacgggacaaaccgcccggcctttaccccggcgacgttcctcgtcggggccttccgagccctaggaggattggaagggtctaggtattattacggntctacgctctataatgcaggtcactacaaactaacgttggttttaccgggacgggacgggtaaccggtaacnggccgttcgtaaccgggtcctaacggtcccacgttcccgtaacgttcggtccccg

SEQ ID NO: 414054 - DNA, 739 bp, Homo sapiens
  misc_feature: GZ8MTXP01EUNO3.3.33.C11.1.454.CMB.2.raw
  modified_base (228)..(228): a, c, t, g, unknown or other
  modified_base (244)..(244): a, c, t, g, unknown or other
tcagagacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgagtcagcctgcctccgtgtctgggtctcctggacagtcatcaccatctcctgcacgtggaaccngcaggtgacgttgganattataatatgtctctgaccaacactccagacaaacgccccaaatgatgtatttatgatagtacaaataactccggcctagtagggtttctaactcgtccttctcgtggtctaccgtaaagtctcggaccaaaccgaccgggtcccctacccgttacgaaccctacttccgtcgtcggggtcctccggaggggttaggaacgggaacgggtacggtacgttaggtaactttaacgtttaacgttcggactaacggtaccttaacctaacgttttaaaccgaaacggacctaacggaccctaaccctaaccgttaccgtaaccgggtttaccgttaaccgggtaaaccggttacgggggtaaaccgttaaacgggttaccccgtaaacccgggtttaccccggtttaacgggttacccgtaacccgggaacccccgaaaaccggggtacccccgaaaacccccttacgttaaccggttaacccctttaacccccgg

SEQ ID NO: 414055 - DNA, 616 bp, Homo sapiens
  misc_feature: GZ8MTXP01AYXCC.3.33.C11.1.454.CMB.2.raw
  modified_base (207)..(207): a, c, t, g, unknown or other
  modified_base (268)..(268): a, c, t, g, unknown or other
  modified_base (371)..(371): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgcccccaaatcatgattangagtcacaaagcgccctcgacgggtccctgactcgcttctctgcctccaagtctcgacaacacggcctccgtcgaccgtctcgtggcctaccgagcctgaggntggagtctgtattattactgcagctctatagtcgcgaggacaactacaaaccgtacggtttacgggttttccggggaccgggtaacgggtaacccgaaacgtccgttacgggtaacccgttccgtacggggtacctaccgggaccccgtaaacgggtcccttcccgggtcccccttcgggtaccctccgttccgttccgttcccccgcccttcccgtcgtacgtcgttccggttcttccgtcggg

SEQ ID NO: 414056 - DNA, 702 bp, Homo sapiens
  misc_feature: GZ8MTXP01BYOFG.3.33.C11.1.454.CMB.2.raw
  modified_base (209)..(209): a, c, t, g, unknown or other
  modified_base (285)..(285): a, c, t, g, unknown or other
  modified_base (312)..(312): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgactagtttggtntaatttaataaactatgtcctccgtaggtaccagcacgccacccgaggaccaaaccgcccccaaatcatgtattangagtcacaagccgcctcgacgggtccngactcgtcttctctcgccctacgaagttcgtacggaccaaccgaccggtccccttcccgtccggtacccgttcgtcgtcgggtccctacccgacgtccgtaggaagggattcgggaaggtcttagttaactttactttacgtcgacgtacgtcttactaattacgtcgacgacggactaacgtaaccgtaaccgttacggggtttcgggttttaccgggggaccggggtaaccgggaaccgaacggtccgtacggtacccgttccgtacggtaccgaccgtacccgaacggtcccgttcccggtcccccgttcggtccctaaccgttcccgttcccgttaccccctaaccccgttccgtcggtacgtccgttccgttccgttcggtcggg

SEQ ID NO: 414057 - DNA, 711 bp, Homo sapiens
  misc_feature: GZ8MTXP01BHNBC.3.33.C11.1.454.CMB.2.raw
  modified_base (191)..(191): a, c, t, g, unknown or other
  modified_base (286)..(286): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccngcagtgactatttgggtataatttaataaactattcgttcctccgtggtaaccagcagccacccgaggaccaaacgcccccaaatcatgtattangaggtcaacaaacgccggccctcgacggggtcccctgactcgcttctctcgcctaccgaagtctacggaccaaccgaccggcccttcccgtcgacccgttctcgtcggggccctacccgagcccgtggaggatcggaggtcttaggtaactttacttaacgtgacacgtcctatactagtcgacgaggctactactaaaccgttcgggtttcgggttttacggggaccgggtaacgggtaacccgaacggtccgtacgggtacccgttccgtacgggtaccaaccggtaccccgtaacgggtccccgttcccggtccccccgttcggttccccgtaaccctttcccgttccccggtttaccccctaacccccgttcccggtaaccggtacggttccggttaccccgttcggttccggtccggggg

SEQ ID NO: 414058 - DNA, 596 bp, Homo sapiens
  misc_feature: GZ8MTXP01CBP4X.3.33.C11.1.454.CMB.2.raw
  modified_base (212)..(212): a, c, t, g, unknown or other
tcagagacgcactccacgaccggtgctcgatttagagtgagctcgttgggtttgggggctttgcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttanatctctgtctctgtaccaacaacaccaggcaaagcccccaaatcatcatttatgatgtcactgctcggccctctaggggtttctcatcgtcttttctggctccaagtctggccaccacggcctccctcgaccatccgtcggggcctccgaggctggagggcgaggctgcttattactgcagctcatatacgaaggacgacaccactcgtcggttaggggttagtttggggtacgggagggtaaccgtaaagccgtacggtaacccgtcgtacgggtaccacggccccgaaacgggtcccgttccggcccccgttcgggtccctaccgttcccgttccgttccccctaacccttcccgtcgtacgtcgccgttccgttcgtcggg

SEQ ID NO: 414059 - DNA, 683 bp, Homo sapiens
  misc_feature: GZ8MTXP01AGQS9.3.33.C11.1.454.CMB.2.raw
  modified_base (278)..(278): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgactagtttggtataatttaataaactatgtctcctaggtaccagcagccacccaggcaaacgcccccaaatcatgattangaggtcaacaaagccggccctcgacggggtccctgactcgcctttctctcgccctccgaagttcgtaggaccaaaccgaccggccccttccccgtcgacccgttctccgtcgggcctacccgagccctggacgggatggagtctagttaacttattactggcagtctactatagtcgacgaggacaagtaccaacgttacggtttcgggtttaccggggacgggaacgggaaccgaaggtcgtacggtacccggtacgtacggtaccaaccggcccggaacggtcccgttcccggtcccccggttacgtacccgttacccgtttcccgttcccggttttccccccggccccgttacccgttaaccgggtcggttccggttcccggttcgtttccgtaaccggggg

SEQ ID NO: 414060 - DNA, 762 bp, Homo sapiens
  misc_feature: GZ8MTXP01E2PZL.3.33.C11.1.454.CMB.2.raw
  modified_base (210)..(210): a, c, t, g, unknown or other
  modified_base (276)..(276): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgactagtttggtnatttaataactatgtctcctggtaccagcagcacccaggaccaaacgcccccaaatcatgatttangaggtacaacaaacgccggccctcgacgggtcccctgactcgtaccttctctcgccctaccaagttccgtacggaccaaaccgacccggtccccttccccgtcggtacccgttcttcgtcggggcccttacccgagtccctagggaagggtacgtcgggagggtcttaggttaatttaacgtttacgtcgtacgacggtccttacgtaacttacgttacgacgaacgggacctaacgttaacctaaaccgttaacgggtttacgggtttttaccgggggaccggggtaaaccggggtaacccgaaacggtccggtaccggtaacccggttccggttaaccgggtaccgaaccggaccccggtaaacgggtcccgttcccgggtccccccgttccgggtacccctacccgttcccgttcccggtttaccccctaaccccgttcccgttaaccggtacggtccggttccgttccgttcggttccgggg

SEQ ID NO: 414061 - DNA, 598 bp, Homo sapiens
  misc_feature: GZ8MTXP01BYKW9.3.33.C11.1.454.CMB.2.raw
  modified_base (243)..(243): a, c, t, g, unknown or other
  modified_base (305)..(305): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactattggtnattataactatgtctctggtacagcagcaccaggaccaaacgcccccaaatcatgtatttangaggtacacgaaacgccggcctcgacggggtccctggactcccgcttctctcgccctaaccaagtctacggaccaaaccgaccggccctcccgtcgacccgttctcgtcgggcctccgacgtccgtaggaggattcggaggtctagtaatttattacgtgtacgatctactatagtgacagacctaataccaactaacgtttcggtttacgggacgggaacgggaaccaaggttccgttcggttacccgtccgtagggtccacggacccgacggtccgttccccggtcccccg

SEQ ID NO: 414062 - DNA, 654 bp, Homo sapiens
  misc_feature: GZ8MTXP01EEMKN.3.33.C11.1.454.CMB.2.raw
  modified_base (245)..(245): a, c, t, g, unknown or other
  modified_base (312)..(312): a, c, t, g, unknown or other
tcagagacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaaccagcagtgactattggtnaattaataactatgtctctggtaccagcagccaacccaggacaaacgcccccaaatcatgtatttangagtacaacgaaacgccggccctacgacggggtccctaggactcccgctttctctcgccctaaccaagtcgtacgggaccaaaccgccggtacccctcccgtcgtacccgtctcgtcggcctcgacgccgtaggagtagtggaacggtctagtaatttacttacggttcgacgacgtactactaatagtcgacgtagcctaactacctaagtaacccgttttggggtttaccggggacggaaacgggaacccgttaacgggccgttccgggttaaccccggtccgttaacgggttccgaccgggtaaccccgaacgggtccccgttccccggttccccccgg

SEQ ID NO: 414063 - DNA, 758 bp, Homo sapiens
  misc_feature: GZ8MTXP01CGVSS.3.33.C11.1.454.CMB.2.raw
  modified_base (209)..(209): a, c, t, g, unknown or other
  modified_base (277)..(277): a, c, t, g, unknown or other
tcagagacgcactccacgaccggtgctcgatttagagtgagctcgttgggtttggcggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgactagttggtnaatttaataactatgtcctcctggtaccagcagccacccgaggaccaaacgccccaaatcatgtatangagtacaacaagccgccctgacgggtccctgactcgcttctctcgccctacgaagtccgtacggaccaaaccgaccggtcccttccccccgtcggtaccgttccgttccgtcggggcccttacccgaacgtcccgttagggaaacgggtactacggggaacgggtcttaacggtaatttttaacgttaccgttacgaccgtacgtacccttaactaagttaagtcggaccgtaacggacctaactaaccgtaaaccggtttacggttttacggggttttaccggggaaccggggtaaccgggaacccgaaacggtccgttaaccggtacccggttaccgtacgggtacccgaaccggaaccccgtaacggttcccttccccggttcccccgtaccggttacccgttacccgtttcccgttacccggtttcccccctaccccgttcccgttaccggtcggttccgtcccgttcgttcccggg

SEQ ID NO: 414064 - DNA, 553 bp, Homo sapiens
  misc_feature: GZ8MTXP01B8H15.3.33.C11.1.454.CMB.2.raw
  modified_base (266)..(266): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctctgtaccagcagcacccaggcaaacgccccaaatcatgatttangaggtcaacaaagcggccctcgaggggtacctgactcgcttctctgcctacaagtctggcaacgaccggcctccctcgacccgtctcgtgggcctccagcctgagatgaggtctagtattatactgcatctcatatgcagcatacaaactcgttcgttttcggcggtacgggaacaacgcgtacgtaccgtccgtaggtccacgcccgaacggcgttaccgccccgttcgtcctacttccgttcgttccccgtccctcccgtcgtcgtcgttccgttcgttcgtcgg

SEQ ID NO: 414065 - DNA, 604 bp, Homo sapiens
  misc_feature: GZ8MTXP01DTY4R.3.33.C11.1.454.CMB.2.raw
  modified_base (209)..(209): a, c, t, g, unknown or other
  modified_base (277)..(277): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatcctcctgcactggaaccagcagtgacagtttggtnattaataaactatgtcctcctggtaccagcagccacccaggaccaaacgcccccaaatcatgtattangagtcacaaagcggcctcgacgggtccctgatcgcttctctcgcctcaagtctggcaacgcgcctcctcgaccgtctcgtcgggcctaccgagccgtgacggatggaggtctagtatttattactgcagctacatatgcaggacactacaactacgggtttcggtttacgggacgggtaacgggaccaagtccgtacggtaacccgtccgtaacgggtccaaccggacccgtaacggtccgttcccgtccccgttcggttccctacgttccgtttcccgttcccctaacccttccgtaacggtcgtcgttccgttcgttcggtcggg

SEQ ID NO: 414066 - DNA, 559 bp, Homo sapiens
  misc_feature: GZ8MTXP01CKPV9.3.33.C11.1.454.CMB.2.raw
  modified_base (207)..(207): a, c, t, g, unknown or other
  modified_base (217)..(217): a, c, t, g, unknown or other
  modified_base (298)..(298): a, c, t, g, unknown or other
  modified_base (300)..(300): a, c, t, g, unknown or other
  modified_base (365)..(365): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactntgtctcctggtaccagcagcacccaggcaaacgcccccaaatcatgatttatgaggtcacaaagcggccctcagggtcccngntcgcttctctgcctccaagtctggcaacacggcctcctgaccgtctttgggctccaagcctgagntgaggctgtattattactgcagctcatatgcaggcatcaactacgttgggttttcgggcgggtagggaccaagccgtcgtaccgtccgtacggtccacgtccccgaagggcctaccgcccccgttcgggttcctaccttccgttccgtttccccaccccgttccctcgtcgtcgccgttctccgttggaacggg

SEQ ID NO: 414067 - DNA, 635 bp, Homo sapiens
  misc_feature: GZ8MTXP01CFLT9.3.33.C11.1.454.CMB.2.raw
  modified_base (228)..(228): a, c, t, g, unknown or other
  modified_base (245)..(245): a, c, t, g, unknown or other
  modified_base (309)..(309): a, c, t, g, unknown or other
tcagagacgcactccacgaccggtgctcgatttagagtgagctcgttggggtttggggggggtctcaggaggcagcgctctcaggacgtcaccaccatggcctgggctctgctcctcctcaccctcctcactcagggcacagggtcctgggcccagtctgccctgactcacgcctccctccgcgtccggtctcctggacagtcagtcaccatctctgcactggaaccngcagtgactagttggtntattaataactatgtctctggtacagcagccaccaggaccaaaccgccccaaatcatgtattangagtcaacaacgccgtcctcgacgggtccctagactcccgtcttctcgtcgaccctacctaagtcgacggtaccaaaccgccggtccctacccgtcgacccgttctccgtcgggcctccgacgtcccgtaggacggtacgtggacggtcttagttatttacgtttaccggtgtacgtacgtctactagtacgtcgacgacgtactacgtaccgtaacgttaacggttcggttacgggacggttacggtaaccgtacgttccgttacggttacccgtaaccgtacggtccgaccggtacccgttaccggtcccgttcccggtccccg

SEQ ID NO: 414068 - DNA, 680 bp, Homo sapiens
  misc_feature: GZ8MTXP01AL02I.3.33.C11.1.454.CMB.2.raw
  modified_base (245)..(245): a, c, t, g, unknown or other
  modified_base (305)..(305): a, c, t, g, unknown or other
tcagagacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactattggtanattataactatgtctctggtaccagcagcaccaggacaaacgccccaaatcatgatttangagtcacaagccgcctgacgggtcctgactccgcttctctcgcctaacagtctggaccaacgccgtcctcctcgtacccgtctcgtcgggcctccgacgtcccgtaggaggtagttcggaacgggtctaggtaacttttaacttaaccggtcggtactaacggtccttaccgtaacttaacgttggaaccgtaacgggtacctaacgttaaccctaaacgttaacccggtttcgggtttttacccgggggacccgggggttaacggggtaaaccccgaaacggttcccgttaccgggttacccgttaacccggttaaacggtcccgtaacccggaccccggaaacggtccccgttaaccccggttcccccccggg

SEQ ID NO: 414069 - DNA, 651 bp, Homo sapiens
  misc_feature: GZ8MTXP01CM6YO.3.33.C11.1.454.CMB.2.raw
  modified_base (221)..(221): a, c, t, g, unknown or other
  modified_base (280)..(280): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctcctcgcgtccggtctcctggacagtcagtcaccatctcctgcactggaaccagcagtgactagttggtataatttaataaactnttcgtctcctggtaccagcacgccaaccgaggaccaaacgcccccaaatcatgtattangagtacaacgaacgccggcctcgacgggtcctgactcgtcttctctcgcctacaagtctaggaccaacgtaccgcctccgtccgaccgtcgtcgtcggcctaccgacgtccgtaggacgtatggaggtcttagtattacttacgacgcgtacgctacagttactcgacgacggtactaactactaacgttacgggttacgggtttacgggaaccgggtaacggaaccgtaacgtcccgttacggtaacccgttcggtaaccgtaccgaaccggcccggtaacggtcccgttccccgtccccgttcggttaccctacttcccgttacccgttcccctaaccgtccgtcgtcgtcgttccgtcgttcgtcggg

SEQ ID NO: 414070 - DNA, 599 bp, Homo sapiens
  misc_feature: GZ8MTXP01DIMFB.3.33.C11.1.454.CMB.2.raw
  modified_base (207)..(207): a, c, t, g, unknown or other
  modified_base (265)..(265): a, c, t, g, unknown or other
  modified_base (337)..(337): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctgtaccagcagcaccagacaaacgccccaaatcatgattangaggtacaacaaagccggccctcgacgggtcccctgactccgtcttctctcgccctacaagtctggacaacnccggtccctcctcgacccgtctcgtcggcctaccagtccgtaggaggatcggaggtctagtaattacttacgtgacagtctacatatcgacgacgctaactacaacgttacggtttcggtttacgggacggtacggaacctacgcgtacgaccgtcgtacggtccgacgcccgaacgccgttcccgtaccccgttcggtacctaccgttcccgttccgttccccgtcccttccgtcgtcggtcgttccgttccgttcgtcgg

SEQ ID NO: 414071 - DNA, 686 bp, Homo sapiens
  misc_feature: GZ8MTXP01DO1ZI.3.33.C11.1.454.CMB.2.raw
tcagagacgcactccacgaccggtgctcgatttagagtgagctcgttggggtttgggggggggtctcaggaggcagcgctctcaggacgtcaccaccatggcctgggctctgctcctcctccaccctcctcactcagggcacagggtcctgggcccagtctgccctgactcagcctgcctccgtgtctgggtctcctggacagtcgtcaccatctctgcactggactccgaccggtgtacgttgacttaactttaattaagtttcgtcttccgtggtacctacggtaaaccaaaaaccacccgaaggacaaacgacccccaagtaacttaatagtatttatgtatgtcagtgagtccgcctgtaggttctacatcgtctttcgtgtctctaagtctacgccaaacgaccggtccctcccgtacgacctactcgtcgtcgggcctccgaggtcgtaggacggacggacgtcgttagtactttattcgtacgcacgtcctacaaactaaccaacccgaaccggacaacccgtagttcgggtttacggtttcggggttttacggggaacgggtaacgggaaccgaaacggttccgttaacgggtaacccgttaccggttacgggttaccgaaccggacccgtaacggtcccgtccccggttacccccgttccgggttaacccttccccg

SEQ ID NO: 414072 - DNA, 619 bp, Homo sapiens
  misc_feature: GZ8MTXP01BKVFK.3.33.C11.1.454.CMB.2.raw
  modified_base (209)..(209): a, c, t, g, unknown or other
  modified_base (274)..(274): a, c, t, g, unknown or other
  modified_base (306)..(306): a, c, t, g, unknown or other
  modified_base (341)..(341): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacatttgggtnatttaataacttatgtcctctggtaccagcagccacccaggccaaacgccccaaatcatgattangagtcaacaaagccggccctcgaggggtcccngactcgcttctctcgcctccaagtctcggcaaccncggtcctcctcgaccgttctcgtcggcctacccgagccgtggagacgtgaggtctgtatttattacgtgcagctacatatgcaggcatactaacgtacggttcggttttcgggacgggtacgggaaccgtaacgtccgtacggtaacccgttcgtaacggtaccgacggccccgaaacgggtcccgttcccggtcccccggttccggttccgtcccttcccgttccgttccccctaaccccgttcccgtaacgtcggtcgttccgttcgttcgtcggg

SEQ ID NO: 414073 - DNA, 711 bp, Homo sapiens
  misc_feature: GZ8MTXP01DV898.3.33.C11.1.454.CMB.2.raw
  modified_base (205)..(205): a, c, t, g, unknown or other
  modified_base (266)..(266): a, c, t, g, unknown or other
  modified_base (295)..(295): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctcctccgcgtccgggtctcctggacagtcagtcaccatctcctgcactggaaccagcagtgacattggnattataactatgtctcctggtaccagcagcacccaggcaaacgcccccaaatcatgattangagtcacaaagcggcctcgagggtccccngactcgtcttcgtactcgtcctacgacgtcgtacggaccaaaccgccgtccctccgtaccgtccgttcgtcggtcggtacctaaccgacgtcggtagaagtacgtacgacgtcgtagttaactttacgttacgtacacggtctactactaagttacgtcgtacgacgtactacgtaaactaacccgttacggggtttacgggtttacggggaaccggggttaaaccggaaccgtaacggtaccggtaccggtaaaccggttaccggttacgtaaccggtacccgaaccggtaaccggttcccgttcccggtcccccgggttccggttaaaccctcccgtttaccggttccccgttaccccctaacccggttacccgtaacggtcgtaccggttaccgttccgttccggttaacggg

SEQ ID NO: 414074 - DNA, 656 bp, Homo sapiens
  misc_feature: GZ8MTXP01BMH29.3.33.C11.1.454.CMB.2.raw
  modified_base (192)..(192): a, c, t, g, unknown or other
  modified_base (209)..(209): a, c, t, g, unknown or other
  modified_base (219)..(219): a, c, t, g, unknown or other
  modified_base (268)..(268): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccngcagtgactattggtanattataactntgtctctggtaccagcagcaccagaccaaacgccccaatcatgtattangaggtcaacgaaacgccggccctcgacggggtccctgactcgtcttctctcgccctacagtctcggacaaccgcgccctccgtcgaccgtctcgtgggccctccgacgtccgtaggaggtactggacgggtctagtaactttattacgtgactacgtctacgtaattacgtacgacgaacggtacacgtaaccgtaaaccgttacggggtttcgggttttaccggggacgggaacgggtaaccaaggtccgtacggtacccgttccgtaggtaccgaaccgacccgtaacggtcccgttcccgtccccgttcggttaccctacccttccgttcccgtttccccaacccgttccgtcgtacggtccgttccgttcgttcccgtaagggg

SEQ ID NO: 414075 - DNA, 706 bp, Homo sapiens
  misc_feature: GZ8MTXP01EH8T9.3.33.C11.1.454.CMB.2.raw
  modified_base (218)..(218): a, c, t, g, unknown or other
  modified_base (247)..(247): a, c, t, g, unknown or other
  modified_base (325)..(325): a, c, t, g, unknown or other
tcagagacgcactccacgaccggtgctcgatttagagtgagctcgttgggtttggggggggtctcaggaggcagcgctctcaggacgtcaccaccatggcctgggctctgctcctcctcaccctcctcactcagggcacgagggtcctgggcccagtctgccctgactcagccctccctccgcgtccgggtctcctggacagtcagtcaccatctccngcactggaaccagcagtgactagttggtntaattaataactatcgtctccgtaggtaccagcacgccacccgaggaccaaaccgacccccaaactcatgtatttagnggaacgtacaaacgaaacgccggtcccgtagacggggtccctgtccttccccgtctttcgtccgtcgtacccctaaccgtaacgtccgtacgggaaccctaaaccgtccccggtccccgtttccccgtcgtaccccgttcgttccggtcgggtacccttccgaacgtcccgtagggacggtagtaggacgggttacttaggttaatttacgttaacggtcgtacgtacgtacctactaagtacgttgaccgtaggtacctacgttaacctaaacgttaacggttttcgggtttaccgggacgggttaacggaacgtaacgccgttacggttacccgtcgtaacggtccacggacccgaacggtcccgttcccggtcccccg

SEQ ID NO: 414076 - DNA, 681 bp, Homo sapiens
  misc_feature: GZ8MTXP01ALRRT.3.33.C11.1.454.CMB.2.raw
  modified_base (207)..(207): a, c, t, g, unknown or other
  modified_base (272)..(272): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnatttataactatgtctcctggtacccagcagccaacccaggcaaacgcccccaaatcatgattangaggtcaacgaagccggccctcgacgggtccctgactcgtcttctctcgcctcaagtctcggaccaacgaccggcctccgtcgtacccgtctcgtcgggcctccgacgcctaggagtacgtggacggtctagtaactttacttacgtcgcgacgtctactaagttacgtcgacgacggactaactaccgttaaaccgttaccggggtttcgggtttttaccgggggacggggtaaccgggaacccgtaacggtccgttaccggtaacccggttaccgtacgggttaccgtaacccggcccggaaacggtcccgttcccggtcccccgttccgggtaccctacccgttcccgttcccgttacccccgtcccttccgtcggtcggtcgttccgttccgttcggtaaccggg

SEQ ID NO: 414077 - DNA, 615 bp, Homo sapiens
  misc_feature: GZ8MTXP01AIB1Z.3.33.C11.1.454.CMB.2.raw
  modified_base (207)..(207): a, c, t, g, unknown or other
  modified_base (268)..(268): a, c, t, g, unknown or other
  modified_base (415)..(415): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcaccaggcaaacgccccaaactcatgatttangaggtcaacaaagcggccctcgacggggtcccctgatcgcttctctgcctcaagtctggcaacacggcctcctcgaccgtctcgtcgggcctaacccgacgcctgacgggatggaggtctagtactttattactgcagctcatacgngcgagactactacaacgttacgggttcggtttacgggacgggaacgggaaccgacgtccgtacggtacccgtacgtacggtaccgaccggacccgtaacggtcccgttcccggtccccgttcggtacccgtacccgttcccgttcccgttacccccgaaccccgttccgtcggtcgtcggttccgttccgttcggtcggg

SEQ ID NO: 414078 - DNA, 613 bp, Homo sapiens
  misc_feature: GZ8MTXP01ARLOO.3.33.C11.1.454.CMB.2.raw
  modified_base (206)..(206): a, c, t, g, unknown or other
  modified_base (267)..(267): a, c, t, g, unknown or other
  modified_base (365)..(365): a, c, t, g, unknown or other
  modified_base (397)..(397): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcaccaggcaaacgcccccaaatcatcatttangatgtcactgctcggccctgagggtttctcattcgtcttttctggctcaagtctggcaccacggccctccccctgacctagtccgtcggggctcccgnggctggagggacgaggtctgtcctttattacngcagtctacatatacgaaggacgccaacctacttccgttcgggtggttagtttgggtagggaaggtacccgaaggcctacggacccgttccgtaggtccacggcccgaacggttcctccggccccccgtcgggttcccaaccccgtttcgttccccggtttaacccccccctccccgttcccggttcggtacggttcccggtcccgttccgtccgg

SEQ ID NO: 414079 - DNA, 643 bp, Homo sapiens
  misc_feature: GZ8MTXP01EGT8M.3.33.C11.1.454.CMB.2.raw
  modified_base (287)..(287): a, c, t, g, unknown or other
  modified_base (316)..(316): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgactagttgggtataatttaataaacttattcgtccttcctggtacccagcagccaacccaggaccaaaacgcccccaaatcatgattangagtcacaaagcgcctgacgggtcccagntcgcttctctcgcctacgaagtctggacaacacggcctccgtcgaccgtctcgtggcctccacgtcctggaggatcgaggtctagtatttatactggacactctactatatgacaggacaacttacaaacgttacggttacggtttttacgggacggggacgggaaccgaacgccgttacggaccgttaccgtacggtccgacgaccccgaacgggtccttcccggtcccccgttcgggttcccttaaccggtttccccgtttcccccttaaccccgtttcccgtcgggtaaccgtcggtcccggttaccttcggttcggtccgggg

SEQ ID NO: 414080 - DNA, 636 bp, Homo sapiens
  misc_feature: GZ8MTXP01ELD7N.3.33.C11.1.454.CMB.2.raw
  modified_base (209)..(209): a, c, t, g, unknown or other
  modified_base (273)..(273): a, c, t, g, unknown or other
  modified_base (336)..(336): a, c, t, g, unknown or other
  modified_base (358)..(358): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgactagtttggnatttataactatgtctcctggtaccagcagcacccgaggaccaaacgccccaaatcatgattangagtcacaaagccgcctgacgggtccctgactcgcttctctcgcctacagtctacggacaacnccggtcctcccgtcgaccttcncgtcggcctacccgagccgtggacggtagtggacgggtactagtaactttattactgacgtacgtcttactaattatgacgaggactaactactaaaccgttacgggtttcgggtttttaccgggacgggtaacgggtaaccgaacggtccgttacggtaacccgttccgtacggtacgtaccggacccgaacggtccgttcccggtaccccgttcggtacctacccttccgttcccgttccccgtcccctgtcgtcgtcgttcctcggttcgtcggg

SEQ ID NO: 414081 - DNA, 640 bp, Homo sapiens
  misc_feature: GZ8MTXP01DYVJC.3.33.C11.1.454.CMB.2.raw
  modified_base (245)..(245): a, c, t, g, unknown or other
  modified_base (378)..(378): a, c, t, g, unknown or other
  modified_base (500)..(500): a, c, t, g, unknown or other
  modified_base (513)..(513): a, c, t, g, unknown or other
tcagagacgcactccacgaccggtgctcgatttagagtgagctcgttggggtttggggggggtctcaggaggcagcgctctcaggacgtcaccaccatggcctgggctctgctcctcctcaccctcctcactcagggcacgagggtcctgggcccagtctgccctgactcagcctcctcgcgtccgggtctcctggacagtcagtcacatctctgcactggaaccagcaagtgactagttggtanattaataactatcgtctcctaggtaccagcagaccaaccaagaacctaaacgacccccaaaatcatagtactttagagagtacaacaaacggccgtaccctaggaacgggtcctaggaccttccgccttttcncgtcgtacccttaacccgaaggttccgagggaccctaaaccgacccggcccctccgtgacccgttctcgtcgggcctacgagtcctagggagatggaaggtctaagtatttacgttaacggngactacgtactanaagtgagacgacgtactacgtaacgtaacgtaacgttacggttacggtacgggaacggtaacgtaacgttacgttccgttaccgtaaccgtacgtaaccgacgtaccgaccgtccgttcccgtcccg

SEQ ID NO: 414082 - DNA, 758 bp, Homo sapiens
  misc_feature: GZ8MTXP01CMOYL.3.33.C11.1.454.CMB.2.raw
  modified_base (285)..(285): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccggtctcctggacagtcagtcaccatctcctgcactggaaccagcagtgactagtttggtagtaatttaataaactatgttcctcctggtaccagcagccacccgaggaccaaaacgcccccaaatcatgtatttanagagtacaacgaaagccggccctcgacgggtccctgactcgtcttctactcgccctacgaagttcgtacggaccaaaccgccggtcccttcccgtacgacccgttctcgtcgggccttacccgagtcccgtaggacggagttggaggtacttagtaacttttacgttacgtacgacgtacgtaccttacgaatttagtacgaccgtaacggactaactaaccgtaaaccgtttacggggtttcggggttttaccgggggaaccgggtaaccggggaaaccctaacgggtccgttaccgggtaaaccccggttccgtaaccgggtacccgaaacgggcccccgtaaacggggtcccttccccggtaccccccgttacggttacccttaccgttccccggttaccgttaccccccctaaccccgtttcgtaacccggtacggtttccgggttacccgttccgttcgggtccgggg

SEQ ID NO: 414083 - DNA, 514 bp, Homo sapiens
  misc_feature: GZ8MTXP01ETLM9.3.33.C11.1.454.CMB.2.raw
  modified_base (206)..(206): a, c, t, g, unknown or other
  modified_base (266)..(266): a, c, t, g, unknown or other
  modified_base (346)..(346): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggnattataactatgtctcctggtaccagcagcacccaggcaaagccccaaatcatgatttangaggtcacaaagccggccctgaggggtcccctgatcgcttctctcgcctcaagtctggacaacacggcctcctgaccgtncgtggctccagcctgaggatgagctgattatactgcagctcatatgcaggcatacaactacgttgtttacggcggacgggaccagactgaccgtctaggtcacgccgaaggcttcgcccttcgtcacttcgttcttcccaacctcctcgacgtcgttcgtcttcgcgg

SEQ ID NO: 414084 - DNA, 517 bp, Homo sapiens
  misc_feature: GZ8MTXP02HWX9J.3.33.C11.1.454.CMB.2.raw
  modified_base (239)..(239): a, c, t, g, unknown or other
  modified_base (300)..(300): a, c, t, g, unknown or other
  modified_base (308)..(308): a, c, t, g, unknown or other
tcagagacgcactccacgaccggtgctcgatttagagtgagctcgttgggtttgggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggaaccagcagtgacattggtnattataactatgtctcctggtaccagcagcacccaggcaaagcccccaaatcatgatttangaggtcanaaagcggcctcaggggtccctgactccgcttctctgcctccaagtctggcaacaccggcctccctgacccgtctctggctccagccctgacgatgaggctgattattactgtcagctcatatgcaggcatacaactacgttcggttttcggacggtacggggaccaaggctgaccgtccgtacggtcacgcccaacggctcgtcccccg

SEQ ID NO: 414085 - DNA, 512 bp, Homo sapiens
  misc_feature: GZ8MTXP02HMHON.3.33.C11.1.454.CMB.2.raw
  modified_base (206)..(206): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaagcccccaaactcatgatttatgaggtcacaaagcggccctcaggggtccctgatcgcttctctgcctccaagtctggcaacacggcctcctcgacccgtctctgggctccagcctgaggatgaggctgattattactgcagctcatatgcaggcatacaactacttgttttcggcggagggaccaagcgtacgaccgtctaggtcagcccaacgctcgcccctcggtcactctcgtcccaaccctcctcgacgtgcgtctctcgg

SEQ ID NO: 414086 - DNA, 554 bp, Homo sapiens
  misc_feature: GZ8MTXP02G1OKG.3.33.C11.1.454.CMB.2.raw
  modified_base (206)..(206): a, c, t, g, unknown or other
  modified_base (337)..(337): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgcccccaaatcatgatttatgaggtcacaaagcggccctcaggggtccctgatcgcttctctgcctcaagtctggcaacacggcctccngaccgtctctgggctccagcctgaggatgaggctagtattatactgcagtctcatatgcgagcatacaactagttcggtttcgggacgggtacgggaaccaacgtcgtacggtacccgtcgtacggtcacgacccgaacggcctccggcccccgttcggtacctaccgttccttccgttaccccaacccgtccgtcgtacgtcgtccgtctcgtcgg

SEQ ID NO: 414087 - DNA, 575 bp, Homo sapiens
  misc_feature: GZ8MTXP02GPV7M.3.33.C11.1.454.CMB.2.raw
  modified_base (243)..(243): a, c, t, g, unknown or other
tcagagacgcactccacgaccggtgctcgatttagagtgagctcgttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactagttggtnaatttataactatgtctcctggtaccagcagcacccaggacaaacgcccccaaactcatgatttatgagtacaacaaaggccggccctgacggggtccctgactcccgtcttctctcgccctccaagtcgtcggaccaaaccgaccggtcccctcccgtcgaccccgtctccgttcgggcctccgacgcccgtaggaggatggaggctagtatttattactgcagctacatatgcagcatacaactacgttgtttacgggacgtagtacgaccgaacgtccgtacgtaacccgttaccgtacggtaccacggacccaacgggtcctccccgg

SEQ ID NO: 414088 - DNA, 534 bp, Homo sapiens
  misc_feature: GZ8MTXP02G59SN.3.33.C11.1.454.CMB.2.raw
  modified_base (206)..(206): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgcccccaaactcatgatttatgaggtcacaaagcggccctcgaggggtccctgatcgcttctctgcctccaagtctggcaaacaccggcctccctcgacccgtctcgtgggcctccgagccctgacggactgaggctagattatactgcagctcatatgcagcatacaactatcgtttcggcggtagggaccaagcgtcgaccgtcgtaggtcacgccctaaggcctcgccccctcggctaccgtcgtccgttccccgcccttccgtcgtcgtcgccgtctcgcgg

SEQ ID NO: 414089 - DNA, 549 bp, Homo sapiens
  misc_feature: GZ8MTXP02G5IUM.3.33.C11.1.454.CMB.2.raw
  modified_base (241)..(241): a, c, t, g, unknown or other
tcagagacgcactccacgaccggtgctcgatttagagtgagctcgttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttgganatataattatgtctcctggtaccaacaactcccaggcaaacgcccccaaactgatgatttatgatgtacaataatcggccctgaggggtccctgactcgtcttcctctcgcctcaagtctggcaacacggcctcctgaccgtctcgtcggcctccgagcctgacgatggagctagattattactgcagtctactattacaagcagcaccactacgacgtcttacggaacgtgggaactaacggtacctaccgttaccgtacggtacaacggacccaaacggaccccaaaccccgactacgtactaccc

SEQ ID NO: 414090 - DNA, 529 bp, Homo sapiens
  misc_feature: GZ8MTXP02J25DT.3.33.C11.1.454.CMB.2.raw
  modified_base (206)..(206): a, c, t, g, unknown or other
  modified_base (303)..(303): a, c, t, g, unknown or other
  modified_base (364)..(365): a, c, t, g, unknown or other
  modified_base (367)..(367): a, c, t, g, unknown or other
  modified_base (369)..(369): a, c, t, g, unknown or other
  modified_base (371)..(371): a, c, t, g, unknown or other
  modified_base (383)..(383): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcaccaggcaaagcccccaaatcatgattatgaggtcacaaagcgcctcaggggtccctgatcgcttcnctgcctccaagtctggcaacgacggcctccgtcgacccgtctcgtggctccagcctgaggnngngntntatatactgcanctcatatgcgacgacactacactacgtcgttcggacggacggacgacgcgtacgaccgtacgtacgtacgacgaccgacgccgccgcccgtccgtaccgtcctccgtcccgtccctcccgtccgtcgtcgtcgtccgtcgtcgtcg

SEQ ID NO: 414091 - DNA, 504 bp, Homo sapiens
  misc_feature: GZ8MTXP02G6LS9.3.33.C11.1.454.CMB.2.raw
  modified_base (206)..(206): a, c, t, g, unknown or other
  modified_base (288)..(288): a, c, t, g, unknown or other
  modified_base (337)..(337): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgcccccaaatcatgatttatgaggtcacaaagcggccctnaggggtccctgatcgcttctctgcctcaagtctggcaacacggcctccngaccgtctctggctccagcctgagatgaggctgtattattactgcagctcatatgcaggcatacaacactgtttcggcggtagggaccaagctgaccgtctaggtcagcccaaggctcgcccctcggtcactctcgttcccaaccgtcctcgtactcgctctctcgg

SEQ ID NO: 414092 - DNA, 515 bp, Homo sapiens
  misc_feature: GZ8MTXP02GBZX9.3.33.C11.1.454.CMB.2.raw
  modified_base (206)..(206): a, c, t, g, unknown or other
  modified_base (402)..(402): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaagccccaaactcatgatttatgaggtcacaaagcggccctcaggggtccctgatcgcttctctgcctcaagtctggcaacacggcctcctgaccgtctctgggctccagcctgaggatgagctgattatactgcagctcatatgcaggcatcaaanactgttttcggcggagggactacgagtcgacgtaccgtacgtacgacgacgaccgacgtcgccctcccgtcgacctctcgttccgtccctccctcgtcgtcgtcgtctctcgg

SEQ ID NO: 414093 - DNA, 312 bp, Homo sapiens
  misc_feature: GZ8MTXP02FE7GC.3.33.C11.1.454.CMB.2.raw
  modified_base (309)..(312): a, c, t, g, unknown or other
tcagagacgcactccacgaccggtgctcgatttagagtgagctcgttgggttgggaggtcacaaagcggccctcagggtccctgatcgcttctctgcctccaagtctggcaacacggcctccctgaccgtctctgggctccagcctgaggatgaggctgattattactgcagctcatatgcaggcatcaacactgttttcggcggaggaccaagctgaccgtcctaggtcagcccaaggctgcccctggtcactctgttccccgccctcctcgagtgcgtctctgagcgggctgggcaaggcgcatagnnnn

SEQ ID NO: 414094 - DNA, 552 bp, Homo sapiens
  misc_feature: GZ8MTXP02HQV1J.3.33.C11.1.454.CMB.2.raw
  modified_base (206)..(206): a, c, t, g, unknown or other
  modified_base (313)..(313): a, c, t, g, unknown or other
  modified_base (393)..(393): a, c, t, g, unknown or other
  modified_base (408)..(408): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaaagcccccaaaactcaatgatttatgaggtcacaaaagcggaccctcaggggtccctgatcgcttcnctgcctcaagtctggcaaacacggctccctgaccgtctctgggctcccagcctgaggatgaggctgattattactgcagntcatatgcaggcaanacaactactgtttcggtcggacgggacgaacgacgtacgaccgtaccgtacgtacgacgaccgacggacgtccgcccgtccgtacctaccgtccttccgttaccctaacccgtcccgtaccgtacgtcgtccgtccgttcgtcg

SEQ ID NO: 414095 - DNA, 686 bp, Homo sapiens
  misc_feature: GZ8MTXP02ITSO4.3.33.C11.1.454.CMB.2.raw
tcagagacgcactccacgaccggtgctcgatttagagtgagctcgttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaacgcccccaaatcatgatttatgaggtacaacaaacgcggcctcgacggggtccctagactccgcttctctgcctccaagtctggcaacgaccgccctccgtgacccgtctcgtcgggcctccgacgtccctaggacgggtagtcggaacgggtccttaggttaaacttttaacgtttaaccgtcggtaccgtaacggtccttaccgtaatttaacgttcggaccgtaacgggacctaaacgtacctaaaacccgttaacgtttcggggtttttaccggggaccgggggtaaacggggaacccgtaaaacggtccgttaacggtaaccccggttaaccggttaaccggggttaccgtaaaccggacccccgaaaacggggtcccgttaccccggttcccccccgg

SEQ ID NO: 414096 - DNA, 510 bp, Homo sapiens
  misc_feature: GZ8MTXP02HDFNB.3.33.C11.1.454.CMB.2.raw
  modified_base (206)..(206): a, c, t, g, unknown or other
  modified_base (287)..(287): a, c, t, g, unknown or other
  modified_base (327)..(327): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaagcccccaaatcatgatttatgaggtcacaaagcggccctnaggggtccctgatcgcttctctgcctcaagtctggcaacncggcctcctcgaccgtctctgggctccagcctgaggatgaggctgattattactgcagctcatatgcagcatcaactactagttttcggcggagggaccaagctgaccgtctaggtacacgcccaacggctcgccccgtcggtccactctcgtcccaaccctccgtcgacgtcgctcgtctcg

SEQ ID NO: 414097 - DNA, 493 bp, Homo sapiens
  misc_feature: GZ8MTXP02FVJZ3.3.33.C11.1.454.CMB.2.raw
  modified_base (342)..(342): a, c, t, g, unknown or other
tcagagacgcactccacgaccggtgctcgatttagagtgagctcgttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaatcatgatttatgaggtcacaaagcggccctcaggggtccctgatccgcttcnctgcctcaagtctggcaacacgcctcctgaccgtctctggctccagcctgagatgagctgattatactgcagctcatatgcaggcatcaactactgtttcggcggtaggaccaagctgaccgtcgtaggtcacgcccaaggctcgcccccg

SEQ ID NO: 414098 - DNA, 504 bp, Homo sapiens
  misc_feature: GZ8MTXP02ICA5Z.3.33.C11.1.454.CMB.2.raw
  modified_base (194)..(194): a, c, t, g, unknown or other
  modified_base (239)..(239): a, c, t, g, unknown or other
  modified_base (244)..(244): a, c, t, g, unknown or other
  modified_base (298)..(298): a, c, t, g, unknown or other
  modified_base (423)..(423): a, c, t, g, unknown or other
tcagagacgcactccacgaccggtgctcgatttagagtgagctcgttgggtttgggggtctcaggaggcagcgctctcaggacgtcaccaccatggcctgggctctgctcctcctcaccctcctcactcagggcacagggtcctgggcccagtctgccctgactcagcctcctcgcgtccgggtctcctggacngtcagtcaccatctcctgcactggaaccagcagtgactattggtnattanaactatgtctctggtaccagcagcacccaggcaaagcccccaaatcatgattangagtcacaaagcggcctcgacggggtccctgactccgcttctctgcctccaagtctggcaaaccgacggccctccctgacccgtctcgtcggctccgagccctgacgatcgagctgattattacngtcagtctcatatgcaggcatcaactacgttgtttcggcgagggaccaagctgacgtcgtagcacgaccaggctcgccccg

SEQ ID NO: 414099 - DNA, 489 bp, Homo sapiens
  misc_feature: GZ8MTXP02GDMLL.3.33.C11.1.454.CMB.2.raw
  modified_base (239)..(239): a, c, t, g, unknown or other
tcagagacgcactccacgaccggtgctcgatttagagtgagctcgttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggnattataactatgtctctggtaccagcagcacccaggcaaacgcccccaaatcatgatttatgagtcacaaagcggcctcaggggtcctgatccgcttctctgcctcaagtctggcaacacgcctcctgaccgtctctggctccagccctgacgatgagctgattatactgcagctcatatgcaggcatacaactacttgtttcggcggtaggacctaagctgaccgtcgtagtcacgccagctcgccccg

SEQ ID NO: 414100 - DNA, 581 bp, Homo sapiens
  misc_feature: GZ8MTXP02IIBTT.3.33.C11.1.454.CMB.2.raw
  modified_base (307)..(307): a, c, t, g, unknown or other
  modified_base (382)..(382): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcaccaggcaaagcccccaaatcatgattatgaggtcaacaaagcggccctgaggggtcccctgatcgcttcnctgcctccaagtctggcaaacacggcctcctgacccgtctctgggctccagcctgagatgaggctgattattacngcagctcatatgacagactactacaactacgttaggtttacgggacgggtaacgggaccaagccgtacgtacccgtccgtacggtacacgacccgtaacggccgtcccgtacccccgtccggtaccctaccgttccgttacccgttaccccctaaccccgttcccgtaccggtacgtccgtccgttaccgttacgtcgg

SEQ ID NO: 414101 - DNA, 513 bp, Homo sapiens
  misc_feature: GZ8MTXP02G2D63.3.33.C11.1.454.CMB.2.raw
  modified_base (207)..(207): a, c, t, g, unknown or other
  modified_base (288)..(288): a, c, t, g, unknown or other
  modified_base (486)..(486): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgcccccaaatcatgattatgaggtcacaaagcggccctnaggggtccctgatcgcttctctgcctccagtctggcaacacggcctcctgacccgtctctgggctccagcctgacgatgagctgattatactgcagctcatagtgcagcatacaactacttggtttcggcggtagggaccaagctgaccgtcgtagtcacgaccaacggcctcgcccctggtccactctcgttacccnccgtccacgtcgtcgccgtcacgtcgg

SEQ ID NO: 414102 - DNA, 527 bp, Homo sapiens
  misc_feature: GZ8MTXP02HYW63.3.33.C11.1.454.CMB.2.raw
  modified_base (500)..(500): a, c, t, g, unknown or other
  modified_base (508)..(508): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctctggtaccagcagcaccaggcaaagcccccaaagtcaatgattatgaggtcaacaaagcggccctcgaggggtccctgatcgcttctctgcctcaagtctggcaaacaccggcctccctcgaccgtctcgtgggctccagcctgagatgaggctgattatactgcagctcatatgcaaggcaatcaaactacttggttttcggacgggagggacccaaagccgtggaacccgtcgtacggtcacgacccaaggcctcgcccctcggcactctcgtcccncccgtccncgacgtcgccgtctcgcgg

SEQ ID NO: 414103 - DNA, 541 bp, Homo sapiens
  misc_feature: GZ8MTXP02HI5JH.3.33.C11.1.454.CMB.2.raw
  modified_base (191)..(191): a, c, t, g, unknown or other
  modified_base (206)..(206): a, c, t, g, unknown or other
  modified_base (267)..(267): a, c, t, g, unknown or other
  modified_base (287)..(287): a, c, t, g, unknown or other
  modified_base (328)..(328): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaacngcagtgacattggtnattataactatgtctctggtaccagcagccacccaggcaaacgccccaaatcatgatttangaggtcacaaagcggccctnaggggtccctgatcgcttctctgcctccaagtctggcaacncggcctcctgaccgtctcgtcggctccgagcctgaggatgaggctgtattatactgcagctctatatgcagcatacaactacttggtttacggcggtacgggacagctcgaccgtcgtagtcgacgacccgaacgtccgtaccgccccgtcggtaccaccgttcgttcccgttccccgtcccttccgtcgtacgtcgtccgtcgttacgtcgg

SEQ ID NO: 414104 - DNA, 329 bp, Homo sapiens
  misc_feature: GZ8MTXP02JYR5H.3.33.C11.1.454.CMB.2.raw
  modified_base (316)..(329): a, c, t, g, unknown or other
tcagagacgcactccacgaccggtgctcgatttagagtgagctcggttggggtttggggaggtcacaaagcggccctcaggggtccctgatcgcttctctgcctccaagtctggccaacacggcctccctgaccgtctctgggctccaggcctgaggatgaggctgattattactgcagctcatatgcaggcatcaacactgtttcggcggagggaccaagctgaccgtctaggtcagcccaaggctgcccctggtcactctcgttcccgccctcctcgacgtcgcgtctctgagcgggctggcaaggcgcatagnnnnnnnnnnnnnn

SEQ ID NO: 414105 - DNA, 574 bp, Homo sapiens
  misc_feature: GZ8MTXP02H49XN.3.33.C11.1.454.CMB.2.raw
  modified_base (243)..(243): a, c, t, g, unknown or other
  modified_base (249)..(249): a, c, t, g, unknown or other
  modified_base (306)..(306): a, c, t, g, unknown or other
  modified_base (473)..(473): a, c, t, g, unknown or other
tcagagacgcactccacgaccggtgctcgatttagagtgagctcgttgggtttggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcacatctcctgcactggaaccagcagtgactagttgggtanattaanaacttatgtctcctggtaccagcagcaccaggacaaacgccccaaatcatgtattangagtcaacaaagccggcctgacggggtccctagactccgcttctctcgcccttacaagtctacgggcaaaccgaccggccctcccgtagtacccgtcctcgtcgggtcctccgacgtccgtagaggagtagacggtctagtatttaacttactgcagtctacattangacgacgacactactaacgtcgttacggtttacggacggtaacggacgtacgtcgtacgaccgtaacgtacgtacgaccgaccgtacggccgtaccgcccg

SEQ ID NO: 414106 - DNA, 534 bp, Homo sapiens
  misc_feature: GZ8MTXP02G9UES.3.33.C11.1.454.CMB.2.raw
  modified_base (206)..(206): a, c, t, g, unknown or other
  modified_base (301)..(301): a, c, t, g, unknown or other
  modified_base (338)..(338): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgcccccaaactcatgatttatgaggtcaacaaagcggccctcgaggggtcccngatcgcttctctgcctcagtctggcaacgcgcctccncgaccgtctctcggctccagcctgaggatgaggctgtattattactgtcagctcatatgcagcatacactacgttgtttcgcggagggaccaagcgtcgaccgtcgtaggtcacgacccgaacggccgtccgcccccgtcggtcctacctccgtccgttccccgtcccgtcctccgacgtcgccgttcgtcgtcgg

SEQ ID NO: 414107 - DNA, 520 bp, Homo sapiens
  misc_feature: GZ8MTXP02GEZ2N.3.33.C11.1.454.CMB.2.raw
  modified_base (206)..(206): a, c, t, g, unknown or other
  modified_base (329)..(329): a, c, t, g, unknown or other
  modified_base (338)..(338): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgccccaaatcatgatttatgaggtcacaaagcggcccctcaggggtcccctgatcgcttctctgcctcaagtctggcaacncggcctccngaccgtctctcggctccagcctgaggatgagctgattatatgcagctcatatgcagcatacaacacttcgttttcggcggagggaccaaacgcgtacgtaccgtctagtcacgacccaacggctcgcccctcggtctacctctccttacccaacccgttcctcgacgtcgtcgtctcgtcgg

SEQ ID NO: 414108 - DNA, 554 bp, Homo sapiens
  misc_feature: GZ8MTXP02GWXDR.3.33.C11.1.454.CMB.2.raw
  modified_base (242)..(242): a, c, t, g, unknown or other
  modified_base (302)..(302): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctctggtaccagcagcaccaggcaaacgcccccaaatcatgatttangagtcaacaaagcgcctcgaggggtccctgatccgcttctctcgcctcaagtctggacaacgaccggccctcccgtcgacccgtctcgtcggcctccacgcccgtgaggtatggaggctgtattattactgacagctacatatgacgaggacatacaacctacgttcggttttcgggacgggtaacgggaccgaaacgtcgtacgacccgtaaccgtacggtaccgacgaccgaacggctacccgtcccccg

SEQ ID NO: 414109 - DNA, 665 bp, Homo sapiens
  misc_feature: GZ8MTXP02H1NOS.3.33.C11.1.454.CMB.2.raw
  modified_base (226)..(226): a, c, t, g, unknown or other
  modified_base (244)..(244): a, c, t, g, unknown or other
  modified_base (303)..(303): a, c, t, g, unknown or other
  modified_base (331)..(331): a, c, t, g, unknown or other
  modified_base (344)..(344): a, c, t, g, unknown or other
tcagagacgcactccacgaccggtgctcgatttagagtgagctcgttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgactagttggtanattataactatgtctcctggtaccagcagcaccaggacaacgccccaatcatgtattangagtcaacaagcgccctgacggggtccngactccgtcttcnctcgtcctaccgaagtccgtacggacaaaccgaccggtcccctcccgtcgtacccgtcctccgtcggtcctccgacgtcccgtaggacggtacgtacggacggtcgttaacgtactttaacgtttacgtacgtaccgtaacgtaccttacctaagttacgttacggacgtaacggaccgtactaccgtaaaaccgttaccggtttacgggttttacccggggacgggttaaaccgggaaccgtaacggtaccgtaccgtacccggttaaccgtacggtaccgtaccggacccgtaaccggtcccgttacccggtcccccgg

SEQ ID NO: 414110 - DNA, 591 bp, Homo sapiens
  misc_feature: GZ8MTXP02IJUSE.3.33.C11.1.454.CMB.2.raw
  modified_base (207)..(207): a, c, t, g, unknown or other
  modified_base (268)..(268): a, c, t, g, unknown or other
  modified_base (327)..(327): a, c, t, g, unknown or other
  modified_base (364)..(364): a, c, t, g, unknown or other
  modified_base (380)..(380): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggccaaacgccccaaatcatgattangagtcaacaaagccggcctcgagggtccctgatcgcttctctgcctcagtctggcaacnccggcctcctgaccctctcgtcggctccagcctgagntgagctgtattatacngcagctacatatgacgagacatactaacgtacgttcgggttttaccggacgggtacgggaaacccaaggccttacggacccgttacgtacggtacacgaccccgtaaacgggccctaccggcccccgttaccggtacctacccgttacccgttcccgttaccccctaacccgttccccgtacgtacggtccgtccgttccgtccgtacggg

SEQ ID NO: 414111 - DNA, 566 bp, Homo sapiens
  misc_feature: GZ8MTXP02FT5RL.3.33.C11.1.454.CMB.2.raw
  modified_base (206)..(206): a, c, t, g, unknown or other
  modified_base (268)..(268): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgccccaaactcatgatttangaggtcacaaagcggccctcgaggggtcccctgatcgcttctctgcctccaagtctggcaacacggcctcctgacccgtctctcgggctccagcctgaggatgagctgatttattactgcagctcatatgacaggacatacaaactacgttcggttttcgggacgggtacgggaaccaagtcgtacggtacccgttcgtacggtacacgacccgtaaacggcctccggcccccgttcggtcctacgtttcctccgttaccccaacccgttccgtacgtacgtcgtccgtcctcgtcgg

SEQ ID NO: 414112 - DNA, 511 bp, Homo sapiens
  misc_feature: GZ8MTXP02FIJBK.3.33.C11.1.454.CMB.2.raw
  modified_base (206)..(206): a, c, t, g, unknown or other
  modified_base (347)..(347): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgcccccaaactcatgatttatgaggtcacaaagcggccctcaggggtcccctgatcgcttctctgcctccaagtctggcaacacggcctcctgaccgtntctgggctccagcctgaggatgaggctgattattactgcagctcatatgcaggcatcaacactgtttcggcggtagggaccaagctgaccgtcctaggtcagcccaaggctcgccccctcggtcaccttctcgttcccaaccctcctcgacgtgcgtctctcgg

SEQ ID NO: 414113 - DNA, 583 bp, Homo sapiens
  misc_feature: GZ8MTXP02IQWJD.3.33.C11.1.454.CMB.2.raw
  modified_base (206)..(206): a, c, t, g, unknown or other
  modified_base (267)..(267): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctcctccgcgtccgggtctcctggacagtcagtcaccatctcctgcactggaaccagcagtgacattggtnattataactatgtctcctggtaccagcagccaccaggacaaacgccccaaatcatgattangagtcacaaagcgcctcgacgggtcctgatcgctctctgcctccaagtctggacaacaccggcctcctcgaccctctctgggcctccgacgccgttgacggtagttcgacggtctagtaatttacgttaactggacaacgtctactatagtgacgaggacaactacaaacctaacgttcggtttttccggggacgggtaacgggaaccgaacgtcgtacggtacccgtacgtacggtacgacgaccccgtaacggcctccgcccgtacggtctaccgtcttccgttcccgcctccgtcgtcgtcgcgtctcgtcgg

SEQ ID NO: 414114 - DNA, 622 bp, Homo sapiens
  misc_feature: GZ8MTXP02IDYO1.3.33.C11.1.454.CMB.2.raw
  modified_base (207)..(207): a, c, t, g, unknown or other
  modified_base (407)..(407): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagccaccaggcaaacgcccccaaactcatgatttatgaggtcaacaaagccggccctcgacggggtccctgatcgcttctctgcctcaagtctggacaacgacggcctcctcgaccgttctcgtcgggacctccgagcccgtgaggtacgtgaggctagtaactttattacgngtacagcttcatatgacaggcaataccaaacttacgttggttttcggggacggtaacgggaacctaacggtcctttaaccggtccttacgggtaccacggacccgtaaacgggcctcccggtcccccgtcggtaacctacccgtttccttcccggtttacccccaacccccttcccgtaccggtacgttcggccgttccgtacgtcggaccgggg

SEQ ID NO: 414115 - DNA, 565 bp, Homo sapiens
  misc_feature: GZ8MTXP02JHY8F.3.33.C11.1.454.CMB.2.raw
  modified_base (225)..(225): a, c, t, g, unknown or other
  modified_base (240)..(240): a, c, t, g, unknown or other
  modified_base (556)..(556): a, c, t, g, unknown or other
tcagagacgcactccacgaccggtgctcgatttagagtgagctcgttgggtttggggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactggaaccngcagtgacattggtnattataactatgtctcctggtaccagcagcaccaggacaaacgcccccaaatcatgattatgagtacaacaaagccggccctcgacggggtccctgactccgcttctctgcctcaagtctcggacaacgaccgcctcccgtcgacccgttctccgtcgggcctccgacgcccgttaggaacggattcggaacggtctagtaatttacgttactcgacagcttacaattgcgcaggcaactcaaactcgtttagtttcgggacggtacgggaaccaacgtctcgaaccgtcgtacggtacacgaccgaacggtcccncccgtcccg

SEQ ID NO: 414116 - DNA, 516 bp, Homo sapiens
  misc_feature: GZ8MTXP02IS2VP.3.33.C11.1.454.CMB.2.raw
  modified_base (225)..(225): a, c, t, g, unknown or other
  modified_base (240)..(240): a, c, t, g, unknown or other
  modified_base (302)..(302): a, c, t, g, unknown or other
  modified_base (332)..(332): a, c, t, g, unknown or other
  modified_base (441)..(441): a, c, t, g, unknown or other
tcagagacgcactccacgaccggtgctcgatttagagtgagctcgttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacattggtnatttataactatgtctcctggtaccagcagcacccaggcaaacgccccaaatcatgatttangaggtcacaaaagcggcctcaggggtcccngactccgcttctctcgcctaccaagtctggccaacgaccgcctccctgacccgtctctgggcctcagcctgacggatgaggctgacttattactgctagcttcattacngcagctatacactcgttgttcggcggacggacacgtctacgaccgtcgtacgtacacgaccgacgcctcgtcccg

SEQ ID NO: 414117 - DNA, 561 bp, Homo sapiens
  misc_feature: GZ8MTXP02GW719.3.33.C11.1.454.CMB.2.raw
  modified_base (242)..(242): a, c, t, g, unknown or other
  modified_base (304)..(304): a, c, t, g, unknown or other
  modified_base (458)..(458): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggacaaacgccccaaatcatgatttangagtcaacaaagccggcctcgacggggtccctgactcccgcttctctcgccctaccaagtcgtggacaaaccgaccgccctccctgacccgtctcgtcggcctccgacgcctaggacggatggaggctagtattatactgacagtctacattancgacgagactatacaacgtacgttcggttacgggacggtaacggaaccacgtccgtacgtaccgtaacgtacgtaccgacgaccgacgtccgtacccgtcccg

SEQ ID NO: 414118 - DNA, 531 bp, Homo sapiens
  misc_feature: GZ8MTXP02HHQH3.3.33.C11.1.454.CMB.2.raw
  modified_base (244)..(244): a, c, t, g, unknown or other
  modified_base (519)..(519): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaaccagcagtgacgttggtanatataattatgtctctgtaccaacaactccagcaaacgcccccaaatgatgatttatgatgtacaataatcggccctcgacggggtccctgatcgtcttcctctcgcctccaagtctggcaacacggcctccctcgaccgtctcgtggcctccacgcctgaggatgaggctgtattattactgcagtctactattacaagtcagccaaccactcaggtcttacggaacgtggaactaaggtcaccgtctaggtcaacgcccaacggcccaacccnctcgtactaccg

SEQ ID NO: 414119 - DNA, 655 bp, Homo sapiens
  misc_feature: GZ8MTXP02GJHFZ.3.33.C11.1.454.CMB.2.raw
  modified_base (209)..(209): a, c, t, g, unknown or other
  modified_base (278)..(278): a, c, t, g, unknown or other
  modified_base (456)..(456): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacatttgggtntaattaataactatgtcctccgtggtaccagcagccacccaggacaaacgcccccaaatcatgatttangagtcaacaaagccgcctgacgggtccctgactcgtcttctctcgtccctaccgaagtctcggaccaaaccgaccggtccccttcccgtacgtaccccgttccgtcgtccggggtcctacccgacgtcccgtaggaaggtagtacgacggtcttagtaatttattactcgcagtcctntatactagacgacggacactaccaaacgtcgtttacggtttacgggacgggaacgggaaccaacggtcgtacgtacccgtacgttacggtacgaaccgacccgaacggtcctcccggtcccccgttcggtacctaccgttccgttcccgtttaccccaaccccgttccgtacggtacgtcgtccgttacgtcgtacggg

SEQ ID NO: 414120 - DNA, 605 bp, Homo sapiens
  misc_feature: GZ8MTXP02JM0AX.3.33.C11.1.454.CMB.2.raw
  modified_base (207)..(207): a, c, t, g, unknown or other
  modified_base (267)..(267): a, c, t, g, unknown or other
  modified_base (375)..(375): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgccccaaatcatgattangagtcaacaaagcgcctgacggggtccctgatcgcttctctcgcctacaagtctggacaacgaccggccctcctcgacccgtctcgtcgggcctccagccgtagaggntagaggtctagtattacttactgcagctcatagtcgcgagactactaccaaactacgttggtttccgggacgggtacgggaaccaagtccgtacggtacccgtccgtaacggtccgaacggacccgtaacggtcccgttcccggtacccccgttccggtccttacccgttccgttcccgttaccccaacccgttccgtacggtacgtcgtccgttaccgtcggtaccggg

SEQ ID NO: 414121 - DNA, 648 bp, Homo sapiens
  misc_feature: GZ8MTXP02IH9DF.3.33.C11.1.454.CMB.2.raw
  modified_base (208)..(208): a, c, t, g, unknown or other
  modified_base (269)..(269): a, c, t, g, unknown or other
  modified_base (329)..(329): a, c, t, g, unknown or other
  modified_base (374)..(374): a, c, t, g, unknown or other
  modified_base (381)..(381): a, c, t, g, unknown or other
  modified_base (393)..(393): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgcccctgactcagcctccctccgcgtccgggtctcctggacagtcagtcaccatctcctgcactggaaccagcagtgacattggtnattataactatgtctcctggtaccagcagcacccaggcaaacgcccccaaatcatgattangagtcacaaagccgcctcgaggggtccctgatcgcttctctgcctccaagtctgacaacnccggcctccctcgacccgtctcgtcgggcctcgacgccgtagagntgacgtntatattattacngcacgctactatagtcgacgagactactacctaaaccttacgtttcgggttttaccggggaccgggtaacgggaaccgaagtccgtaccgtacccgttaccgtacggtaccgaccgaacccggtaaccggtcccgttccccggtacccccgttaccggttacccttacccgtttacccgttaccccgtttaccccctaaccccgttcccgtaccggttaccggttccggtcccgtttaccgttacggtcccgggg

SEQ ID NO: 414122 - DNA, 551 bp, Homo sapiens
  misc_feature: GZ8MTXP02IA5BR.3.33.C11.1.454.CMB.2.raw
  modified_base (240)..(240): a, c, t, g, unknown or other
  modified_base (304)..(304): a, c, t, g, unknown or other
  modified_base (333)..(333): a, c, t, g, unknown or other
  modified_base (344)..(344): a, c, t, g, unknown or other
tcagagacgcactccacgaccggtgctcgatttagagtgagctcgttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggaaccagcagtgacattggtnattaataacttatgtctcctggtaccagcagcaccaggacaaacgcccccaaatcatgatttangagtcaacaaagcgcctgacggggtcccngatccgcttcnctgcctccaagtctcggacaaaccgccgtccctcccgtagacccgtcctcgtcggccttccacgcccgtgacggagtggacgctagtattattactgcagtctactatatgcaggcatacaactacgttggttttcggacgtacgggaccaacgtcgtacgaccgtccgtacgtaccacgacccgtaacggcccgttaccgcccccg

SEQ ID NO: 414123 - DNA, 570 bp, Homo sapiens
  misc_feature: GZ8MTXP02IIKV6.3.33.C11.1.454.CMB.2.raw
  modified_base (207)..(207): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggccaaacgcccccaaatcatgatttatgaggtcacaaagccggccctcgacggggtccctgatcgcttctctgccctcaagtctggcaacaccggcctcctcgacccgtctcgtcgggcctccacgcctgacggatggagctagtattattctagcagctcatatgcgagcatacactacgttcgggtttcgaccgggacgggtaaccacggacgtacgacccgtcgtaggtaccacgacccgtaacggcctaccggcccccgttcggaaacctccttccgtcccgttccccaacccgtcccgtcgtacgtcgtccgtcttacgcgg

SEQ ID NO: 414124 - DNA, 553 bp, Homo sapiens
  misc_feature: GZ8MTXP02GN0AS.3.33.C11.1.454.CMB.2.raw
  modified_base (241)..(241): a, c, t, g, unknown or other
  modified_base (444)..(444): a, c, t, g, unknown or other
tcagagacgcactccacgaccggtgctcgatttagagtgagctcgttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnatttataactatgtctcctggtaccagcagcacccaggcaaacgcccccaaatcatgatttatgagtcacaaagcggccctcgaggggtccctgatccgcttctctcgcctccaagtctggcaacgaccgccctcccgtgacccgtctcgtcgggctccacgccctgacggatgaggtctagtatttattactgcagctcatntagcgaggctatacaactacgttcggttttcggacgggtaacggaccgaacgcgtacggacccgttaaccgtacggtaccgacgacccgaacggcctaccggtcccccg

SEQ ID NO: 414125 - DNA, 591 bp, Homo sapiens
  misc_feature: GZ8MTXP02GRI8J.3.33.C11.1.454.CMB.2.raw
  modified_base (227)..(227): a, c, t, g, unknown or other
  modified_base (242)..(242): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgagtcagcctgcctccgtgtctgggtctcctggacagtcgatcaccatctcctgcactggaaccngcagtgacgttgganatataattatgtctcctgtaccaacaactcccaggcaaacgccccaaactgactgatttatgatgtacaaataactcggccctcgtaggggtttctaaatcgtcttctctggctccaagtctggcaaacgacggccctcctgaccatcctctgggctccgagggtgaggacgaggctgtattattactgcagtctctatttacaagtcagccaaccactacgaacgttcctttacgggaaaccttggggtaaaccttaaacggggtcctaacccggttccgtaacgggttaccgaacgaccccgaaaacgggaccccctaaaacccccacgttacgtacccttaacccg

SEQ ID NO: 414126 - DNA, 570 bp, Homo sapiens
  misc_feature: GZ8MTXP02HD8LF.3.33.C11.1.454.CMB.2.raw
  modified_base (243)..(243): a, c, t, g, unknown or other
  modified_base (301)..(301): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactattggtnattataactatgtctctgtacagcagcaccaggacaaacgcccccaatcatgatttangagtcaacaaagccggccctacgacggggtccctagactcccgcttctctcgccttaccaagtctcggacaaaccgaccggccccttcccgcgtacccgtctcgtcggcctccgacgtcccgtagaggatgagctagtattattactgcagtctacatatcgcgaggcatacaacgtacgttcggtttccggacggaacgggaccaacggtccgtacgtacccgtccgtacggtacgacgacccgaacggtccgtacccgtacccccgg

SEQ ID NO: 414127 - DNA, 646 bp, Homo sapiens
  misc_feature: GZ8MTXP02FP5ZK.3.33.C11.1.454.CMB.2.raw
  modified_base (268)..(268): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaacgccccaaactcatgattangaggtcacaaagcgccctcgacgggtccctgactcgtcttctctcgcctcaagtctggcaacgacggcctcctcgaccgtctcgtcgggctccgacgccgtggacgggtagtggacggtcttagtatttaacttacgtcgacgacgtccttactatagtcgacgacggtactaacttaaactacgtttacggtttcggggtacgggacgggaaccggtaacgaccgttacgtaccgttaccggtacgttaccgacgaccgaaccggtacgtcccgtaccccgttcccggtaccgtaccttacccgttccgttaccccgttaacccccgtaacccgttccgtacggttccggtcccggttccgttccgtcggtacgggg

SEQ ID NO: 414128 - DNA, 559 bp, Homo sapiens
  misc_feature: GZ8MTXP02JKAPD.3.33.C11.1.454.CMB.2.raw
  modified_base (207)..(207): a, c, t, g, unknown or other
  modified_base (267)..(267): a, c, t, g, unknown or other
  modified_base (331)..(331): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgccccaaatcatgattangagtcaacaaagccggccctcgacggggtccctgatcgtcttctctgcctccaagtctgcaacncggccctcctcgacccgtctcgtcgggctccagcctgaggatgaggctgattattactgcagctcatatgacgagcatacaactacgttggtttcggacggtacgggaccaagcgtacgtaccgtcgtacggtacacgacccgaacggtcctccgtcccccgtcggtacctacctccgttccgttcccctaacccgtccgtaccgtacgtccgtccgtccgtcgtcgg

SEQ ID NO: 414129 - DNA, 579 bp, Homo sapiens
  misc_feature: GZ8MTXP02I3POQ.3.33.C11.1.454.CMB.2.raw
  modified_base (207)..(207): a, c, t, g, unknown or other
  modified_base (398)..(398): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaagcccccaaactcatgatttatgaggtcacaaagcggccctcaggggtccctgatcgcttctctgcctcaagtctggccaacaccggcctccctgacccgtctcgtcgggctccagcctgaggatgaggtctgattatactgcagctcatntgcaggcatacaactacgttcggttttcgggacgggtacgggaaccgaaacgcgtacgtaccgtacgtaggtaccgacgacccgaacggcctccggtcccccgttcggtacctaccgttccgttccgtttacccccaacccgttcccgtacggtacggtcgtccgttccgtaccgttcggg

SEQ ID NO: 414130 - DNA, 587 bp, Homo sapiens
  misc_feature: GZ8MTXP02II2DC.3.33.C11.1.454.CMB.2.raw
  modified_base (207)..(207): a, c, t, g, unknown or other
  modified_base (232)..(232): a, c, t, g, unknown or other
  modified_base (303)..(303): a, c, t, g, unknown or other
  modified_base (313)..(313): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccngcagccacccaggcaaacgcccccaaatcatgatttatgaggtcaacaaagccggccctcgaggggtcccngatcgcttcnctgcctccaagtctggcaacaccggcctcccgtgacccgtctcgtgggcctccacgcctgagatgacggctagtattattactgacagtctactatagtgacaggcatacaaactacgttcggttttacgggacgggtacgggaaccaacgcgtacgaccgtacgtaggtacgacgacccgaacggtccttccggacccccgttcggtacctaccgttccgttcccgttcccccgtcccgttccgtaccggacgtcggtccgtcgtcgtacggg

SEQ ID NO: 414131 - DNA, 604 bp, Homo sapiens
  misc_feature: GZ8MTXP02GQ43K.3.33.C11.1.454.CMB.2.raw
  modified_base (207)..(207): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaagccccaaatcatgattatgagtcacaaagcggccctcaggggtccctgatcgcttctctgcctccaagtctggcaacaccggcctcctcgaccctctcgtcgggctccagcctgaggatgaggctgtattattactgcagctcatatgacagacatacaactacgttcggttttacggacgggtacggggaaccaacggccgttacggtaacccgttaccgtacggttaccgaaccgaccccgtaaacggtcccttccggtacccccccgttcgggttaccctaccgtttcccgtcccggtttacccccaaccccgttcccttaccggacggttcgcccggttcttaccgtccggg

SEQ ID NO: 414132 - DNA, 587 bp, Homo sapiens
  misc_feature: GZ8MTXP02H6Q9B.3.33.C11.1.454.CMB.2.raw
  modified_base (242)..(242): a, c, t, g, unknown or other
  modified_base (302)..(302): a, c, t, g, unknown or other
tcagagacgcactccacgaccggtgctcgatttagagtgagctcgttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacagttggtnattataactatgtctctggtaccagcagcaccaggacaaacgcccccaaatcatgattangagtcacaaagcgcctgacggggtcctgatccgcttctctcgcctcaacgtctggacaacgaccgtccctcccgtcgtacccgtcctcgtcgggcctccgacgcccgtagacggatggacggtctagtatttacttactcgtacagtctacatagtcgacgaggtacaactacaaactacgttacggttttccgggacggtacggggaacctaaacggccgtacggtacccgttccgttacggtaccgtaccggacccgaacggtccgttacccggtccccccgg

SEQ ID NO: 414133 - DNA, 623 bp, Homo sapiens
  misc_feature: GZ8MTXP02GCTD7.3.33.C11.1.454.CMB.2.raw
  modified_base (207)..(207): a, c, t, g, unknown or other
  modified_base (269)..(269): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggccaaacgccccaaatcatgatttangaggtcacaaagcgccctcgagggtccctgatcgcttctctgcctcaagtctggacaacgaccggcctcctcgacccgtctcgtcggcctccgacgtccgtgacggtatggagctagtatttattactgacagctacatatgacgaggacactaccaaactacgtttcgggttttccgggacgggaacgggaaccaaacggtccgtacggtacccgttacgttacggtaccgaccgacccgtaaacggtcccgtcccggtaccccccgttcgggtaccctaccctttcccgttcccggttaccccctaacccgttcccgtcggtacggttccgtaccgttccgtcgtaccgggg

SEQ ID NO: 414134 - DNA, 520 bp, Homo sapiens
  misc_feature: GZ8MTXP02J3EEZ.3.33.C11.1.454.CMB.2.raw
  modified_base (227)..(227): a, c, t, g, unknown or other
  modified_base (243)..(243): a, c, t, g, unknown or other
  modified_base (248)..(248): a, c, t, g, unknown or other
  modified_base (301)..(301): a, c, t, g, unknown or other
  modified_base (341)..(341): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacattgggtnattanaactatgtctctggtaccagcagcaccaggcaaagccccaaatcatgatttangagtcacaaagcgcctcgaggggtccctgactccgcttcnctcgcctccaagtctggcaacacgcctaccctgacccgtctctcggctccagccctggagatgagggctgattattacgtgcagctcatatgcaggcatacaactacgttgtttcggcggacggacaacgctacggacccgtccgtacggtcacggacccaacggcctaccgtcccccg

SEQ ID NO: 414135 - DNA, 598 bp, Homo sapiens
  misc_feature: GZ8MTXP02JXAQ5.3.33.C11.1.454.CMB.2.raw
  modified_base (206)..(206): a, c, t, g, unknown or other
  modified_base (285)..(285): a, c, t, g, unknown or other
  modified_base (295)..(295): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcaccaggcaaagcccccaaatcatgatttatgaggtcacaaagcgccctnaggggtcccngatcgcttctctgcctcaagtctggcaacacggcctcctgacccgtctcgtgggctccagccctgaggatgagctagattattactgcagctcatatgcagcattacaactacgttggttttcgggacgggacggggaaccaaaggtccgtacggtaacccgtccgttaacgggtaccacgaccccgaaacggggcctccggtccccccgttacgggtcctaacccgtttccgttaacccggttcccccggtccccctcccgtttaccggacggttccgccggtttacctccgttaaccgggg

SEQ ID NO: 414136 - DNA, 597 bp, Homo sapiens
  misc_feature: GZ8MTXP02JT6Z1.3.33.C11.1.454.CMB.2.raw
  modified_base (206)..(206): a, c, t, g, unknown or other
  modified_base (266)..(266): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcaccaggcaaacgccccaaatcatgatttangaggtcaacaaagccggcccctgacggggtccctgatcgcttctctgcctcagtctggcaacacggcctcctcgaccgtctctgggctccagcctgaggatgaggctagtatttacttacgtgtcagctacatacgtgacaggactataccaaactacgttcggttttccgggacgggaacgggggtaacccaaggtccgttacggacccgttccgtacgggtaccacggaccccgaacgggtccgtccggcccccgttcggtacctaccgttcccgttccgtttcccccgcccgttcccgtcggtacgtccggtccgttccgtcgtcggg

SEQ ID NO: 414137 - DNA, 567 bp, Homo sapiens
  misc_feature: GZ8MTXP02FQDPQ.3.33.C11.1.454.CMB.2.raw
  modified_base (241)..(241): a, c, t, g, unknown or other
  modified_base (301)..(301): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggngattataactatgtctctggtacagcagcaccaggacaaacgccccaaactcatgattangagtcacaaagccggcctcgacggggtccctgactccgcttctctcgcctaccaagtccgtggaccaaacgaccgtcctcccgcgtacccgttctcgtcgggcctccgacgtccctggaggactggacgtctgtaatttattacgtgcagtctacatacgtgcgaaggcaactcaaactacgttcggtttcgggacgggtaacggaccaacgtcgtcggtacccgtcgtacggacgaccgacccgtaacggtcctaccgtcccccg

SEQ ID NO: 414138 - DNA, 578 bp, Homo sapiens
  misc_feature: GZ8MTXP02GOBNK.3.33.C11.1.454.CMB.2.raw
  modified_base (206)..(206): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaagcccccaaatcatgatttatgaggtcacaaagccggccctcgaggggtcccctgactcgcttctctcgcctccaagtctggcaaacgaccggcctcctcgacccgtctcgtcgggctccagcctgacggatgaggctgattatactgcagctcatatgcagcatacaaactacgttggtttcggacggacgggaccaagcttacgaccgtcgtaggtacacgacccgaacggccttccgcccccgttcgggtacctacccgttccgttacccggtttcccccgccccgtttccccgttacggacgttccgtccgttccgttacgtccgggg

SEQ ID NO: 414139 - DNA, 559 bp, Homo sapiens
  misc_feature: GZ8MTXP02G74JC.3.33.C11.1.454.CMB.2.raw
  modified_base (207)..(207): a, c, t, g, unknown or other
  modified_base (298)..(298): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctctggtaccagcagcacccaggacaaacgccccaaactcatgattatgaggtcacaaagcggcctcgaggggtcccngatcgcttctctgcctcaagtctggcaacgacggccctcctcgaccgtctctgggctccagcctgacggatgagctgattattactgcagctcatactgcaggacatacaactacgttcggttttccgggacgggacgggaacccaaggcctacggacccgtcgtaacgggtcaacggacccgaaaggtcctccggcccccgtcggtcctaccgttcgtccgttccccgcccttaccgtcgtacgtcgtccgtctcgtcgg

SEQ ID NO: 414140 - DNA, 513 bp, Homo sapiens
  misc_feature: GZ8MTXP02IHH4R.3.33.C11.1.454.CMB.2.raw
  modified_base (207)..(207): a, c, t, g, unknown or other
  modified_base (269)..(269): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaaagcccccaaatcatgatttangagtcacaaagcggccctcaggggtccctgatcgcttctctgcctcaagtctggcaacacgcctcctgaccgtctctggctccagcctgaggatgagggtctgtattattactgcagctcatatgcagcatcaactactgttttcggcgggtaggaccagctgaccgtctagtcacgccaacgctcgcccctcggcctactccttcgtccccaacccgtcctacgtacgtgtccgttctcgtgg

SEQ ID NO: 414141 - DNA, 717 bp, Homo sapiens
  misc_feature: GZ8MTXP02ICN8C.3.33.C11.1.454.CMB.2.raw
  modified_base (226)..(226): a, c, t, g, unknown or other
  modified_base (243)..(243): a, c, t, g, unknown or other
  modified_base (251)..(251): a, c, t, g, unknown or other
  modified_base (306)..(306): a, c, t, g, unknown or other
  modified_base (315)..(315): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggaaccngcagtgactagttggtnaatttaanaactatgtctctgtaccagcagcaccaggacaaacgcccccaaatcatgtattangagtacaanaaagccggcctcgacggggtccctgactccgtcttctctcgcctaccaagtctcggcaaccgaccggtccctcccgtgtacccgtcctcgtcggcctcccacgcccgtaggacggtagttacgggacggtacgttagtaacttttaaactttaaccgtacggttccgaacggttcctaccgtaacttaagttcggaacccgttaagggtaccaacgttaaccctaaaaccgtttaccggtttacggggtttttacccgggggaacggggttaaaccgggggaaaacccgttaaaacggcccggtttaaccgggtaaccccgggtttaacccggttacggggttaacccgaacccgggtaaccccggaaaccgggtcccgttaacccccgggttcccccccgg

SEQ ID NO: 414142 - DNA, 582 bp, Homo sapiens
  misc_feature: GZ8MTXP02IDBZW.3.33.C11.1.454.CMB.2.raw
  modified_base (207)..(207): a, c, t, g, unknown or other
  modified_base (378)..(378): a, c, t, g, unknown or other
  modified_base (398)..(398): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctctggtaccagcagcaccaggcaaacgcccccaaactcatgattatgaggtcaacaaagccggcccctgacggggtccctgatcgcttctctcgcctccaagtctggcaaaccgccggccctcctccgacccgtctcgtgggctccgagcctgaggntgaggtctagtattattacngacagctacattatgacaggcactactaaactacgtttggttttccgggacgggtaacgggaccaagctacggaccgttccgtacggtcacgacccgaacggccgtcccggcccctccggtcctaccgttccgttcccgttcccccgtcccgttccgtacgtcggtcgtccgtcttcgtacggg

SEQ ID NO: 414143 - DNA, 533 bp, Homo sapiens
  misc_feature: GZ8MTXP02IS9MT.3.33.C11.1.454.CMB.2.raw
  modified_base (207)..(207): a, c, t, g, unknown or other
  modified_base (394)..(394): a, c, t, g, unknown or other
  modified_base (497)..(497): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagccacccaggcaaaacgcccccaaaactcatgatttatgaggtcaacaaagccggccctcgaggggtccctgatcgcttctctgcctcaagtctggcaacacggcctcctcgaccgtctctggcctccagccgtgaggatgaggctgtattattactgnagctcatatgacagcatacaaactacgttgtttcggcgggtagggaaccgaacgcgtcgaccgtcgtaggtacacgccctatcggcctcgccccctcggtccnctctccttcccgaccctcctcgacgtcgtcgtctcg

SEQ ID NO: 414144 - DNA, 597 bp, Homo sapiens
  misc_feature: GZ8MTXP02F9DRM.3.33.C11.1.454.CMB.2.raw
  modified_base (207)..(207): a, c, t, g, unknown or other
  modified_base (271)..(271): a, c, t, g, unknown or other
  modified_base (415)..(415): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaaacgccccaaaactcatgatttangaggtacaacaaagccggcccctcgacggggtccctgatcgcttctctgcctccaagtctggacaaacacggcctcccgtgacccgtctcgtcgggctccgacgcctgacggatgacggtctagtattatacgtgacagtctanatagtgacgagacaatacaaactacgtttcggtttacgggacgggacgggaaacgaacgccgtacggtacccgttacgtacggtaccgaccgaccgaacggtccgtcccgtcccccgtaggtaccctaccgttcctcccgtttaccccaacccgttccgtacgacgtcgcctccgtcgcggg

SEQ ID NO: 414145 - DNA, 531 bp, Homo sapiens
  misc_feature: GZ8MTXP02JB67I.3.33.C11.1.454.CMB.2.raw
  modified_base (207)..(207): a, c, t, g, unknown or other
  modified_base (357)..(357): a, c, t, g, unknown or other
  modified_base (381)..(381): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacatttggtnattataactatgtctcctggtaccagcagcaccaggcaaacgccccaaatcatgattatgagtcacaagcgcctgagggtcctgatcgcttctctgcctcagtctggcaacacggcctcctgacccgtctcgtggcctccagcctgaggntgagctagattattactgcagctnatatgcgagacatacaactacgttggtttcggacgggacggtaccagcgtcgaccgtcgtaggtcgacgcccaacggcctcgcccccgtcggtacctacctccgtccgttaccccaacccgttccgtcgtacgtcgtccgttctcgtcgg

SEQ ID NO: 414146 - DNA, 561 bp, Homo sapiens
  misc_feature: GZ8MTXP02GFP2S.3.33.C11.1.454.CMB.2.raw
  modified_base (226)..(226): a, c, t, g, unknown or other
  modified_base (244)..(244): a, c, t, g, unknown or other
  modified_base (306)..(306): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggaaccngcagtgactagttggtanatttataactatgtctcctggtaccagcagccaccaggcaaacgccccaaatcatgatttangagtcacaaagcgcctcgacgggtcctgactccgcttctctcgcctccaagtcctggacaaccgacgccctccgtcgacccgtctcgtcggctccgagccctgacgagtggaggctagtaattagttaactggcagtctacattacgtagcgacggcactacaaactacgtttcggtttacggacgggtaagggaaccacgtactacggtacccgtcgtacggtcaccgcccgtaacgtccgtacccgtcccccg

SEQ ID NO: 414147 - DNA, 605 bp, Homo sapiens
  misc_feature: GZ8MTXP02G491Y.3.33.C11.1.454.CMB.2.raw
  modified_base (208)..(208): a, c, t, g, unknown or other
  modified_base (270)..(270): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagccctccctccgcgtccgggtctcctggacagtcagtcaccatctcctgcactggaaccagcagtgacattggtnattataactatgtctcctggtaccagcagcacccaggcaaacgcccccaaatcatgatttangaggtcacaaagccggccctcgacggggtccctgactcgcttctctgcctccaagtctggcaacaccggcctcctcgacccgtctcgtcgggctccagcctggaggatgagctgtatttattactgctagctcatatgacaggctactacaaactacgtttcggtttacggggacgggtacggggaacccaaggtccgtacggacccgttccgtacggtaccgacggtaccccgaacgggtccctcccggtccccccgttcggtaccctaccgttcccgttccgtttacccccaacccgttcccgtacggacgttcgtccgttccgtcgtacggg

SEQ ID NO: 414148 - DNA, 560 bp, Homo sapiens
  misc_feature: GZ8MTXP02IZB40.3.33.C11.1.454.CMB.2.raw
  modified_base (225)..(225): a, c, t, g, unknown or other
  modified_base (240)..(240): a, c, t, g, unknown or other
  modified_base (299)..(299): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcacatctcctgcactggaaccngcagtgacattggtnattataactatgtctctggtaccagcagcaccaggcaaacgccccaaatcatgatttangagtcacaaacgcgcctcgacgggtccctgactccgtctctctcgcctcaagtctgacaacaccgcctaccgtcgtaccctcgtcgtcggcctccgacgcctgacggtatcggacgactgtatttacttactgtcagtctacaagtatcggacaaggctaatactaaactacgtttcggtttacgggacgggtaacggtaaccgacgtaccgtcgtacccgttcgtacggtacacgacccgaaggtccgtaccgtcccccg

SEQ ID NO: 414149 - DNA, 599 bp, Homo sapiens
  misc_feature: GZ8MTXP02HTRVL.3.33.C11.1.454.CMB.2.raw
  modified_base (207)..(207): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgccccaaatcatgattatgaggtcaacaaacgcggccctcgaggggtccctgatcgcttctctgcctcaagtctggcaacaccggcctccctcgaccgtctcgtcggctccagcctgacgatgaggctagtattattactgcagctacatatgacaggacatacaaactacgtttcggttttacgggacgggtaagggaacccgaaagtcgtaccggtaacccgttccgtaacgggtaccgaacggacccgtaaacggcccgttacccggccccccgttcggttacctacccgttccgtcccgttccccggcccttccgtaccggtacgtcggtccgtccgttcgtcggg

SEQ ID NO: 414150 - DNA, 554 bp, Homo sapiens
  misc_feature: GZ8MTXP02HAKOR.3.33.C11.1.454.CMB.2.raw
  modified_base (206)..(206): a, c, t, g, unknown or other
  modified_base (311)..(311): a, c, t, g, unknown or other
  modified_base (331)..(331): a, c, t, g, unknown or other
  modified_base (392)..(392): a, c, t, g, unknown or other
  modified_base (398)..(398): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggccaaagcccccaaatcatgatttatgaggtcaacaaagccggccctcgaggggtccctgatcgcttcnctgcctcaagtctggcaacnccggcctcctcgaccgtctctcggctccagcctgaggatgagctgattatacgtgcagctnatagtncgaggacattacaaactcgttgtttcggacggagggaacagctagaccgtctaggtcacgcccgaaggccttccgcccccgttcgggtcctaaccgttcctccggtttacccccctaacccgttccgtcggtacgttcgtccttccgtacggtcgg

SEQ ID NO: 414151 - DNA, 575 bp, Homo sapiens
  misc_feature: GZ8MTXP02F4U08.3.33.C11.1.454.CMB.2.raw
  modified_base (207)..(207): a, c, t, g, unknown or other
  modified_base (267)..(267): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgccccaaatcatgattangagtcacaaagcggcctcgacgggtccctgactcgcttctctcgcctccaagtctggacaacgaccggcctccctcgacccgtctcgtcgggcctccgagcctgaggatgaggctgtatttattactgcagtctcatatgcagcatacaaactacgttggtttacgggacggtacgggaccaagtccgtacggtacccgtacgtacggtacacgtacccgaaacggtccgtccggtcccccgttcggtacctaccgttccgttcccgttccccaacccgtcccgtcgtacgtcgtccgtctcgtacgg

SEQ ID NO: 414152 - DNA, 607 bp, Homo sapiens
  misc_feature: GZ8MTXP02G8VBJ.3.33.C11.1.454.CMB.2.raw
  modified_base (242)..(242): a, c, t, g, unknown or other
  modified_base (303)..(303): a, c, t, g, unknown or other
  modified_base (329)..(329): a, c, t, g, unknown or other
  modified_base (376)..(376): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcaccaggacaaacgcccccaaatcatgattangagtcacaaagcgcctcgagggtccngactccgcttctctcgcctccaagtcgtgcaaacgaccgccctcccngtacccgtctcgtcgggcctccgacgtcccgtaggacgggtacgtacggaacgggtctaggttaatttacttaactcggtacgacgtctactaatagttcgaccgaggctaatacctaaacgtaacgttcggttttaccgggacgggtaacgggaaccgaaacggtccgtacggtacccgttccgtaacggtaccaacggaccccgaaacggtccgtacccggtcccccgg

SEQ ID NO: 414153 - DNA, 586 bp, Homo sapiens
  misc_feature: GZ8MTXP02FXKTC.3.33.C11.1.454.CMB.2.raw
  modified_base (207)..(207): a, c, t, g, unknown or other
  modified_base (269)..(269): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgcccccaaatcatgatttangaggtcacaaagcggccctcgaggggtcccctgatcgcttctctgcctcagtctggcaacacggcctcctcgaccgtctcgtcgggctccagcctggaggatgaggctacgatttattactgcacgctcatatgacgaggacatacaaactacgttactttcgggggggggggactacggggaacctaacgcgtacgtacccgtaccgttacgacgacgacccgaacggccgtccgtcccccgtccggtacctaccttccgttccgttcccccgtccccgttcccgtccggtacgtcgtcgttccgtcgttaccggg

SEQ ID NO: 414154 - DNA, 601 bp, Homo sapiens
  misc_feature: GZ8MTXP02IKVIE.3.33.C11.1.454.CMB.2.raw
  modified_base (227)..(227): a, c, t, g, unknown or other
  modified_base (243)..(243): a, c, t, g, unknown or other
  modified_base (306)..(306): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgactattggtnattataactatgtctcctggtaccagcagcacccaggacaaacgacccccaaatcatgattangagtcaacaaagccggcctacgacggggtccctgactcccgcttctctcgcctccaagtctggacaacgaccgccctcccgtcgtacccgtctcgtcgggcctccgacgcccgtagacggatggaacggtctagtatttattacgtgcacgtctacatatgactaggactactacaaactacgtttcggtttccggggacgaaacgggtaaccaacggtccgttacggtacccggttaaccgttaacggtaccgtaaccggacccgtaaccggtccgttaccccggtccccccgg

SEQ ID NO: 414155 - DNA, 590 bp, Homo sapiens
  misc_feature: GZ8MTXP02G76I0.3.33.C11.1.454.CMB.2.raw
  modified_base (243)..(243): a, c, t, g, unknown or other
  modified_base (266)..(266): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacagttggtnattataactatgtctctgtaccngcagcaccaggaccaaacgcccccaaatcatgtaatttatggagtacaacgaaacgccggcctcgacggggtccctggatccgcttctctcgccctcaacgtctcggacaaccgaccgccctcccgtcgtacccgtcgtccgtcgggcctccgacgtcccgtaggacggtatcggacggtctaggttaactttaactttacgcgtacacgtctactaaatgtgacgagctatacgaactcgttaggtttcgggacggtacggaccacgtccgtacggtacccgtcgtacggtacgacgacccgacggtccgtacccgtcccccg

SEQ ID NO: 414156 - DNA, 643 bp, Homo sapiens
  misc_feature: GZ8MTXP02H3SNK.3.33.C11.1.454.CMB.2.raw
  modified_base (226)..(226): a, c, t, g, unknown or other
  modified_base (313)..(313): a, c, t, g, unknown or other
  modified_base (344)..(344): a, c, t, g, unknown or other
tcagagacgcactccacgaccggtgctcgatttagagtgagctcgttggggtttgggggggtctcaggaggcagcgctctcaggacgtcaccaccatggcctgggctctgctcctcctcacccctcctcactcagggcacagggtcctgggcccagtctgccctgactcagccctccctcgcgtccggtctcctggacagtcagtcaccatctctgcatggaaccngcagtgactagtttggtataatttataactattcgtctccgtggtaccagcagccaccaggaccaaacgccccaaatcatgtattangagtacaacaacgccgcctcgacgggtcccngactccgtcttcctcgtcgtccctaccgtaagttcgtcgaccaaccgaccggtccctccgtcgtacccgtctcgtcggcctccgacgcccgtaggacggagtcggaacggtcgttagtaaacttttacttaaccgttggacctaacgtctaccgtaattacgtcgacgaacggtactaacgtacctaaccgtacgtttcgggttttaccgggacgggtaaaccggtaaccgtaacgccgttacggacccgttaacgtacggtaccgacgtacccgaaccggtccgtacccggtcccccg

SEQ ID NO: 414157 - DNA, 661 bp, Homo sapiens
  misc_feature: GZ8MTXP02JRBIR.3.33.C11.1.454.CMB.2.raw
  modified_base (206)..(206): a, c, t, g, unknown or other
  modified_base (266)..(266): a, c, t, g, unknown or other
  modified_base (306)..(306): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctctgtaccagcagcaccaggacaaacgcccccaaatcatgtattangagtacaacaagccgcctgacgggtcctgactcgcttctntcgcctacaagtcgtggacaacgaccggtcctccgtccgaccgtctcgtcggcctcgacgtccgtaggaggtatggacggtctaggtaatttaacgttacgtcggacacgtcctctaattacgtacggacgaggacctaacttaccaaacgttaacgtttacgggttttcggggaacgggtaacggggaaaccgtaaacgtccgtaaccggtacccgttacggttaacggtaccgaaccgaccccgtaaacggtcccgtccccggtaccccgttccggtaccgtacccttccgttcccgttaccccctaacccgttcccgtaaccgtacggtccgtccggtttcctacgtccggg

SEQ ID NO: 414158 - DNA, 583 bp, Homo sapiens
  misc_feature: GZ8MTXP02I2PBN.3.33.C11.1.454.CMB.2.raw
  modified_base (227)..(227): a, c, t, g, unknown or other
  modified_base (243)..(243): a, c, t, g, unknown or other
  modified_base (304)..(304): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgactattggtnattaataactatgtctctgtaccagcagcaccaggacaaacgccccaaactcatgatttangagtcaacaaacgccggccctcgacggggtcccctgactccgtcttctctcgcctaccaagtcgtgccaacaccggccctcccgtgtaccctctcgtcggcctccagtcccgtagaggatggagtctagtactttaagttactgctagtctacaatctagactaggaccataccaaaaccgttacgtttcgggtttaccggacgggtaaacgggaaccaacgtaccgtccgtaccgtccgttacggacgaccgaccgaacggtcctacccgtcccccgg

SEQ ID NO: 414159 - DNA, 573 bp, Homo sapiens
  misc_feature: GZ8MTXP02FSH0U.3.33.C11.1.454.CMB.2.raw
  modified_base (207)..(207): a, c, t, g, unknown or other
  modified_base (268)..(268): a, c, t, g, unknown or other
  modified_base (330)..(330): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgccccaaatcatgatttangaggtcacaaagccggccctcgaggggtccctgatcgcttctctgcctcaagtctggcaacncgcctcctgaccgtctcgtggcctccagcctgacggatgagtctgtatttattactgcagctcatatgacaggcactacaaactacgtttcggtttacgggacgggaacggggaaccaaaggtccgtacggtacccgttaccgtaggtaccgacgaccccgaaacggtcccgtccgcccccgtcggtcctaccgttcctccgttacccccaacccttccgtacgacgtcgtcgtcctcgtcgg

SEQ ID NO: 414160 - DNA, 648 bp, Homo sapiens
  misc_feature: GZ8MTXP02JOGOU.3.33.C11.1.454.CMB.2.raw
  modified_base (243)..(243): a, c, t, g, unknown or other
  modified_base (309)..(309): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactattggtnaattaataactatgtctctggtaccagcagccaaccaggacaaacgcccccaaatcatgtatttangagtcaacgaaagccgacctcgacggggtccctagactccgtcttctctcgcctaccaagtcgtacggaccaaacgaccggtcctcccgtcgtacccgtcttcgtcggtcctaccgagtcccgtagacggtatacggagtcgtagtaaatttattaacgtgacacgtactactaataagtcggacaggactaactactaaaacgttcgtttacgggtttaaccgggaccggggaaacggaaccgtaaacggtaccgtaccgggttaaacccgtaaccggtttaaaccggtaccgtaccggaaccccgaaacggttccccggtaccccgttaccccccgg

SEQ ID NO: 414161 - DNA, 593 bp, Homo sapiens
  misc_feature: GZ8MTXP02IPDHB.3.33.C11.1.454.CMB.2.raw
  modified_base (243)..(243): a, c, t, g, unknown or other
  modified_base (248)..(248): a, c, t, g, unknown or other
  modified_base (307)..(307): a, c, t, g, unknown or other
  modified_base (340)..(340): a, c, t, g, unknown or other
  modified_base (374)..(374): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactattggtnattanaactatgtctcctgtaccagcagccaccaggaccaaaacgcccccaaatcatgatttangagtcaacaaagccggcctacgacggggtcccngactccgcttctctgcctacaatctgacaaaccnccggccctcctcgaccctctcgtcggcctccacgccgtagaggagtgaggtacgtagtaatttacttaacgtcgtacgagtctacaagttactcgacgacggtacaacttacaaaaccttacgtttacggttttaccgggaccggtaaacgggacctaaacgccgttacgacccgtaacgtacgtaccgaccgaccgaacggtcctacccggtcccccg

SEQ ID NO: 414162 - DNA, 543 bp, Homo sapiens
  misc_feature: GZ8MTXP02H6ASH.3.33.C11.1.454.CMB.2.raw
  modified_base (207)..(207): a, c, t, g, unknown or other
  modified_base (295)..(295): a, c, t, g, unknown or other
  modified_base (349)..(349): a, c, t, g, unknown or other
  modified_base (383)..(383): a, c, t, g, unknown or other
  modified_base (386)..(386): a, c, t, g, unknown or other
  modified_base (388)..(388): a, c, t, g, unknown or other
  modified_base (392)..(392): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctctggtaccagcagcaccaggcaaagcccccaaatcatgattatgaggtcaacaaagcgccctcaggggtcccngatcgcttctctgcctccaagtctggacaaacacggcctcctcgaccgtctcgngggctccagcctggagatgaggctgatattacgncancnatangcgagcatacaactacgttggttcggacgggacggaacgagcgtacgaccgtacgtacgacgacgaccgtacggccgtcccgcccgtcgtacctaccgttccgttcccgttccccgtcccgtccgtacggtacgtcgtccgtcgtcgtcgg

SEQ ID NO: 414163 - DNA, 618 bp, Homo sapiens
  misc_feature: GZ8MTXP02GCURY.3.33.C11.1.454.CMB.2.raw
  modified_base (225)..(225): a, c, t, g, unknown or other
  modified_base (241)..(241): a, c, t, g, unknown or other
  modified_base (263)..(263): a, c, t, g, unknown or other
  modified_base (299)..(299): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctctgcactggaaccngcagtgactattggtnattataactatgtctcgtgacngcagccaccagacaaccgaccccaatcatgtattangacgtacaacgaacgccgccgtcggtacgggtccagtactcccgtcttctcgtcgtcctacgtaacgtcgtacgacaaccgacccgtccctccgtacgtacccgtcgtcgtcggacctccgacgtccgtaggacggtagtacggacgtcgttacgtaactttacgttacgtcgtacgtacgtctactaagttacgtcgacgtacgtacctacgtaacgtaaccgttacggtttacgggtttaccgggacgggtaaccggaacgtacgtccgtaccggtaccgtcgtacgacgaccgaccgtacgtccgtcccgtccccg

SEQ ID NO: 414164 - DNA, 632 bp, Homo sapiens
  misc_feature: GZ8MTXP02GM15M.3.33.C11.1.454.CMB.2.raw
  modified_base (207)..(207): a, c, t, g, unknown or other
  modified_base (267)..(267): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcaccaggcaaacgccccaaatcatgatttangaggtcacaaagcggcctcgacgggtcctgatcgcttctctgcctcaagtctgcaacacggcctcctgacccgtctcgtcgggcctccgagccctggaacggtagtggaggtctaggtactttaattactgactagtctacgatagttcgaccgaggacctaactactaaacctacgtttacgggtttttaccggggacgggtaacgggggaacccaacggtaccgtacggtacccggttaccgtaacggtaccgaacgtaccccgaaacggtccgttacccgcccccgttcgggtacctaccgttcctttccggttaccccctaaccccgttcctaccggtacgtcgtccgttacgtcgtcggg

SEQ ID NO: 414165 - DNA, 524 bp, Homo sapiens
  misc_feature: GZ8MTXP02F7764.3.33.C11.1.454.CMB.2.raw
  modified_base (207)..(207): a, c, t, g, unknown or other
  modified_base (269)..(269): a, c, t, g, unknown or other
  modified_base (288)..(288): a, c, t, g, unknown or other
  modified_base (366)..(366): a, c, t, g, unknown or other
  modified_base (418)..(418): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgccccaaactcatgatttangaggtcacaaagcgccctnaggggtccctgatcgcttctctgcctccaagtctggcaacacggcctccctgaccgtctctgggctccagcctgaggntgagctgacttatactgcagctacatatgcaggcatcaaactatgtttcggnggtagggaccaagctagaccgtccgtagtcacgacccgaaagcctcgcccccttcggtccaccttcgtccgttcccgtcccgtcctcgacgtcgtcgtctcgtcgg

SEQ ID NO: 414166 - DNA, 638 bp, Homo sapiens
  misc_feature: GZ8MTXP02FYORQ.3.33.C11.1.454.CMB.2.raw
  modified_base (207)..(207): a, c, t, g, unknown or other
  modified_base (269)..(269): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgactattggnattataactatgtctcctggtaccagcagccaccaggacaaacgccccaaatcatgatttangaggtcaacaaagccgcctcgacgggtccctgactcgcttctctcgccctacgaagtctggaccaaccgaccggtccctccgtcgtacccgtctcgtcggcctaccgacgccgtaggaacggtacgttaggacgggtacttaggttaaacttttaacgttacgttacggacaagtcctactaatagtcgacgacgactactaacctaaacttacgtttcgggtttacgggacgggaacgggaaccaacggtccgtacggacccgttcgtacggtacgacgacccgacggtcccgtccgtccccgtacggtcctaccgttccgtccgttaccccaaccgttccgacgtacggtcgtccgtctcgtacggg

SEQ ID NO: 414167 - DNA, 519 bp, Homo sapiens
  misc_feature: GZ8MTXP02JUNK1.3.33.C11.1.454.CMB.2.raw
  modified_base (240)..(240): a, c, t, g, unknown or other
  modified_base (300)..(300): a, c, t, g, unknown or other
  modified_base (317)..(317): a, c, t, g, unknown or other
  modified_base (327)..(327): a, c, t, g, unknown or other
tcagagacgcactccacgaccggtgctcgatttagagtgagctcgttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaagcccccaaatcatgattangagtcacaaagcgcctnaggggtcccngatccgcttctctcgcctccgaagtctggacaaacacggcctcccgtgacccgtctcgtgggctccagcctgaggatgaggctgattattactgcagctacatatgacaggcatacaactacttggtttcggcggacgggacctaacgcgtacgacccggtctacggtcacgacccaaggccgtcgcccccg

SEQ ID NO: 414168 - DNA, 595 bp, Homo sapiens
  misc_feature: GZ8MTXP02GS9G5.3.33.C11.1.454.CMB.2.raw
  modified_base (230)..(230): a, c, t, g, unknown or other
  modified_base (370)..(370): a, c, t, g, unknown or other
  modified_base (373)..(373): a, c, t, g, unknown or other
  modified_base (392)..(392): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctctggtacngcagcacccaggcaaacgcccccaaatcatgatttatgagtcaacaaagccggccctcgacggggtccctgatcgcttctctgcctccagtctgcaacacggccctcctcgaccgtctcgtcggggcctccagcctgagntgngctgattatactgcagctnatatgcaggcattacaaactacgttcggttttccgggacgggtaacgggaaccgaacggtccgtacggtaacccgttaccgttacgggtaccgtacggaccccggtaaacgggccgttcccggtccccccgttccgggtacctaccgttccgtccgtttcccccaacccttcccgtacgtcggtcgtccgtccgttcgtcggg

SEQ ID NO: 414169 - DNA, 550 bp, Homo sapiens
  misc_feature: GZ8MTXP02GTDUS.3.33.C11.1.454.CMB.2.raw
  modified_base (207)..(207): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctctggtaccagcagcaccaggcaaagccccaaatcatgattatgagtcacaagcgccctgagggtccctgatcgcttctctgcctcaagtctggcaacgaccggccctcctcgacccgtctctcgggctccagcctggaggactggagcttagtattattactgcagtctctatagtagcgaggacataccaaactacgttcggtttacgggcgggtaacgggaccaacgccgtacgtaccgttcgtaggtcacggacccgaacggcctccgccccgtcggtacctacgtcctccgttcccgccctccgtcgcgtcgcgtcgtcgtcgg

SEQ ID NO: 414170 - DNA, 635 bp, Homo sapiens
  misc_feature: GZ8MTXP02FLINI.3.33.C11.1.454.CMB.2.raw
  modified_base (242)..(242): a, c, t, g, unknown or other
  modified_base (378)..(378): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacagttggnaattataactatgtctcctggtaccagcagccacccaggacaaacgacccccaaactcatgtatttatgaggtacaacaaagccggccctcgacggggtccctagactcccgtcttctctcgccctaccaagttcncggacaacgaccggccctcccgtacgtacccgttcctcgtcgggccctaccgacgtcccgtaggacggtagtcggacggtcgtagttaatttaacttacgtcggacacgtctactaatagtgacgacggactacgtactaaacgtacgtttcggtttccgggacgggtaacggggaaccgaaacggtccgtacggtaacccgttaaccgtaacggtaccgaccggacccgaacggtcccgttacccggtaccccccg

SEQ ID NO: 414171 - DNA, 571 bp, Homo sapiens
  misc_feature: GZ8MTXP02HQCPJ.3.33.C11.1.454.CMB.2.raw
  modified_base (207)..(207): a, c, t, g, unknown or other
  modified_base (373)..(373): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgcccccaaatcatgatttatgaggtcacaaagccggcccctcgacggggtccctgatcgtcttctctgcctccaagtctggcaacaccggcctcctcgaccgtctctcggctccagcctggagntgagctgtattatactgcagctcatatgcagacactactaaactacgtttcggttttacgggacgggacgggaaccgaaagtccgtacggaccgtccgtaggtaccgacgacccgaacggtcccgtccggtcccccgttcggtacctacctccgttccgttccccgcccctccgtccgtacgtcgtcctcgtcgtcgg

SEQ ID NO: 414172 - DNA, 593 bp, Homo sapiens
  misc_feature: GZ8MTXP02FLEZR.3.33.C11.1.454.CMB.2.raw
  modified_base (228)..(228): a, c, t, g, unknown or other
  modified_base (267)..(267): a, c, t, g, unknown or other
  modified_base (407)..(407): a, c, t, g, unknown or other
  modified_base (430)..(430): a, c, t, g, unknown or other
tcagagacgcactccacgaccggtgctcgatttagagtgagctcgttggggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccngcagtgacattggtatataactatgtctctgtacagcancacccagacaaaccgaccccaaacctcatagtatttatgtagtacacaaagaccggccctacgtacgggtccgtgatcgcccttctctcgcctccaagtacgtcggcaaacgaccggtccctccccgtgacccgtctcgnggtccgtcccagcctgaggatgnggtctagtagtttaattaccgtgcgaactcgtactaatagttgacgacgacactaactaaccgaacgtttcgggttttcggaccgggggaacggtaaccaacgtacgtcgtacccggtaccttaacgggcaaacggcccgaacgtccgtccgccccctacggg

SEQ ID NO: 414173 - DNA, 562 bp, Homo sapiens
  misc_feature: GZ8MTXP02I5FPV.3.33.C11.1.454.CMB.2.raw
  modified_base (242)..(242): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctctggtaccagcagcaccaggcaaacgcccccaaactcatgattatgagtcacaaagcggcctgacggggtccctgactccgcttctctcgcctccaagtctggcaaacgaccgccctccctgacccgtctccgtcgggcctccgagcccgtaggaggatggacggctagtattattactgcagtctacatatgacaggcatcaaactacgttggtttccgggacgggtaacgggaaccacggtaccgtacggaacccgttccgtaacgggtacaccggtacccgaacggtcctaccggtcccccg

SEQ ID NO: 414174 - DNA, 674 bp, Homo sapiens
  misc_feature: GZ8MTXP02HLX4X.3.33.C11.1.454.CMB.2.raw
  modified_base (326)..(326): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaaccagcagtgactagtttgggtataatttaataacttattcgtccttccgtggtaaccagcagccaacccgaggaccaaacgcccccaaactcatgatttatgaggtacaacaaacgccggccctcgacggggtcccngactcgtcttctctcgtcctccgtaagtcgtcggaccaaaccgaccggtcccctccgtaccgacccgttctcgtcgggctcccgacgtccgttaggacgtagttacggacgggtctagttaactttacgttactcggacacgtctactatagtcgacgtacgggactaactaccgtaaacttcgtttacgggttttacgggacgggtaacgggaacacggtacgtacgtacccgtcgtacggtaccgacgacccgtaacggccgtacccgtccccgtacgtccgtccgttccgttccccgttccccgtcccgttccgtacggtacggtcgtccgttcgtcgtccgggg

SEQ ID NO: 414175 - DNA, 320 bp, Homo sapiens
  misc_feature: GZ8MTXP02HMAHV.3.33.C11.1.454.CMB.2.raw
  modified_base (316)..(320): a, c, t, g, unknown or other
tcagagacgcactccacgaccggtgctcgatttagagtgagctcgttgggtttggggaggtcacaaagcggccctcaggggtccctgatcgcttctctgcctccaagtctggcaacacggcctccctgaccgtctctgggctccagcctgaggatgaggctgattattactgcagctcatatgcaggcatcaacacttgttttcggcggagggaccaagctgaccgtcctaggtcagcccaaggctcgcccctcggtcactctcgttccccaccctcctcgagtgcgtctctgagcgggctggcaaggcgcatagnnnnn

SEQ ID NO: 414176 - DNA, 575 bp, Homo sapiens
  misc_feature: GZ8MTXP02IPB8B.3.33.C11.1.454.CMB.2.raw
  modified_base (206)..(206): a, c, t, g, unknown or other
  modified_base (270)..(270): a, c, t, g, unknown or other
  modified_base (437)..(437): a, c, t, g, unknown or other
  modified_base (569)..(569): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggccaaacgcccccaaactcatgtattangaggtcaacaaacgccgccctcgacgggtccctgactcgtcttctctcgtccaccgtaagtccttacggccaaaccgaccggtcccctcccgtccgtaccccgttctcgttcgggcctccgagcctggacggtactgagcttgtactttattactgcagctcaaatntcgacgagacatacactacgttgttacggcggtaggaccagtcgtcgaccgtctaggtccagacccgaaggccctccgccccgtcggacctccgttcgtcccgtcccgccctaccgtcgcgttcgccgttcncgtcgg

SEQ ID NO: 414177 - DNA, 598 bp, Homo sapiens
  misc_feature: GZ8MTXP02F6Y4G.3.33.C11.1.454.CMB.2.raw
  modified_base (242)..(242): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctctgtacagcagcaccaggacaaacgccccaaactcatgtattatgagtcaacaagcgtccctcgacggggtcctgactccgcttctctcgcctaccaagtcgtcgacaacgaccgcctccctcgacccgtctcgtcggcctccgacgccgtagaggtacgtaggacggtactagtaatttacttaacgtgcgtagtcttacatagtcgacacggcaactactaaacgtaccgttcggttttaccgggacgggtaacgggtaaccgaacggtaccgtacggtacccggtccgtttacggtaccgaccgaccccgaacgggtcccgtaccggttcccccccgg

SEQ ID NO: 414178 - DNA, 717 bp, Homo sapiens
  misc_feature: GZ8MTXP02JMQPI.3.33.C11.1.454.CMB.2.raw
  modified_base (228)..(228): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggaaccngcagtgactagttggtatattataactattgtctcctggtaccagcagccacccaggacaaacgacccccaaactcatcgtatttatgaggtcaacgaaacgccggccctcggacggggtccctgactcccgtcttcctctcgcctaccaagtcgtcggacaacgacccggtcctcccgtcgtacccgtcctcgtcgggtcctccgacgtcccgtaggacgggtagtacgggacgggtaccgttaggttaaactttaacgtttaaccgtcggtaccgtacgtaccgttacctaagttaacgttcggacgaacgggtacctaacgtacctaaaaccgtttccggttttacgggggttttacccggggaaaccgggggtaaccggggtaaccgtaaccgggtaccgttaaccgggtaccccggttaaccggtaacgggttaacccgaccggaaccccggtaaccggtccccgtaccccggttaccccccgg

SEQ ID NO: 414179 - DNA, 570 bp, Homo sapiens
  misc_feature: GZ8MTXP02IWNRI.3.33.C11.1.454.CMB.2.raw
  modified_base (207)..(207): a, c, t, g, unknown or other
  modified_base (267)..(267): a, c, t, g, unknown or other
  modified_base (407)..(407): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctctggtaccagcagcacccaggcaaacgcccccaaatcatgattangagtcaacaagccggccctcgacggggtccctgatcgcttctctcgcctccaagtctcggacaacaccggtccctccctcgacccgtctcgtcggcctccgagccgtgaggatggaggtctagtaatttatacgtgctanctcatatgcgagctatacaactacgttcggtttcgggacgggtacgggaacaacgcgtacggaccgtcgtacggacacgaccgtaacggcctccgtccccgttcggtacctacctcctcccgttcccctaacccgtccgtcgtcgtcgtccgtccgttcgcgg

SEQ ID NO: 414180 - DNA, 655 bp, Homo sapiens
  misc_feature: GZ8MTXP02G1H1K.3.33.C11.1.454.CMB.2.raw
  modified_base (235)..(235): a, c, t, g, unknown or other
  modified_base (513)..(513): a, c, t, g, unknown or other
tcagagacgcactccacgaccggtgctcgatttagagtgagctcggttggggtttggggggggtctcaggaggcagcgctctcaggacgtcaccaccatggcctgggctctgctcctcctccaccctcctcactcagggcacagggtcctgggcccagtctgccctgactcagccctccctccgccgtccggtctcctggacagtcagtcaccatcctcctgcacgtcggaaccngcagtgaactagttggtataatttaataacttattcgtcctccgtaggtaccagaccacgacccaacccgaaggaaccaaaaccgaccccccaaaatcaagtagtaatttataggtacgtacaacgaaaacgccggacctcggacgggtccctagactcccgtcttactcgtcgcctacgaagttcgacggactaaccgacccgtccctaccgacgtacccgtctcgtcggtcctccgacgtccgaggaggtaacgtggacgtcgtattattaacttnacgagactctatataggagacgacgtactacgtacaacgttacggttacggttacgggacgggaacggaacgtacgtaccgtaccgtaccgtaaccggtaacggtaccgaccgtaccgtaccggtcccgtacccgtaccccg

SEQ ID NO: 414181 - DNA, 688 bp, Homo sapiens
  misc_feature: GZ8MTXP02INU5V.3.33.C11.1.454.CMB.2.raw
  modified_base (296)..(296): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagccctccctccgcgtccgggtctcctggacagtcagtcaccatctcctgcactggaaccagcagtgactagtttggtagtaatttaataaacttattgttaccttccgtaggtaacccagcaagcccaacccgaggaccaaaacgcccccaaatcatgtattangagtcaacaagccgcctcgacgggtccctgatccgtcttctccgtcgtcctaccgtaagttccgtacggaccaaaccgaccggtccccttccccgtccgtaccccgttcctccggtcgggtcccttacccgacgtcccgttagggaacggtaagttcgggaacgggtcttagttaactttacttacgtcgactacgtctacgtatagtgacgtagactactactaacgtacgtttggtttcggacggtacggaccagtcgtacgtaccgtcgtacgtacgacgaccgtacggtcccgtaccgtcccccgtacggtaccctccgttcccgttcccgttacccccgtaaccccgttccgtacggttacggtccgtccgttccgttacggtccgg

SEQ ID NO: 414182 - DNA, 647 bp, Homo sapiens
  misc_feature: GZ8MTXP02FSTV5.3.33.C11.1.454.CMB.2.raw
  modified_base (242)..(242): a, c, t, g, unknown or other
  modified_base (308)..(308): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccgaggaccaaacgccccaaatcatagtatttangaggtcaacaaacgccggacctcgacggggtccctgactccgtcttctctcgcctacgaacgtctacggactaacgaccggtcctacccgtgacccgttctcgtcggcctcgacgtccgtgacggatcggagtcgtagtatttactacgtgaccgtagtactactaattacgtacgacgtacggactaacgttaactaaaaccgttcgtttacgggttttaccggggaccgggtaaacggggtaaccctaaacggtcccgtaccggtaacccggttaaccgttaacgggtaccgtacccggtaccccggaacggtacccgttaccccgtaccccccggg

SEQ ID NO: 414183 - DNA, 590 bp, Homo sapiens
  misc_feature: GZ8MTXP02J1WFM.3.33.C11.1.454.CMB.2.raw
  modified_base (242)..(242): a, c, t, g, unknown or other
  modified_base (306)..(306): a, c, t, g, unknown or other
  modified_base (438)..(438): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggccaaacgcccccaaatcatgtatttangagtcacaaagcgccctgacggggtccctgactccgcttctctgcctccaagtctggaccaaccacggtccctcccgtgacccgtctcgtcggcctccgagccctgaggatgacggctagtattattaccgngacagtctactatagtacgacgacgactacgtaccgaacgttacggttacggttaccgggacggggtaaacggtaaccgtacggtccgtaaccggtacccgtaacgtaccggtaccgaccggtacccgtacggtcccgtacccgtcccccgg

SEQ ID NO: 414184 - DNA, 629 bp, Homo sapiens
  misc_feature: GZ8MTXP02I1CVD.3.33.C11.1.454.CMB.2.raw
  modified_base (206)..(206): a, c, t, g, unknown or other
  modified_base (332)..(332): a, c, t, g, unknown or other
  modified_base (340)..(340): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnatttataactatgtctcctggtaccagcagccacccaggcaaaacgcccccaaaactcatgattatgaggtcacaaagcggcctcgaggggtccctgatcgcttctctgcctcaagtctggcaacncgcctccngacctctcgtggcctccagcctgacgatgaggctgattattactgcagctacatatgactaggctatacctaaactcgtttcggtttttacggaccgggtaagggaaccccgaaaggtcctacggtacccggttacccgttaaacgggttccaacggaccccgtaaaacgggtcccgtaccggtcccccccgttaccgggttccctacctttcccgttacccgtttccccctaacccccgtttcccgtaccggtaccggttccgtcccggttccttaccggtttccggg

SEQ ID NO: 414185 - DNA, 543 bp, Homo sapiens
  misc_feature: GZ8MTXP02FRZRX.3.33.C11.1.454.CMB.2.raw
  modified_base (242)..(242): a, c, t, g, unknown or other
  modified_base (304)..(304): a, c, t, g, unknown or other
  modified_base (347)..(347): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgcccccaaatcatgatttangagtcaacaaagcggccctcgacggggtcctgactccgcttcnctcgccctccaagtctggacaaacgaccggccctccctcgacccgtctcgtcgggcctccagcctgaggagtgaggctgtattattactgcagtctcatagtgcaggcactacaaactacttgtttacgggacggacgggaccaacgtctacgacccgtaacgtacggtacacgacccgaaggcctcgtacccccg

SEQ ID NO: 414186 - DNA, 543 bp, Homo sapiens
  misc_feature: GZ8MTXP02HXRR1.3.33.C11.1.454.CMB.2.raw
  modified_base (248)..(248): a, c, t, g, unknown or other
  modified_base (311)..(311): a, c, t, g, unknown or other
  modified_base (341)..(341): a, c, t, g, unknown or other
  modified_base (355)..(355): a, c, t, g, unknown or other
  modified_base (357)..(357): a, c, t, g, unknown or other
  modified_base (382)..(382): a, c, t, g, unknown or other
  modified_base (413)..(413): a, c, t, g, unknown or other
  modified_base (433)..(433): a, c, t, g, unknown or other
  modified_base (449)..(449): a, c, t, g, unknown or other
  modified_base (456)..(456): a, c, t, g, unknown or other
tcagagacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagccctccctccgccgtccgggtctcctggacagtcagtcaccatctcctgcactggaaccagcaggtgactagttggtntattaataactatgtctctggtaccagcagcaccaggacaaacgcccccaatcatagtattangagtcaacgaacgcgcctcgacgggtcccngatcccgcttctcncncctcagtctggacacgacgcctccngccctctcgtcggctccacgccgtagacggntgagtctgtattacgttacngtcagtctcatagtgnaggacanactaaccttagttcggtttacggcgggtaacggactaacgcgtaccgacgtccgtacgtccacgacccgacggtcctaccgtccccg

SEQ ID NO: 414187 - DNA, 557 bp, Homo sapiens
  misc_feature: GZ8MTXP02FO1CR.3.33.C11.1.454.CMB.2.raw
  modified_base (452)..(452): a, c, t, g, unknown or other
  modified_base (458)..(458): a, c, t, g, unknown or other
tcagagacgcactccacgaccggtgctcgatttagagtgagctcggttggggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtcaccatctcctgcactggaaccagcagtgacattggtgattataactatgtctcctggtaccagcagcaccaggcaaacgcccccaaatcatgatttatgagtcacaaagccggcctcgaggggtccctgtatcccgcttctctgcctccaagtctacggcaaacaccgccctcccgtagacccgttctcgtcgggcctaccgacgcccgtagaggatggaggtctgattattactgctagtctanactatncgtaggccagtcaactacgttggtttacggcggaagggtaccaaggtcctcgtaaccgtccgtaacggtacacggcccgaacggccgtaccgtcccccg

SEQ ID NO: 414188 - DNA, 330 bp, Homo sapiens
  misc_feature: GZ8MTXP02FZXR7.3.33.C11.1.454.CMB.2.raw
  modified_base (279)..(279): a, c, t, g, unknown or other
  modified_base (318)..(330): a, c, t, g, unknown or other
tcagagacgcactccacgaccggtgctcgatttagagtgagctcgttggggtttggggaggtcacaaagcggccctcaggggtccctgatcgcttctctgcctccaagtctggccaacacggcctccctgaccgtctctgggctccagccctgaggatgaggctgattattacctgcagctcatatgccaggcatcaaacactgttttcgggcggagggaccaagctgaccgtctaggtcagcccaaggctgcccctggtcactctgttcccgccctcncgagtcgcgtctctgagcgggctggcaaggcgccatagnnnnnnnnnnnnn

SEQ ID NO: 414189 - DNA, 597 bp, Homo sapiens
  misc_feature: GZ8MTXP02H0SDH.3.33.C11.1.454.CMB.2.raw
  modified_base (227)..(227): a, c, t, g, unknown or other
  modified_base (243)..(243): a, c, t, g, unknown or other
  modified_base (251)..(251): a, c, t, g, unknown or other
  modified_base (315)..(315): a, c, t, g, unknown or other
  modified_base (348)..(348): a, c, t, g, unknown or other
  modified_base (360)..(360): a, c, t, g, unknown or other
  modified_base (487)..(487): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctctcactcagggcacagggtcctgggcccagtctgccctgactcagccctccctccgcgtccgggtctcctggacagtcagtcaccatctcctgcactggaaccngcagtgactattggtntaattaanaacttatgtctccgtggtaccagcagccacccaggaccaaacgacccccaaatcatgaatttanagagtacaacaaagccgccctcgacggggtccngactccgcttcnctcgccttccaagtcgtcggactaaccgaccgtccctcccgcgtacccgtcctcgtcggcctccgacgcccgtaggacggtgtaggacggctagtatttattacgtgtcagtctactatagtcgacnggtacacgtacaacgtcgttacggtttccgggacggtacggaaccaacgtccgtacggaccgttaaccgtacggtaccgacgacccgtaacggccgtcccggtacccccg

SEQ ID NO: 414190 - DNA, 650 bp, Homo sapiens
  misc_feature: GZ8MTXP02F62KE.3.33.C11.1.454.CMB.2.raw
  modified_base (229)..(229): a, c, t, g, unknown or other
  modified_base (245)..(245): a, c, t, g, unknown or other
  modified_base (304)..(304): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacgagggtcctgggcccagtctgccctgactcagccctccctcgcgtccgggtctcctggacagtcagtcaccatctcctgcacgtggaaccngcagtgactagttggntattaataactatgtctctggtacagcagcaccagacaaacgccccaaatcatgattangacgtcaacgaaagcgccctcgacggggtcctagactccgtcttctctcgcctacgaacgtctacggacaaccgaccgtccctccgtcgtacccgtcgtcgtcgggccctccgtacggtcccgtaggacggtatacgggtacggtacgttacgttaaattttaacgtttaaccgttcggacctaacggtccgttaactaacgttaacgttcgaccgttaaacggacctaaactaccgtaaaccgttacggtttcgggtttaccggggacgggtaaacggtacgtaaacgtccgtacggtacccgtaacgttacggacgaccgtaccgacgtcccgtaccgtccccg

SEQ ID NO: 414191 - DNA, 632 bp, Homo sapiens
  misc_feature: GZ8MTXP02HE1LA.3.33.C11.1.454.CMB.2.raw
  modified_base (208)..(208): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgactagttggtnattataactatgtctcctggtaccagcagcaccaggaccaaacgccccaaatcatgtattatgaggtcaacaaacgccggcctgacgggtcctgactcgtcttctctcgcctacagtctggaccaacgtccggcctccgtcgaccgtctcgtcgggcctccgacgtccgtaggacgtacgtgacggtctagttaactttacttacgtgactacggtcttacgtagtacgtcggacgtacggactactacgtaaccgttacgtttcgggtttaccgggacgggacgggtaaccacggtcgtacggtaccgtcgtacggtacgacgtacccgtaacggcctcccggtccccgttacggtacctccgttcccgttcccgttaccccgcccgttccgtcggtacgttccgtccgttcgtcgtaccggg

SEQ ID NO: 414192 - DNA, 737 bp, Homo sapiens
  misc_feature: GZ8MTXP02HRAV7.3.33.C11.1.454.CMB.2.raw
  modified_base (243)..(243): a, c, t, g, unknown or other
  modified_base (317)..(317): a, c, t, g, unknown or other
tcagagacgcactccacgaccggtgctcgatttagagtgagctcgttggggtttgggggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactggaaccagcagtgactattggtnaatttaataactatgtctcctggtaccagcacgcacccaggaccaaacgaccccccaaatcatacgtatttagngaggtacaacgtaaacggccggacctacggacggggtcccctagactcccgtctttcctcgtcgcctacccgaagttccgtacggacctaaaccgacccggtccccttcccgtcgtaccccgtcgttccgtcggggtccctacccgtacggtcccgttagggaacggtacgtacgggacggtccgttaggtaacttttaacttacgttcgtacgtaacgtcctacctaattacgtcgacgtacggactaactaaccgtaaaaccgttacggtttaccgggttttaccggggaccggggttaaacgggtaaacccgaaacggtcccggttaaccgggtaacccgttaacccggtttaacggggtaccctacccgggaacccgtaaaccgggggttcccctaccccgggtttacccccccgg

SEQ ID NO: 414193 - DNA, 579 bp, Homo sapiens
  misc_feature: GZ8MTXP02ITQOJ.3.33.C11.1.454.CMB.2.raw
  modified_base (208)..(208): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacatttggtnattataactatgtctcctggtaccagcagccaccaggacaaacgccccaaactcatgattatgagtcacaaagcgcctcgacgggtccctgatcgcttctctgcctacagtctggacaacgaccggcctcccgtcgaccgtctcgtcgggtctccgagccgtgagagtgacgctagtatttactacgtgacgagctactatatcgcaaggcaataccaaactacggttgttttaccgggacgggtaacgggaacaaacgtcgttacggacccgttacgtacggtaccgacgacccgaacggtcctaccggccccgtcgtactacctccgttccgtacccaacccgtcgtcgtacgtcgtccgtctcgtcgg

SEQ ID NO: 414194 - DNA, 660 bp, Homo sapiens
  misc_feature: GZ8MTXP02GPIR0.3.33.C11.1.454.CMB.2.raw
  modified_base (207)..(207): a, c, t, g, unknown or other
  modified_base (219)..(219): a, c, t, g, unknown or other
  modified_base (276)..(276): a, c, t, g, unknown or other
  modified_base (313)..(313): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccggtctcctggacagtcagtcaccatctcctgcactggaaccagcagtgacatttggtnaattaataactntgttcctcctggtaccagcagccacccaggaccaaacgcccccaaatcatgtattanagaggtacaacgaaacgccgccctcggacgggtcccngactcgtcttctctcgtcctacctaagtctacggaccaaccgaccggtccctcccgtccgacccgttctccgtacgggtcctaccgacgtcctaggagggtacgtgggacgtcttagttaaactttacgttaacgttcgactaacgtctactatacgtagcgacgacctatacctaaacttcggttacggtttcgggacgggtaacgggaaccaacgtccgtaccggtacccggttacgtaccggtacgaccgacccgtaacggtcccgtcccggtccccgttccgtacctacccgttccgttcccgtcccctaacccgtccgtcgtacgtccgtcgtctacgtcgg

SEQ ID NO: 414195 - DNA, 627 bp, Homo sapiens
  misc_feature: GZ8MTXP02FYXP0.3.33.C11.1.454.CMB.2.raw
  modified_base (208)..(208): a, c, t, g, unknown or other
  modified_base (270)..(270): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaaccagcagtgacattggtnattataactatgtctctggtaccagcagcacccaggacaaacgccccaaactcatgatttangaggtcaacaaagcggccctcgaggggtcccctgactcgcttctctcgcctaccaagtccgtggaccaaaccgaccggcccctccctcgacccgtcctcgtcgggcctccagtccgtaggacggtagtggaggtctaggtaactttaatttacgtgcctaagtcctactatagtcgacgacggactaactaccaaactacggtttcggttttacgggaccggaacggggaaccaacgcgtaccggtaccgttacctagggtacacgacccgaaggtccctaccgcccccgtcggtacctaccttcccgtccgtttaccccaacccgtccgtacgacgtcgtccgttccgtcgtacgg

SEQ ID NO: 414196 - DNA, 582 bp, Homo sapiens
  misc_feature: GZ8MTXP02GYZ5X.3.33.C11.1.454.CMB.2.raw
  modified_base (206)..(206): a, c, t, g, unknown or other
  modified_base (217)..(217): a, c, t, g, unknown or other
  modified_base (270)..(270): a, c, t, g, unknown or other
  modified_base (299)..(299): a, c, t, g, unknown or other
  modified_base (313)..(313): a, c, t, g, unknown or other
  modified_base (329)..(329): a, c, t, g, unknown or other
  modified_base (377)..(377): a, c, t, g, unknown or other
  modified_base (414)..(414): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctctgcactggaacctgcagtgactattggtnattaataactntgtcctcctggtaccagcagcaccaggccaaacgccccaaatcatgtatttangagtcaacaacgcgcctcgacgggtcccngatcgtcttactcncgtacctacaagttcncggaccaacgaccggccctccgtccgtacccgtctcgtcggctaccgngtcctagaagggtctggagtactagttattatttacncgactactctagtatagtcgacgacgactaactacgtaacgttcggtttacggttacggacggtacggacacgtcgtcgacgtcgacgtcacgccgacgccgtccgcccgtcgtactccgttccgttccgtcccgtccgttccgacgtacgtcgtccgtacgtcgtcg

SEQ ID NO: 414197 - DNA, 595 bp, Homo sapiens
  misc_feature: GZ8MTXP02GN30C.3.33.C11.1.454.CMB.2.raw
  modified_base (229)..(229): a, c, t, g, unknown or other
  modified_base (245)..(245): a, c, t, g, unknown or other
  modified_base (287)..(287): a, c, t, g, unknown or other
  modified_base (314)..(314): a, c, t, g, unknown or other
  modified_base (410)..(410): a, c, t, g, unknown or other
  modified_base (480)..(480): a, c, t, g, unknown or other
tcagagacgcactccacgaccggtgctcgatttagagtgagctcgttggggtttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgactattggtntaatttataactatgtcctcctaggtaccagcagccaccaanaccaaacgcccccaaatcatgatttangacgtacaacgaacgcgccctaggacgggtcctgactccgtcttctctcgcctacagtcgcgacaacgccgcctccgtagcccgtctcgtccggcnccgtacgccgtagacggtagtggaacggtctagttaatttacttaacgtcgtctacgtcttacagttacngacgtagactatactaaacgtcggtttcggttacgggacgggtaaacgaccgtagtaccgtacggtacccgttcgtaacggtcgaacgacccgtacggcccctacccggtccccg

SEQ ID NO: 414198 - DNA, 682 bp, Homo sapiens
  misc_feature: GZ8MTXP02GEFRK.3.33.C11.1.454.CMB.2.raw
tcagagacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtcaccatcctcctgcacgtggaaccagcagtgactagttggatattataactatgtctcctggtacagcagccacccgaggaccaaaccgacccccaaaatcactagtatttagtgacggtacaaacgtaaacggccggccctacggtacggggtccctgactccgtccttctctccgcctactaagtccgtacgaccaacgacccgtccctccgtcgtacccgtcgtaccgtcggcccgtcgacgtcccgtaggacggtagtacgggaacgtccttaggttaactttacgttacgtcgtaccgtagtccttagactaagtgaccgtaacgactaactacaaaccgttacggtttacgggtttacggggaacggggtaacggtaaccgtacggtccgttacccgggttacccgttaaccggtaccggttaccggaaccggttaccggaaccggtccccggtttaccggcccccccgg

SEQ ID NO: 414199 - DNA, 696 bp, Homo sapiens
  misc_feature: GZ8MTXP02G7UIM.3.33.C11.1.454.CMB.2.raw
  modified_base (313)..(313): a, c, t, g, unknown or other
tcagagacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactggaaccagcagtgactagttggtataattataactatgtctcgtggtaccagcagccaccgagacaaacgacccccaaatcatgtattanagagtacaacgaaacggccggaccctacggacggggtccctaggtactccccgtcttctcgtcgtaccctaccgtaacgtccgtacggaccaaaccggacccggtcccctcccgtcggtacccttcgtccgtccgggtccctccgacgtcccgtaggacggtacgtagggtacggtcgttacggttaaacttttacgtttaaaccgtcgaccgtaacggttcctaactaacgttacggtaccgacgaacggtacctaacgtaaccgtaaaccggttacgtttacggggtttaccgggacgggtaaaccggaaccgtacgtccgtaccggtacccgtaaccgtacggtacccgaccgaccgtaacgcccggtccctacccccgg

SEQ ID NO: 414200 - DNA, 597 bp, Homo sapiens
  misc_feature: GZ8MTXP02JA3DL.3.33.C11.1.454.CMB.2.raw
  modified_base (207)..(207): a, c, t, g, unknown or other
  modified_base (269)..(269): a, c, t, g, unknown or other
  modified_base (289)..(289): a, c, t, g, unknown or other
  modified_base (392)..(392): a, c, t, g, unknown or other
  modified_base (396)..(396): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnattataactatgtctcctggtaccagcagcacccaggcaaacgccccaaactcatgatttangaggtcacaaagcggccctnaggggtcccctgatcgcttctctgcctccaagtctggcaacaccggcctccctgacccgtctctgggctcccgagcctgaggatgaggctgattattactgcngctnatatgcaggcatacaactacttacggtttttcgggacgggtacggggaacccgaaacggtcctacggtaccggtcccgtacgggttacaacggccccgtaaacgggccctaccgccccccgttaccgggtccctaccgttcccgtcgtttcccccggtcccctcccgttccggtacggtcgtccgttccgttcgttccggg

SEQ ID NO: 414201 - DNA, 684 bp, Homo sapiens
  misc_feature: GZ8MTXP02JPT2R.3.33.C11.1.454.CMB.2.raw
  modified_base (245)..(245): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactagttggtanaattataactatgtctctggtaccagcagcaccaggacaaacgcccccaaatcatcgtattatgagtacaacgaaagccggcctcgacggggtccctgactcccgcttcctctcgcctcgaatcgtcggacaaacgtaccggccttcccgtgacccgttctcgtcggtcctccgacgtccgtagaaggagtggaacgtcgttagtaacgtttacttaacgttcgtacgacgtccttaacctagtaacttcggacccgaaggggacctaacgtttaacaaaccgtttaaccggtttcgggtttttacccgggggaccggggttaaaacgggggaaacccgtaaaacggtccgttaacccggtaacccggtttaaccgaaacgggttcccgtaaccgggaccccgttaaaacggggccccgtttacccgttacccccccgg

SEQ ID NO: 414202 - DNA, 608 bp, Homo sapiens
  misc_feature: GZ8MTXP02F9DAL.3.33.C11.1.454.CMB.2.raw
  modified_base (229)..(229): a, c, t, g, unknown or other
  modified_base (244)..(244): a, c, t, g, unknown or other
  modified_base (309)..(309): a, c, t, g, unknown or other
tcagagacgcactccacgaccggtgctcgatttagagtgagctcgttggggtttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgacattggtnaattataactatgtctctgtaccagcagcaccagacaacgccccaaatcatgattatgagtcaanaagcgcctcgacgggtcctgatcccgtcttctctcgtcctaccaagtctggacaaacgaccgtcctcccgtagacccgttctcgtcggctccacgtcccgtagacggtaatggaaggtctagttaactttaacgttaaccgtcgacgtacgtacctataacgtagtacgtacgacgtacgtaactaacgtaaacgttaacgtttacgggtttacgggtacgggaacgggtaaccgtaacgtacgtaccgtaccgtaaccgtacgtaccgaccgaccgtaccggtaccgtcccgtccccg

SEQ ID NO: 414203 - DNA, 620 bp, Homo sapiens
  misc_feature: GZ8MTXP02IVDF8.3.33.C11.1.454.CMB.2.raw
  modified_base (242)..(242): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactggaaccagcagtgactagttggtnaatttataactatgtctcctggtaccagcagcacccaggcaaacgacccccaaactcatgatttatgagtcacaaaacgccggcctcgacggggtcccctgactccgcttctctcgcctaccaacgtctcggacaaaccgaccgtcccctcccgtcgacccgtctcgtcgggcctccgacgcccttggacggtagttcggacggctaggtatttaacttacgtgactaacgtctaccattagtgacgacggtacacgtactaaacgtacgtttcgggttttccggggacggggtaaacgggaaccctaacggtaccgtaccgtacccgtaaccgtacggtaccgacggaccccgaacgggtcctcccggtacccccgg

SEQ ID NO: 414204 - DNA, 600 bp, Homo sapiens
  misc_feature: GZ8MTXP02HWP4S.3.33.C11.1.454.CMB.2.raw
  modified_base (206)..(206): a, c, t, g, unknown or other
  modified_base (302)..(302): a, c, t, g, unknown or other
  modified_base (370)..(370): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtnaattataactatgtctctggtaccagcagcaccaggcaaagcccccaaatcatgattatgagtcacaaagcgcctcgaggggtcctgatcgcttcnctcgctccaagtctgcaaacacggcctcctgacccgtctcgcggctccagcctggaggtatgacggtntagtattatactgacacgtctactatatcgacgagacactactaaactcgttacggttcgggacgggtaacgggaaccaacgtaccgtacgtacccggtacgtacggtaccgaccgaaccgtaacggtccgtacccggcccccgttccggtacctaccgttccttcccggttcccccgtaaccccgttcccgtacccggtacggttccgtacccgttccgtacggtacgg

SEQ ID NO: 414205 - DNA, 672 bp, Homo sapiens
  misc_feature: GZ8MTXP02F5EMI.3.33.C11.1.454.CMB.2.raw
  modified_base (268)..(268): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcaccaggcaaacgccccaaactcatgatttangaggtcaacaagccggcctcgacggggtcctgactcgcttctctcgcctacaagtctaggacaacgccgcctcctcgtacccgtctcgtggtcctccgagtccgtaggacggtatcggacgtcttaggtaatttttaacgtacgtcgacgagtccttacaattacgttcgacgacggtactactacctaaacgttacggttcggttttaccggggacgggtaacgggtaaccgaacgtccgtacggtacccggttacttacggtacctaacggacccgtaaacggggtccctacccgggtcccccgttacgggtacccttacccgttaccgttccccgttacccctaacccccgtttcccggtaacgttaccggtacgtcccggtttaccgtccggttaccggg

SEQ ID NO: 414206 - DNA, 636 bp, Homo sapiens
  misc_feature: GZ8MTXP02FZXC4.3.33.C11.1.454.CMB.2.raw
  modified_base (244)..(244): a, c, t, g, unknown or other
tcagagacgcactccacgaccggtgctcgatttagagtgagctcgttgggtttggggggggtctcaggaggcagcgctctcgggacgtctccaccatggcctgggctctgctattcctcaccctcctcactcagggcacagggtcctgggcccagtctgccctgagtcagcctgcctccgtgtcgtgggtctcctggacagtcgatcaccatctcctgcactggaaccagcagtgacgttgganatatatatgtctctgtaccaacactccagcaaacgcccccaaatgatagtatttatgatgtataataacgtccggccctaggtacggggtttactaatcgtcttccgtactcggtctacctaagtcgtacggccaaaccgacccggtcccttcccctacgaaccctacttccgttccgtcggggtcccgtaccggtaggggtacggaacggggtacggacgggtcttaaggtactttaacttacgttagaccgtagtccttactaaacgtttaacgaacgtacacgacctacctacgtacgtacggttaccgtacggaacgtacgggtaactacggtaccaccgtcgtacgcacgaaccgtaacgacccaacctcgtacgtactacttcccg

SEQ ID NO: 414207 - DNA, 676 bp, Homo sapiens
  misc_feature: GZ8MTXP02HMH68.3.33.C11.1.454.CMB.2.raw
  modified_base (191)..(191): a, c, t, g, unknown or other
  modified_base (206)..(206): a, c, t, g, unknown or other
  modified_base (269)..(269): a, c, t, g, unknown or other
  modified_base (299)..(299): a, c, t, g, unknown or other
  modified_base (409)..(409): a, c, t, g, unknown or other
tcagagacgcactccacgaccggtgctcgatttagagtgagctcgttgggtttggggctttgcctgggctctgctcctcctcaccctcctcactcagggcacagggtcctgggcccagtctgccctgactcagcctccctccgcgtccgggtctcctggacagtcagtcaccatctcctgcactggaaccngcagtgacatttggnattataactatgtctcctggtaccagcagccaccaggacaaacgcccccaaatcatgatttangagtcaacaaagccgcctgacggggtcccngactcgcttctctgccctaccaagtctggaccaaaccgaccggccctccgtcgaccctatcttcgtgggccttcgaggcctagacggacgagtctagtatttacgtttcncggacaggtccttacgaacttaccgaaccgaacccggccaaaccgtacgttcggttcggtttcgggtttttaccgggagggtaaccgggaaccaaacgggtcgtaccggtaacccgttacgtaacgggtccaaccggacccggttaacggcccgtttacccgggccccctttaccgggccttaacccttccgtttccccgtttacccccaaccccgttccgtcggggtaaccgtaccggtccgtccgtttacggtacggtaccgggg

SEQ ID NO: 414208 - DNA, 637 bp, Homo sapiens
  misc_feature: GZ8MTXP02GFBY5.3.33.C11.1.454.CMB.2.raw
  modified_base (228)..(228): a, c, t, g, unknown or other
  modified_base (243)..(243): a, c, t, g, unknown or other
  modified_base (307)..(307): a, c, t, g, unknown or other
  modified_base (355)..(355): a, c, t, g, unknown or other
  modified_base (372)..(372): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggaaccngcagtgacattggtnattataactatgtctcctggtaccagcagccacccaggacaaacgcccccaaatcatgatttangaggtcaacaaagccggcctacgacggggtcccctgactcccgcttcnctacgcctacaagttcnggaccaaacgaccggtccctcccgtacgtacccgtcctccgtcgggcctcccgacggtccctaggaggactaggacgggtctagtaaagtttacgtttacgtcgcgtacgtcctactatagttcgcgaacggtcaactcaaaaccgttacgtttcgggttttaccgggaccggggaacgggaaccgttaacggaccgtaaccggttaacccgtccgtaacggtccgaaaccggtaccccgaacggcccgttacccgtccccccgg

SEQ ID NO: 414209 - DNA, 772 bp, Homo sapiens
  misc_feature: GZ8MTXP02GGVU3.3.33.C11.1.454.CMB.2.raw
  modified_base (200)..(200): a, c, t, g, unknown or other
  modified_base (253)..(253): a, c, t, g, unknown or other
tcagagacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcacgcctccctccgtgtctgggtctcctggacngtcgtcaccatctctgcagtgactccgacggtgtacgttgcttattatagttnctcgtgtctaggaaccaaacaccagacaacgccccagtactatgtattagtgtatgtacagtgtacgtcggtccctaggtacgggtttctactacgttcgttctttcgtcgtcctacgtacgtcgtacgactaccgaccgtccctaccgtacgtacctacgtcgttacggtcggtccctacggacgtcgacgggaaacgggtacggtacggtactttacggttaactttaccgttcgtacgtaccgtaccggtaccttaactaaaccgttacccggaaaacccgacccgggtacccttaaacccgttacgggtttccggggttcggggttttacccggggtttacgggggttaaccggggaaaacggggttaacccgtaacgggttacccggttacccgggttaaaccccggttccggtttaacccggggtaccacccgggttaaacccgacccggggttaccccgtcccccgggttacccccggttaccgttaaccccggttaccctttacccccggg

SEQ ID NO: 414210 - DNA, 587 bp, Homo sapiens
  misc_feature: GZ8MTXP02FQ36X.3.33.C11.1.454.CMB.2.raw
  modified_base (206)..(206): a, c, t, g, unknown or other
  modified_base (269)..(269): a, c, t, g, unknown or other
  modified_base (411)..(411): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggnattataactatgtctcctggtaccagcagcacccaggacaaacgccccaaactcatgatttangaggtcaacaaagcgccctcgaggggtccctgatcgcttctctcgcctccaagtctggacaacgaccggccctccctcgacccgtctcgtcgggcctccgagcctggaggatgagctgtaatttattacgtgcagctactanatgcgagacatacaactacgttcggtttacggacgggtaacgggacaacgtcgtacggtacccgtcgtacggtacgacgacccgaacggtcctcccggcccccgttcggtcctacccgttccgttcccgttcccccgtcccgttcccgtacggtacgtcgtccgtcgtcgtacggg

SEQ ID NO: 414211 - DNA, 797 bp, Homo sapiens
  misc_feature: GZ8MTXP02FLXXZ.3.33.C11.1.454.CMB.2.raw
  modified_base (205)..(205): a, c, t, g, unknown or other
  modified_base (215)..(215): a, c, t, g, unknown or other
  modified_base (259)..(259): a, c, t, g, unknown or other
  modified_base (264)..(264): a, c, t, g, unknown or other
  modified_base (304)..(304): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccggtctcctggacagtcagtcaccatctcctgcactggaaccagcagtgacattggntattatactntgtctctggtaccagcagcaccaggacaaacgccccaaatcatnattangagtcacaagcgcctagagggtcctgatcgcttctctacncctacgaaacgtcgtacgggaccaaaccgaccggtaccccttaccccgtacgtacccccgttccgtccggtccggggtacccttacccggaacggtccccgtaggaacggtagttcgacgggtctaggttaacttacgttacgttcgactacgtaccttctaattacggtacgaacgacgtactaacgttaaaccgttaacggtttacggtttacggggtttaccggggaacgggtaaaccgggtaaccgtaaaccggttaccgttaacccgggttacccggttaccggtaccggtaaccgtaaacccggtaaccccggtaaccgggttcccccgttacccccgggttaccccccggttacccgggtttaaccccttacccggtttacccccgtttacccccggtttaaccccccgtaaccccggttttacccggttaacccgggtaccggttaccccgggtttaccggtttacccgttaccgggtaccgggg

SEQ ID NO: 414212 - DNA, 702 bp, Homo sapiens
  misc_feature: GZ8MTXP02IZWA1.3.33.C11.1.454.CMB.2.raw
  modified_base (244)..(244): a, c, t, g, unknown or other
tcagagacgcactccacgaccggtgctcgatttagagtgagctcggttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactcggaaccagcagtgactattggntattataactatgtctctgtaccagcagccaccaggacaaaccgacccccaaactcatgtaatttatagaggtcaacgaaaacggccgccctacggacggggttccctaggtactcccgtctctctcgtccctaccgaagtcgtcgacctaaaccgccgggccccttccctacggtacccgtctcccgttcggacccttccgacgtcccgtggaacgtgtaggacgggtctaggtaactttactttaccgagggttccaacgcctttaactaacgttgtacgacgtacgtactaacgtaaccgtaaaccgttaccggtttacgggtttaccggggtaaccggggtaaaccgggtaaaccggtaaccgtaccggttacccggttaacccggttaacccggttaccggtaaccgtacccggtaaccccggtacccggtacccgtaccccggtacccccgg

SEQ ID NO: 414213 - DNA, 733 bp, Homo sapiens
  misc_feature: GZ8MTXP02GJKTX.3.33.C11.1.454.CMB.2.raw
  modified_base (211)..(211): a, c, t, g, unknown or other
  modified_base (284)..(284): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgactagttgggtanatttaataacttatgttcctcctggtaaccagcagccaacccgaggaccaaacgcccccaaatcatgatttangaggtcaacaaagtcggccctcgaggggtcccctgatcgcttctctgcctccaagtctggactaacaccggccctcctcgacccgtctcgtcgggcctaccagtcccgtggaggattggacggtctagtatttaactactcgacacgtactctaattacgtacgacgaggacctaacttaaaccggaaaccttaaacgttttcggggtttttaccgggaccggggtaacggggtaaacccgaaaaccgggtccgttaaccggtaccccggttaacccggttaacggggtacccgtaaccggaaccccgtaaaacgggtccccgttacccggtacccccccggttcgggttaacccctaacccggttacccttcccggtttaccccccaacccccgtttcccgttccggtaaaccggttccggtacccggttccgttaccggttccgggg

SEQ ID NO: 414214 - DNA, 763 bp, Homo sapiens
  misc_feature: GZ8MTXP02GW2P9.3.33.C11.1.454.CMB.2.raw
  modified_base (209)..(209): a, c, t, g, unknown or other
  modified_base (274)..(274): a, c, t, g, unknown or other
tcagagacgcactccacgaccggtgctcgatttagagtgagctcgttgggtttgggggctttgcctgggctctgctcctcctcaccctcctcactcagggcacgagggtcctgggcccagtctgccctgactcagcctccctccgcgtccgggtctcctggacagtcagtcaccatctcctgcactggaaccagcagtgacattggtanattataactattgtctccgtggtaccagcagcaacccgaggacaaacgccccaaatcatgattangaggtcacaaagccgccctcgacggggtccctgactcgtcttctctcgcctaccgaagtcgtcggaccaaaccgaccggtcccctcccgtaccgtaccccgttccttcgtacggggtacccttcccggaacgtcccgttagggaacggtaacgttgggaacgggtcttaggtacttttacttttctacggctacgtccttacaaactacccgaaccgaaccccggtacaacccgtacgtttcggttcccgggtttgggtttttaccggggaggggaaaccgggtaacccgtaaacggtcccgtaccggtaccccggttaccggtttaacgggtaccgaacccggacccggtaaaaccgggtcccggttccccggtaccccccggttacgggttccctaacccgtttcccgttaccccgggtttcccccgtaccccgttcccgtccggtaacggttcccggtcctttaccgttcggttacggcccggggg

SEQ ID NO: 414215 - DNA, 611 bp, Homo sapiens
  misc_feature: GZ8MTXP02GPHFN.3.33.C11.1.454.CMB.2.raw
  modified_base (417)..(417): a, c, t, g, unknown or other
tcagagacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcaccaggacaaacgccccaaatcatgattatgaggtcaacaaagccggccctcgacggggtccctgactcgtcttctctcgcctaccaagtctcggacaacgccggtaccctcctcgtaccgtctcgtcggctccagcctagacggatgagtctagtatttacgtactgcagtctactatntgcaggactatacaactacgttacggtttacgggacggtacgggaccaacggtcgtacgtacccgtacgtacggtacctacggacccgtaacggtcctacccgtacccccgttcggtaccctacccgttccgttcccgtttacccccaacccgttacccgtaccgtacgttccgtaccgttccgtcgttccggg

SEQ ID NO: 414216 - DNA, 617 bp, Homo sapiens
  misc_feature: GZ8MTXP02JOMBC.3.33.C11.1.454.CMB.2.raw
  modified_base (230)..(230): a, c, t, g, unknown or other
  modified_base (258)..(258): a, c, t, g, unknown or other
  modified_base (326)..(326): a, c, t, g, unknown or other
  modified_base (384)..(384): a, c, t, g, unknown or other
  modified_base (435)..(435): a, c, t, g, unknown or other
  modified_base (437)..(437): a, c, t, g, unknown or other
  modified_base (441)..(441): a, c, t, g, unknown or other
  modified_base (449)..(449): a, c, t, g, unknown or other
  modified_base (465)..(465): a, c, t, g, unknown or other
  modified_base (467)..(468): a, c, t, g, unknown or other
  modified_base (489)..(489): a, c, t, g, unknown or other
tcagagacgcactccacgaccggtgctcgatttagagtgagctcgttgggtttggggggggtctcaggaggcagcgctctcaggacgtcaccaccatggcctgggctctgctcctcctcaccctcctcactcagggcacgagggtcctgggcccagtctgccctgactcagcctcctccgcgtccggtctccgtggacagtcagtcaccatctcctgcacgtcggaaccngcagtgactagttgtatattaataactntgtctccgtaggtaccagcagcccaaccaagaaccaaaccgaccccctaaatcagttacgtatttacnggtacgtacaacgaaacggccgtaccctcggaaccgggtccagtactcccgtcttccnctcgcctaccagtcgcgaacaccgccgtcccgcctgaccgtctcgcgtccncngtcngagcaggngctatagttattacgngnngtcctatagttacgcgtacgngtaacctataaccgtacgttacggtttacgggtttaacgggaccggtaaacggaaccttaaacggccgttacggtacccgttaacgtacggtacctaaccggaccgtaccgtcccgtcccggtacccc

SEQ ID NO: 414217 - DNA, 594 bp, Homo sapiens
  misc_feature: GZ8MTXP02IZX07.3.33.C11.1.454.CMB.2.raw
  modified_base (228)..(228): a, c, t, g, unknown or other
  modified_base (312)..(312): a, c, t, g, unknown or other
  modified_base (428)..(428): a, c, t, g, unknown or other
tcagagacgcactccacgaccggtgctcgatttagagtgagctcggttgggtttggggggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatcctctgcactggaaccngcagtgactagttggtagatttataactatgtctcctggtacagcagcaccgacggacaaacgacccccaaactcatgatttangagtacacaaagcgcctcgacggggtccctgtactcccgtcttctctcgtcctaccaagtcgtggacaaccgaccgccctccgtacgccgtctcgtcggctccgagtcctgacggntggagctagtaatttacgttactgctagtctataaatcgtagcgaggctaaactcaaactacggtttcgtttacggggacgggacgggaactaacggtccgttaacggaccgttaacgtaacgggttacaacggacccgtaaacggtcctaaccccggttcccccg

SEQ ID NO: 414218 - DNA, 689 bp, Homo sapiens
  misc_feature: GZ8MTXP02IK7ET.3.33.C11.1.454.CMB.2.raw
  modified_base (244)..(244): a, c, t, g, unknown or other
tcagagacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggccagtctgccctgactcagcctccctcgcgtccggtctcctggacagtcagtcacatctctgccactggaaccagcagtgactagtttgggtanatttaactaacttatcgttctcctaggtaccagcacgccacccgaggaccaaaccgaccccccaaatccaattacgtaagtttagtacggaggtacaacgaaaacggccggtccctacggtacggggtccctagtactccccggtcttccgtctacgccctaccgaacgtcgtcgaccaaacgacccgtccctaccgtacgtacccgtcgtcgtcgggcctccggacgtcccgtggtacggtacgtaggacggtacgttaagtaacgtttacttaacgtcggcctacggtctaccgtagtacgtacgacggtagaactactaccgtaaacttacggtttacgggttttacgggacggggttaaacggaccgtaacggtacgttccgtacccggttaacggttacgcgtacccggaccgtaacggtcccgtcccggttacccccgg

SEQ ID NO: 414219 - DNA, 749 bp, Homo sapiens
  misc_feature: GZ8MTXP02IGT6C.3.33.C11.1.454.CMB.2.raw
tcagagacgcactccacgaccggtgctcgatttagagtgagctcgttgggtttgggggctttgcctgggctctgctcctcctcaccctcctcactcagggcacagggtcctgggcccagtctgccctgactcagcctcctccgcgtccgggtctcctggacagtcagtcaccatctcctgcactggaaccagcaagtgaactagtttggtagaatttaataaacttattggtccttcctaggtaccagcacgccaaccgaggaccaaacgacccccaaatcaatgtattagtagacggtacaacgaaacggccgaccccgtacgacggggtcccctgacttccgtcttcctctcgaccctaccgaaagttcgtacgaccaaccgtaccggtccccttaccgtccgtacccgttcgtcgtcgggtcctaccgacgtccgtagaggtactggacgtctagtttacttaacttacgtcgtacacgtcgttacctagtaacttcggaacgtaacggacctaaactaacctaaacgttaccggtttcgggtttaccggggaacggggttaacgggaaccctaaagggtacccttaaacggtaccccgttacggtaacggttacccgaaccgtaacccgtacggtaccctcccggtaacccccgtccgttaacctaccgttacccgttaccgtttacccccgaacccgtttaaccgtccggttacgtaccggtccgtttaccgtacggtccgggg

SEQ ID NO: 414220 - DNA, 650 bp, Homo sapiens
  misc_feature: GZ8MTXP02JNSK8.3.33.C11.1.454.CMB.2.raw
  modified_base (246)..(246): a, c, t, g, unknown or other
tcagagacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgaactagttgggtntaattataactatgtctctggtaccagcagcaccaggcaaacgccccaaatcatgattatgagtcaacaaagcgacctcgacggggtcctgactcccgcttctctcgcctccgaagtcgtcggacaaccgacggcccttcccgtacgtacccgtcctccgtcggggcctaccgacgtcccgtaggacggtagtcggaaggtcgtagtatttaaacgttacgtcggactaaggtccttactaattacgttacgccgaacgggtaccactaaccgtaaaccgtcgtttacggtttaccgggggacggaaacgggggtaacccaaacgggttccgtaaccgggtacccgttaaccggttacggtaaacccggcgtacccggtaaacggcccgttacccgtccccccg

SEQ ID NO: 414221 - DNA, 663 bp, Homo sapiens
  misc_feature: GZ8MTXP02FJY25.3.33.C11.1.454.CMB.2.raw
tcagagacgcactccacgaccggtgctcgatttagagtgagctcgttggggtttggggggggtctcaggaggcagcgctctcaggacgtcaccaccatggcctgggctctgctcctcctcaccctcctcactcagggcacgagggtcctgggcccagtctgccctgactcagccctccctccgcgtccgggtctcctggacagtcagtcaccatctcctgcactggaaccagcaagtgacattggtgattaataactatgtctctacggtaccagcagccacccacggacaaaccgaccccaaactcatgtatttagtgagtacaacgaaacgccggtcccgtacgtacgggtccctagtactccccgtacttcctctaccgtcctacgtaacgttcgtacggacctaaccgacccgtcccttacccgtcggtacccgttcgtcgtacggtccctccgacgtcccgtagacggtagtacggacgggtaccttagttaaactttacgttaactaggtaccacgttacctactacgttacgtcgacggacggaacctactaccgaaccgttacggttacgggtttccggggacggaacgggtaaccacggtacgtccgtaccgtaacgttacggcctaccgaccgtacgccgtcccgtaccccgg

SEQ ID NO: 414222 - DNA, 542 bp, Homo sapiens
  misc_feature: GZ8MTXP01DT9QT.3.36.D03.1.454.CMB.2.raw
  modified_base (201)..(201): a, c, t, g, unknown or other
  modified_base (330)..(330): a, c, t, g, unknown or other
tcagagacgcactccacgaccggtgctcgatttagctgcgtcacgatctctcttggggaggaactgctcagttaggacccagagggaaccatggaaaccccagcgcagcttctcttcctcctgctactctggctcccagatacgaccggagaaattgtgttgacgcagtctccagccaccctgtctttgtctccagggganagagccaccctctcctgcggggccagtcagagtgttcccagcaactatatagcctggtaccagcacaagtggcctggcgcccaggctcctcatctatgatacattcaccaggccactggcatcccgganaggttccagaggcagtgggtaatgggcagacttcactctcacatcagcagactggagccgtgattagttcgagttagtttaacttcgttcggtacgtagtactagttagtacgttactacaaacctaccgtccgacggacggacaacgtcggagaagttaagtaacgacgttagttggacgtcgcaacctaactcttcgttcgttcgttaac

SEQ ID NO: 414223 - DNA, 581 bp, Homo sapiens
  misc_feature: GZ8MTXP01DEFKR.3.36.D03.1.454.CMB.2.raw
  modified_base (204)..(204): a, c, t, g, unknown or other
  modified_base (297)..(297): a, c, t, g, unknown or other
  modified_base (337)..(337): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgaggggganagacgcccaccctctcctggcggggccagtcagagtgttcccagcaactatatagcctggtaccagcacaaagtgctggcgcccaggctcctnatctatgatacattcaccagggcccactggcatcccgganaggttccaggaggcgaggtgggtaatgggaacagacttcactctacaccatcagcagactggagccgtaggagtattttgacttaggttttacttacgttggtactagtactagttagttcggttactttaccgaaacctaaacccgtttcgggaccgaacgggggactaacggtacgttagggaacgttaagttaaacggcgttaacgttggttacggctgccactattcttcgttccttaac

SEQ ID NO: 414224 - DNA, 515 bp, Homo sapiens
  misc_feature: GZ8MTXP01BCSIH.3.36.D03.1.454.CMB.2.raw
  modified_base (334)..(334): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagtggcctggcgcccaggctcctcatctatgatacattcaccagggcccactggcatcccgganaggttccaggaggcagtgggaatgggcagacttcactctcaccatcagcagactggagccgtggagtatttgctagtttatactggtcagcagtatggtactcaactaaccttggaccaggggacaacgacttgggagaagttaacgcgaaacgttgttaggctgcaccattctgttcttc

SEQ ID NO: 414225 - DNA, 520 bp, Homo sapiens
  misc_feature: GZ8MTXP01DRYDS.3.36.D03.1.454.CMB.2.raw
  modified_base (291)..(291): a, c, t, g, unknown or other
  modified_base (331)..(331): a, c, t, g, unknown or other
  modified_base (397)..(397): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgagggggagagagccaccctctcctgcggggccagtcagagtgttcccagcaactatatagcctggtaccagcacaaagtgctgcgccaggctccncatctatgatacattcaccagggccactggcatcccgganaggttccaggaggcaggtgggtaatggggcagacttcactctcacatcagcagactgagctggatntttgctagtttattactggtactgcagtatggtacttactaacaaaccgttcggaccgagggacaacgacgttaggagagttaaagcgaaacgttggttaggctgcacattctgttcttaacg

SEQ ID NO: 414226 - DNA, 531 bp, Homo sapiens
  misc_feature: GZ8MTXP01CE4ZE.3.36.D03.1.454.CMB.2.raw
  modified_base (203)..(203): a, c, t, g, unknown or other
  modified_base (295)..(295): a, c, t, g, unknown or other
  modified_base (308)..(308): a, c, t, g, unknown or other
  modified_base (372)..(372): a, c, t, g, unknown or other
tcagagacgcactccacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccaggggaanagccacctctcctgcagggccaatcagagtgttagcaactacttagcctggtaccaacagaaacctggccaggctcccaggctctcatctangatgcatccaacngggccactggcactcccagccaggttcccaggtggcagtgggtctgggcagtaccttcacctcncacatcagcagcctagagcctagaagtatttgctagtttattactgtcagcagcgtagcaacgtcggcctctctacgtttcgggaacggtacgggaccgtagggttggaacgtagttaaccgaaacgttactggtggctaggccactaacgttcgttcg

SEQ ID NO: 414227 - DNA, 696 bp, Homo sapiens
  misc_feature: GZ8MTXP01DAM5E.3.36.D03.1.454.CMB.2.raw
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgttctttgtctccgagggggagagacgcccaccctctcctggcggggccagtcagagtcgtcccagacaactatatagcctaggtaccagacaacaaaggtggcctggccgcccgaggcctcctcatctatgatacattccaccgaggcccacgtcggaccacgtcccggaactacgggttacccaaggaggacgtaggggttggggtaaagtagggggaaccaaggtaccctttaccaaccttcctaccaaccctatccagcaaggacgtgggacgtcgtagggtattagttttcggacttaagttttacttaacgttgggttactaaggtacctaaggttaagttcgggttaaccctttaccgaaacccttaaaccggtttccgggaccggtaaacgggggtaaccaacggtaacgttaggggaaattaacggtttaaacggccggttaaacgttggttacgggtaactacggccctaaacccgtatttcccgttcgttcccgtttaaccc

SEQ ID NO: 414228 - DNA, 518 bp, Homo sapiens
  misc_feature: GZ8MTXP01AMGA1.3.36.D03.1.454.CMB.2.raw
  modified_base (501)..(501): a, c, t, g, unknown or other
tcagagacgcactccacgaccggtgctcgatttagctgcgtcacgatctctcttggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagtggcctggcgcccaggctcctcatctatgatacattcaccagggccactggcactcccggacaggttccaggaggcaggtgggtaatggggaacaggacttcactctcaccatcagcagactggagcctggatattttgactagtttattactggtctagcagtagtgtacttcaactaaaccttcggacgagggacaacgacttggagttagtaagcgacgttgttggntgcacattctgttcttc

SEQ ID NO: 414229 - DNA, 556 bp, Homo sapiens
  misc_feature: GZ8MTXP01BY56R.3.36.D03.1.454.CMB.2.raw
  modified_base (299)..(299): a, c, t, g, unknown or other
  modified_base (339)..(339): a, c, t, g, unknown or other
  modified_base (349)..(349): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgaggggagagacgccaccctctcctggcggggccagtcagagtcgttcccagcaactatatacgcctggtaccagcacaaagtggcctggccgccaggctcctnatctatgatacattcaccgaggcccagtggcatcccgganaggtccaggnggcaggtggtaatgggaacagacttcactctacacctatcgagacagactggagcctagaagtatttgactagttgtattacggtgtacgtaggttcttagttcggttactcgtaccgtcgttcagtcgttggccggtaggggaccaagggttgaagtacgttacgaaacgttacgtggtcggctcggacttaccctaagttcttcg

SEQ ID NO: 414230 - DNA, 588 bp, Homo sapiens
  misc_feature: GZ8MTXP01CMJST.3.36.D03.1.454.CMB.2.raw
  modified_base (203)..(203): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgagggganagagcccaccctctcctggcggggccagtcagagtgttcccagcaactatatagcctggtaccagcacaagtggcctggccgcccaggctcctcatctatgatacattccaccagggcccacgtggaccacgtcccggaatacggtttccaggttggctaggtggggtactggggaacaggtacgttcactctacaccatcagcacgcctagcagttctaggagttatttgacttagttttacttacgtgtacagtactaattaacaattaacgtcggtccttcggcttacgtaccgttcgggacgggttagggaccgttaaggggtaggaacgttacgttaccgaaacggtaacgtgggtcggctcggacctaacgttcgttcg

SEQ ID NO: 414231 - DNA, 575 bp, Homo sapiens
  misc_feature: GZ8MTXP01EEVIP.3.36.D03.1.454.CMB.2.raw
  modified_base (445)..(445): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtcctccgaggggagagacgccaccctctccgtgccggggccagtcagagtcgttcccagctaactatatagcctggtaccagcacaaagtgctggccgcccaggctcctcatctatgatacattcaccaggcccatggcactccggacaggttccaggagcgagtacggggtaatgggaacagtaaccttcactctacacatcagcagactaggagccgtaggagttatttcgactaagtttatacgtgggtacngtactagtatagtactcaactaaccgtggaccgtaggggcaacgcgttagggaagttaaagttaaacggacgttaaacgttggacggtcgttacggaacctaacctacggttcttcgtttccgtttaacc

SEQ ID NO: 414232 - DNA, 604 bp, Homo sapiens
  misc_feature: GZ8MTXP01DN74D.3.36.D03.1.454.CMB.2.raw
  modified_base (139)..(139): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccngatacgaccggagaaattgtgtgacgcagtctccagccacccctgtctttgtctccgaggggagagacgccacctctcctgcggggccagtcagagtgtcccagcaactatatagcctggtaccagcacaaagtggctggcgcccaggctcctcatctatgatacattcaccagggcccaactggcatccccgggacaggttccaggaggcgaaggtggggtaattggggaactaggacctttacacttctcgaccaatcagcaagacgtgggatcccgtagggtagtaagttttggactaggtttattaactgggttcagtcgagttagttcggtacctttacaacctaaaccgttccggaccgaacggggtacgaacggtacgttagggaaggttaattaaaggacggaaaccgttggttggtccgtgtaaccaccctagttcttaaccggttcttttaaccg

SEQ ID NO: 414233 - DNA, 600 bp, Homo sapiens
  misc_feature: GZ8MTXP01EEQ7C.3.36.D03.1.454.CMB.2.raw
  modified_base (203)..(203): a, c, t, g, unknown or other
  modified_base (350)..(350): a, c, t, g, unknown or other
tcagagacgcactccacgaccggtgctcgatttagctgcgtcacgatctctcttggggggaggaactgctcagttaggacccagagggaaccatggaaaccccagcgcagcttctcttcctcctgctactctggctcccagatacgaccggagaaattgtgttgacgcagtctccagccaccctgtctttgctccgagggganagacgccaccctctccgtggccggggccagtcagagtcgtcccagacaactatatacgcctggtaccagacaactaaaggtcggcctggccgcccaggcctcctcatctatgatacattcacgaggcccagtcggcacgtcccgganacggtccaggagcgaggtgggtaatgggaacagtacttcactctacacatcagcaggactgggacgtccgtaggacgttagttttagacttaagtttaattacgttgggtacagtctaagttacttaggttaccttacgaaacgtaaacccgttcgggaaccgaggggtaaccaacgtacgttagggaacttaagttaacggacgttaacgttggttacgctcgaactacctattcgttcgttctaaccg

SEQ ID NO: 414234 - DNA, 702 bp, Homo sapiens
  misc_feature: GZ8MTXP01AMD94.3.36.D03.1.454.CMB.2.raw
  modified_base (202)..(202): a, c, t, g, unknown or other
  modified_base (292)..(292): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccagggganagacgcccaccctctcctggcggggccagtcagagtcgttcccagcaactatatgcctggtaccagcacaagtgctggccgccaggctcncatctatgatacattcaccgagggcccagtcggccacgtccccggatagggttccccaggacgggcgtagggtacgggtaagtcggggaactaacgggacctttcaaccttccgtcaaaccctattcccgaaaggcctaaacggacgttagggacggtacccgttaggggtaaagtttagtttttacggactttaaaggttttaatttaccgttggggttaccaggtaccgtaagttaagtttcggttaaccttaccgtaaaccgttaaacccgtttccgggaccggtaaacgggggtaccaaccgggtacgttaaggggaaacgttaaaggtttaaacgggcccgttaaaggttcggttaacgggtccttacggaactacccgttattccgttccgttcgtttaacccg

SEQ ID NO: 414235 - DNA, 582 bp, Homo sapiens
  misc_feature: GZ8MTXP01BOBMW.3.36.D03.1.454.CMB.2.raw
  modified_base (569)..(569): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgaggggagagacgcccaccctctcctggcggggccagtcagagtgttcccagcaactatatagcctggtaccagcaacaaagtcggcctggccgcccaggcctcctcatctatgactacattcaccgagggcccagtcggcacgtcccggacaggttccaggaggctaggtgggtaatggggaactagtacttcactctacaccatcagcagacgtggacgccgtaggattagttttgcttaaggttttacttacgttcgggtactagtctagttagtcggttacttaccaactaaaccgttccggaccgaggggaactaacggacgttggaacgttagttaaacgcgttaacgttggttacggctcgcacgtnttctcgttctaac

SEQ ID NO: 414236 - DNA, 639 bp, Homo sapiens
  misc_feature: GZ8MTXP01EW9RR.3.36.D03.1.454.CMB.2.raw
  modified_base (202)..(202): a, c, t, g, unknown or other
  modified_base (295)..(295): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccagggganagagcccaccctctcctggcggggccagtcagagtgttcccagcaactatatagcctggtaccagcacaaagtggcctggcgcccaggctccncatctatgatacattcaccgaggccactggcactcccggacaggttccaggagcagtgggtaatgggaacagacttcactctcacatcagcagactgggacgtccgtaggtacgtattttggacttaaggttttaacttacgttgggttacctaggtacctaaggttattacgggttaacctttaccgaaaccgtaaacccgtttccgggaccggaaacgggggtaaccaacggtaaccgttaggggtaaagttaacgtttaaaacggacccgttaaagttcgggttacgggtaaccttaggaaccctaaacccgttacgttaccgttaacgtttccgttaacg

SEQ ID NO: 414237 - DNA, 598 bp, Homo sapiens
  misc_feature: GZ8MTXP01CYFZH.3.36.D03.1.454.CMB.2.raw
  modified_base (202)..(202): a, c, t, g, unknown or other
  modified_base (301)..(301): a, c, t, g, unknown or other
  modified_base (513)..(513): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgctccaggggganagacgcccaccctctcctggcggggccagtcagagtcgtcccagcaactatatacgcctggtaccagcaacaaagtggcctggccgcccaggcctcctnatctatgatacattcaccgagggacccacgtcggacacgtcccggatacggttccaggaggcgtaggtgggtaatgggaacagtacttacacctctacacatcagacaagacgtaggacgtacgtggtatagtttagacttagtttattacgttggtactagtactagtatacgtactacaaaccgtaacgttccggaccgtacggggaacncggtaacgttagggaattaacgttaaaggacgttaacgttggttacggtctcggaacctacctattccgtaacgttcgtttaacc

SEQ ID NO: 414238 - DNA, 562 bp, Homo sapiens
  misc_feature: GZ8MTXP01A9DIO.3.36.D03.1.454.CMB.2.raw
  modified_base (342)..(342): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgaggggagagagccaccctctcctggccggggccagtcagagtgttcccagcaactatatagcctggtaccagcaacaaagtggcctggccgcccaggcctcctcatctatgatacattcaccgaggcccagtggcacgtcccgganacggttccaggaggctaggtgggtaatgggaacagacttcactctcacatcagcagactggagtccgtaggtacgtatttgcttagtttattactggtcagtctagtagtcgtacttacgaactaaaccgttcggaccgtacggggacaacggaacgttggacgaagttaaacggcgttaagttggttcggctgaaccacctagttcttcgttccttccg

SEQ ID NO: 414239 - DNA, 603 bp, Homo sapiens
  misc_feature: GZ8MTXP01DIZNX.3.36.D03.1.454.CMB.2.raw
  modified_base (298)..(298): a, c, t, g, unknown or other
  modified_base (340)..(340): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgaggggagagacgcccaccctctcctggcggggccagtcagagtgttcccagcaactatatagcctggtaccagcacaaagtggcctggcgcccaggctcctnatctatgatacattcaccgagggcccagtggcactcccgganaggttccaggaggcgaggtgggtaatgggaacagtacttcactcctacacatcagcagacgtggagccgtaggacgttatttgacgttagttttacttacgtggtacagtctaagttattggttaaccttcaaacctaaccgttccgggaccgaacgggggaaccaacggtaacgttgggtaacgttaaagttaaacggacgttaaacgttgggttacggtcgttacgcctaacccgattaccgttaacgttcctttaacccg

SEQ ID NO: 414240 - DNA, 538 bp, Homo sapiens
  misc_feature: GZ8MTXP01B0DYW.3.36.D03.1.454.CMB.2.raw
  modified_base (204)..(204): a, c, t, g, unknown or other
  modified_base (284)..(284): a, c, t, g, unknown or other
  modified_base (294)..(294): a, c, t, g, unknown or other
  modified_base (333)..(333): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgaggggganagagccaccctctcctggcggggccagtcagagtgttcccagcaactatatagcctggtaccagcacaaagtgcctggcnccagctcctnatctatgatacattcaccgaggcccatggcatcccgganagggttccaggagcaggtgggtaatgggaacagacttcactctacacatcagcagacgtggagccgtaggtagtattttgactagtttattactggtcagtcagtatggtacttcaactaaaccgtcggaccgagggacaacgacttggagagttaaagcgttaacgttggttcggctcgaactaccgattcgtcgttcgttaac

SEQ ID NO: 414241 - DNA, 631 bp, Homo sapiens
  misc_feature: GZ8MTXP01BELBZ.3.36.D03.1.454.CMB.2.raw
tcagagacgcactccacgaccggtgctcgatttagctgcgtcacgatctctcttgggggaggaactgctcagttaggacccagagggaaccatggaaaccccagcgcagcttctcttcctcctgctactctggctccagatacgaccggagaaattgtgttgacgcagtctccagccaccctgtctttgtctccgaggggagagacgccaccctctcctggcggggccagtcagagtgttcccagcaactatatagcctggtaccagcaacaaagtggcctggccgccaggcctcctcatctatgaactacattacaccgacgggcccacgtggcacgtcccggatacggttaccaggaggctagggtgggtaagtacgggcagtacttccactctacacatcagctaacgcgtaggacgtccgtagggacgttagtttaggacttaagttttaacttacgttagggtacctaggtacctaagggtttactacggttaaccttacgaaacccgtaaaccgttccgggacccgtaagggggaccaacggtacgttagggtaaagttacgttaaacggcgttaaacgttggttacggtctacgctacccgtattccgttgttcccgtttaacg

SEQ ID NO: 414242 - DNA, 690 bp, Homo sapiens
  misc_feature: GZ8MTXP01EJJX7.3.36.D03.1.454.CMB.2.raw
  modified_base (204)..(204): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtcttttgcctccgagggganagacgccaccctctcctggccggggccagtcagtagtcgttcccagcaactatatacgcctggtaccagcaacaaagtggcctggccgcccaggctcctcatctatgatacacttacaccgagggccctaacgtcggccacgttaccccggaactacgggtttccccgaaggtacgggaccgtaggggttacgggggttaaacgtaggggaacctaaggtaaccctttaccgaccgttacctaccaaccctagtaccagacccaaggaccgttacgggacgtacccgttagggtaagttagttttcgacgttaaggttttattaccgttaggggttactaggtacctaaggttagttcggttacctttacgaaaccttaaacccggttcgggaccgaacgggggacaacggtacgttagggaagttaagttaacggacgttaacgttggttacggctgcctaacgcttcttaacgttcgtttaacc

SEQ ID NO: 414243 - DNA, 566 bp, Homo sapiens
  misc_feature: GZ8MTXP01A72LC.3.36.D03.1.454.CMB.2.raw
  modified_base (301)..(301): a, c, t, g, unknown or other
  modified_base (338)..(338): a, c, t, g, unknown or other
  modified_base (555)..(555): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatacgcctggtaccagcacaaagtggcctggcgcccaggctcctcatctangatacattcaccgagggcccacgtggcactcccgganaggttcccaggaggcgaggtgggtaatggggaacagtacttcgactctacaccatcagcagactgggagccgtaggtacgtattttgactagtttaattactgggtacagtcagttactggttaccttagaacctaaaccgttccggaccgtacgggggacaacggacgttggaacgagttaacggacgttaagttggttacgggctggccaccgtnttctcgttctc

SEQ ID NO: 414244 - DNA, 549 bp, Homo sapiens
  misc_feature: GZ8MTXP01EWPDN.3.36.D03.1.454.CMB.2.raw
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagtggcctggcgcccaggcctcctcatctatgatacattccaccagggcccactggcagtcccggacaggttccaggaggcaggtgggtaatgggaacagacttcactctacaccatcagcagacgtggagtccgtaggagtatttgacttagtttattactggtcagctagtatgtacttcactaaaccgttcggaccgaggggacaacggacttgggaacgttagttaaacggcgttaacgttggttaggctggccaccagttcctgttccctaacc

SEQ ID NO: 414245 - DNA, 710 bp, Homo sapiens
  misc_feature: GZ8MTXP01A2QFV.3.36.D03.1.454.CMB.2.raw
  modified_base (203)..(203): a, c, t, g, unknown or other
  modified_base (299)..(299): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgagggganagacgccaccctctcctggcggggccagtcagagtcgttcccagcaactatatagcctggtaccagcacaaagtcgcctggccgcccaggctcctnatctatgatacattcaccgaggccacgtgacactacccgaacacggttaccaggaggacgtaggtgggtaaacgtcggggaacaggtacctttaccgaccttcctaccaacctacttccgaacgacgaacggacgttagggacgtacccgttgggtaaacgttagtttttacggacctttaaggttttaactttacgttacgggttaccgtaaggttaccgttaagggtttaacgttacgggtttaaccctttaacccgtaaacccgttaaaccccggtttaccggggaacccgtaacgggggtaaccctaaacgggtaacgttacgggtaaacgttaaacgtttaaacggacgttaaacgttgggacgtcgtacgccgtaacctacgttccttaacggttcctttaaccg

SEQ ID NO: 414246 - DNA, 622 bp, Homo sapiens
  misc_feature: GZ8MTXP01DGJ81.3.36.D03.1.454.CMB.2.raw
  modified_base (253)..(253): a, c, t, g, unknown or other
  modified_base (300)..(300): a, c, t, g, unknown or other
  modified_base (382)..(382): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgagggggagagacgcccaccctctcctggcggggccagtcagagtgttcccagcaatntatagcctaggtaccagcacaagtcggcctggcgcccaggcctcctnattcatgatacattccgaccgagggcccacgggcacgttccccggataggttccaggacggcagggtgggtatacggggacnggtacttcaccgttcaccgacatcgagctagacgtggacgcgtagggtagttagttttggacttagtttacttacgtcgtacggtacgtacgtaagttacgtacggttaccttaccgtaacgtaaacccgttcggacggtaacggggtacaacggtaacgtagggttaacgtaaacgttaaggacgtaacgttggttcggttccgtgacctaaccgtatcccgttgttccttcgtaaccg

SEQ ID NO: 414247 - DNA, 831 bp, Homo sapiens
  misc_feature: GZ8MTXP01AFUKM.3.36.D03.1.454.CMB.2.raw
  modified_base (204)..(204): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtcctccgagggganagacgccaccctctccgtggcggggccagtcagagtcgttcccagctaactatatacgcctaggtaccagacaacgtaaaggtcggcctggccgcccgaggtcctcctctactctatgaactacctacttaccgaccgtacgggcccaacgtcggacctaaccgtaccccgaaacgtacgggttacccgaaggtacggtacggtagggttagggggtaaagttaacggggggaacctaacgggttaaccctttacccgtaaacccttcccgtaaacccaaaccccgtaacgttacccgaacggtaccgaaacgtacgggttacgggaaccggtacccgggttagggttaacgtttagtttttacggaaccgtttaaaggttttaacgtttaacgtacgggggttaacgtaagggtaaccgttaaacgggtttattaacggggttaaccctttaacccgtaaaacccgttaaacccggttccggggaaccccgggtaaacgggggtaaacctaaccgggtaaacggttagggtaacggttaaagttaaaccgggacgttaaacgttcgggttcggttaaccgtcggaacccgtaaccctacgtttaccgttcgttttcccgtaacccg

SEQ ID NO: 414248 - DNA, 637 bp, Homo sapiens
  misc_feature: GZ8MTXP01DO4X0.3.36.D03.1.454.CMB.2.raw
  modified_base (159)..(159): a, c, t, g, unknown or other
  modified_base (202)..(202): a, c, t, g, unknown or other
  modified_base (268)..(268): a, c, t, g, unknown or other
  modified_base (274)..(274): a, c, t, g, unknown or other
  modified_base (288)..(288): a, c, t, g, unknown or other
  modified_base (301)..(301): a, c, t, g, unknown or other
  modified_base (346)..(346): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgngttgacgcagtctccagccaccctgtctttgctccgagggganagacgccaccctctcctggcggggccagtcagagtcgttcccagcaactatatacgcctggtaccngacaanaagtgcctaggccncccaggcctcctnatctatgatacattcgaccagggtcccagtggacacgtcccgganacggttcaggtaggctaggtgggtaaatcgggaactaggtaaaccttcgaactccgtacaacctataccgaagccgaagaccgtaggacgtccgtaggtagtacttttgagttagtttattacgtggggtacagtcgtaagtacgttagtacttacgaaaccgtaaccttcgggacccgtaaggggacctaacggtacgttagggtaaagaacgttaaacggccgttaaacgttggttaccggtcttacggaaccgtaacccgttattcccgtttaagttccgttaacccg

SEQ ID NO: 414249 - DNA, 616 bp, Homo sapiens
  misc_feature: GZ8MTXP01AM1SL.3.36.D03.1.454.CMB.2.raw
  modified_base (204)..(204): a, c, t, g, unknown or other
  modified_base (296)..(296): a, c, t, g, unknown or other
  modified_base (602)..(602): a, c, t, g, unknown or other
tcagagacgcactccacgaccggtgctcgatttagctgcgtcacgatctctcttggggggaggaactgctcagttaggacccagagggaaccatggaaaccccagcgcagcttctcttcctcctgctactctggctcccagatacgaccggagaaattgtgttgacgcagtctccagccaccctgtctttgtctccgagggganagacgccaccctctccgtggcggggccagtcagagtcgttcccagacaactatatacgcctggtaccagcaacgtaaaggtcggctgggccncccaggctcctcatctatgatacattaccaccgaggcccagtcggacacgtcccggatacggttcccaggacggcgtagggtggggtaaagacgggaacacgtaccttcacgtctaccaactatcgacgacacggtacgtgggacgtccgtaggagttactttggactttagtttattacgtggtacgagtacgtaagttagtcgttacttacaaccgttaaaccgttccgggacgacggggacaacggtaacggttggtaacttagttaacggcgttaacgttggacgggctacggcctaacgtnttcgttcgttctcg

SEQ ID NO: 414250 - DNA, 621 bp, Homo sapiens
  misc_feature: GZ8MTXP01DJSHG.3.36.D03.1.454.CMB.2.raw
  modified_base (153)..(153): a, c, t, g, unknown or other
  modified_base (282)..(282): a, c, t, g, unknown or other
  modified_base (311)..(311): a, c, t, g, unknown or other
  modified_base (601)..(601): a, c, t, g, unknown or other
tcagagacgcactccacgaccggtgctcgatttagctgcgtcacgatctctcttggggggaggaactgctcagttaggacccagagggaaccatggaaaccccagcgcagcttctcttcctcctgctactctggctcccagatacgaccgganaaatttgtgttgacgcagtctccagccaccctgtctttgtctccgagggggagagacgcccaccctctccgtggccgggccagtcagagtcgttcccagctaactatatacgcctaggtaccagacaanaagtcggcctggccgcccaggcctacctnatctatgatactattccaccgagggccctagtcgggacctacgtccccggatacggttaccaggaggcgtagggtggtaaactgggaacacgtacttacaccttcgacactatcagacagactgggacaccgtaggattatttgacttagtttattacgtggggtacagacgtaagtacgtaggttacttaccgtaaactaacccgttcggaccggaacggggacctaacgtacgttagggaaattaacgttaaacgcgttaacgttggttaggtaacctagtccacctnttaccgttcgttcgttaacg

SEQ ID NO: 414251 - DNA, 483 bp, Homo sapiens
  misc_feature: GZ8MTXP02GMKP3.3.36.D03.1.454.CMB.2.raw
  modified_base (279)..(279): a, c, t, g, unknown or other
  modified_base (329)..(329): a, c, t, g, unknown or other
  modified_base (364)..(364): a, c, t, g, unknown or other
tcagagacgcactccacgaccggtgctcgatttagctgcgtcacgatctctcttggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccacctctcctgcgggccagtcagagtgttcccagcaactatatagcctggtaccagcacaaagttgcctggcncccaggctcctcatctatgatacattcaccagggccactggcatccgganggtccagagcagtggtatgggacagacttcactcncaccatcagcagactggagctggagatttgcagtttatactgtcagcagtatgtattcacaaacttcgaccagggacacgactgagataagcgaactgtggctgcaccatctgtcttac

SEQ ID NO: 414252 - DNA, 497 bp, Homo sapiens
  misc_feature: GZ8MTXP02IYLJT.3.36.D03.1.454.CMB.2.raw
  modified_base (333)..(333): a, c, t, g, unknown or other
  modified_base (433)..(433): a, c, t, g, unknown or other
tcagagacgcactccacgaccggtgctcgatttagctgcgtcacgatctctcttggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccacctctcctgcggggccagtcagagtgttcccagcaactatatagcctggtaccagcacaaagttggcctggcgcccaggctcctcatctatgatacattcaccagggcccactggcatcccgganaggttccagagcagtgggtatggggcagacttcactctcaccatcagcagactggagcctggagatttgcagtttattactgtcagcagtatggtacttnacaaacttcggccaggggacacgactggagattaagcgaactgtaggctgcaccatctgtcttc

SEQ ID NO: 414253 - DNA, 508 bp, Homo sapiens
  misc_feature: GZ8MTXP02JWWMK.3.36.D03.1.454.CMB.2.raw
  modified_base (202)..(202): a, c, t, g, unknown or other
  modified_base (334)..(334): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccagggganagagccaccctctcctgcggggccagtcagagtgttcccagcaactatatagcctggtaccagcacaaagttggcctggcgcccaggctcctcatctatgatacattcaccagggccactggcatcccgganaggttccagagcagtgggtatgggacagacttcactctcaccatcagcagactggagcctggagtatttgctagtttattactgtcagcagtatggtacttacactaaaccttcggacctaggggacacgacgtggagagttaagcgaacgtgtaggctgcacgatctgtcttc

SEQ ID NO: 414254 - DNA, 610 bp, Homo sapiens
  misc_feature: GZ8MTXP02JILVH.3.36.D03.1.454.CMB.2.raw
  modified_base (203)..(203): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgagggganagagcccaccctctcctggccggggccagtcagagtgttcccagcaactatatagcctggtaccagcaacaaagttggcctggccgcccaggcctcctcatctatgatacattccaccgagggcccacgtggccagtccccggataggttccagaggcaggtgggtagtcgggacagtacttcactctacaccatcagcagacgtggacgtccgtggaattagttttagacttaagttttacttaccgttggttacgagtactagggttaatcggttaaccttacgaaccgtaaacccgttcggaaccggtaaggggacctacggacgtagggaaacggtaagttaaacggacgtaaacgttggtacggaactacggaccaaccgtattccgttacgttctttaccg

SEQ ID NO: 414255 - DNA, 504 bp, Homo sapiens
  misc_feature: GZ8MTXP02G3MP2.3.36.D03.1.454.CMB.2.raw
  modified_base (334)..(334): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttgcctggcgcccaggctcctcatctatgatacattcaccagggcccactggcatcccgganaggttccagagcaggtgggtatggggacagacttcactctcaccatcagcagactggagcctggatatttgctagtttattactgtcagcagtatgtacttcacaaacttcggaccaggggacacggactggagattaagcgtaactgtagcgtgcaccatcttcgtctc

SEQ ID NO: 414256 - DNA, 501 bp, Homo sapiens
  misc_feature: GZ8MTXP02JGI8S.3.36.D03.1.454.CMB.2.raw
  modified_base (333)..(333): a, c, t, g, unknown or other
  modified_base (395)..(395): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcgggccagtcagagtgttcccagcaactatatagcctggtaccagcacaaagttggcctggcgcccaggctcctcatctatgatacattcaccagggcccatggcatcccgganaggttccagagcagtggatgggacagacttcactctcaccatcagcagactggagcctgganatttgcagtttattactgtcagcagtatggtacttacactaaaccttcggaccaggggacacgactggagattaagcgaactgtggctgacaccatctgtctttac

SEQ ID NO: 414257 - DNA, 502 bp, Homo sapiens
  misc_feature: GZ8MTXP02HS1K4.3.36.D03.1.454.CMB.2.raw
  modified_base (201)..(201): a, c, t, g, unknown or other
  modified_base (280)..(280): a, c, t, g, unknown or other
  modified_base (328)..(328): a, c, t, g, unknown or other
  modified_base (368)..(368): a, c, t, g, unknown or other
  modified_base (373)..(373): a, c, t, g, unknown or other
  modified_base (482)..(482): a, c, t, g, unknown or other
tcagagacgcactccacgaccggtgctcgatttagctgcgtcacgatctctcttggggaggaactgctcagttaggacccagagggaaccatggaaaccccagcgcagcttctcttcctcctgctactctggctcccagatacgaccggagaaattgtgttgacgcagtctccagccaccctgtctttgtctccagggganagagccaccctctcctgcgggccagtcagagtgttcccagcaactatatagcctggtaccagcacaaagttgcctggcnccaggctctcatctatgatacattcaccaggccactggcatcccgganaggttccagaggcaggtgggtatgggacagacttcactcncaccntcagcagactggagctggatatttgactagtttattactgtacagtcagtatgtacttcaactaaacgttcggccaggggacacgactgggatagtaacgcgaactggngcgtgacacatctgtacttc

SEQ ID NO: 414258 - DNA, 494 bp, Homo sapiens
  misc_feature: GZ8MTXP02H9TKG.3.36.D03.1.454.CMB.2.raw
  modified_base (320)..(320): a, c, t, g, unknown or other
  modified_base (359)..(359): a, c, t, g, unknown or other
tcagagacgcactccacgaccggtgctcgatttagctgcgtcacgatctctcttgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaacctggccaggctccaggctcctcatctatgatgcatccacaggccacggtnccagccagtcagtgcagtggtctggacagagttcactcncacatcagcagctgcagtctgagattttgactagtttatactgctagctatacaataactggcctacggctacgtacgtttcggacggacggaccaagggtgagtaagtacgaaaacgactggtacggactgacc

SEQ ID NO: 414259 - DNA, 554 bp, Homo sapiens
  misc_feature: GZ8MTXP02J04BE.3.36.D03.1.454.CMB.2.raw
  modified_base (340)..(340): a, c, t, g, unknown or other
  modified_base (492)..(492): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgaggggagagacgccaccctctcctggcggggccagtcagagtcgttcccagcaactatatagcctggtaccagcacaaagttgcctggcgccaggctcctcatctatgatacattcaccagggccacgtggcacgtccccgganaggttcccagaggcaggtgggtatggggacagacttcgactctacaccatcagcagactggacgccgtgggacgtagttttgactagtttacttactgtcagtctagtagtcgtacttacactaaaccgttcggacgagggtacacgtacgnggaacgaattaacggcgtaaacgtggtacggcgtacggcctaacctagtctacgtctttacc

SEQ ID NO: 414260 - DNA, 601 bp, Homo sapiens
  misc_feature: GZ8MTXP02IF176.3.36.D03.1.454.CMB.2.raw
  modified_base (202)..(202): a, c, t, g, unknown or other
  modified_base (277)..(277): a, c, t, g, unknown or other
  modified_base (328)..(328): a, c, t, g, unknown or other
  modified_base (409)..(409): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccagggganagagccaccctctcctgcgggccagtcagagtgttcccagcaactatatagcctggtaccagcacaagtgctgcnccaggctctcatctatgatacattcacaggcccactggcacgtccccgganaggttccaggaggcgtagggtaggtaggacgacgactacgtacctacctcctaccaactacgtacgacgacgacgtacggnggaccgtcggtaggtacgtttagtttcgtagtttaagttttacgttacgttagtacgtacgtagttagttagttacgttactaactaaacccgttaccggttccgacgggtaacgacgtaccggtaggtaggaacttaaagtaacggtacgtacggttgacgtcgacgacctacgtctacgttacttctacc

SEQ ID NO: 414261 - DNA, 642 bp, Homo sapiens
  misc_feature: GZ8MTXP02FWU4W.3.36.D03.1.454.CMB.2.raw
  modified_base (203)..(203): a, c, t, g, unknown or other
  modified_base (284)..(284): a, c, t, g, unknown or other
  modified_base (295)..(295): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgagggganagacgccaccctctcctggcggggccagtcagagtcgttcccagcaactatatacgcctggtaccagcacaagtgctggcnccaggctcctnatctatgatacattcaccgagggcccacgtggaccacgtccccggatacggttccaggacggcgaagggttggggtaagtcggggacctaggtacctttacgacctcctacacctatccaagaccagaccgtgggaacgtccgtagggtaagttaatttttggacttaaggttttaacttacgttagtcgaagtcctaaggtttacgtacggtttaaccttaccgaaaccttaaaccggttccggaccggtaacgggggaccaacgggtacgttagggaacgtaagttaaacggaccgtaaacgttgggtacggctacggacctacctagttcgtcgttcctttacg

SEQ ID NO: 414262 - DNA, 532 bp, Homo sapiens
  misc_feature: GZ8MTXP02IDP12.3.36.D03.1.454.CMB.2.raw
  modified_base (336)..(336): a, c, t, g, unknown or other
  modified_base (427)..(427): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctggcgggccagtcagagtgttcccagcaactatatagcctggtaccagcacaaagttggcctggcgcccaggctcctcatctatgatacattcaccgaggcccatggcacgtcccgganaggttccagaggcaggtgggtagtgggacagtacttcactctcacatcagcagactggagccgtggagtatttgcttagtttattactgtnagtctagtatcggtacttacacgtaaccgttgaccgagggacacgacgtaggagtaagttaacgcgaacgtgtagcgtacgaccacgtacttcgttcgtactttc

SEQ ID NO: 414263 - DNA, 542 bp, Homo sapiens
  misc_feature: GZ8MTXP02JMBBD.3.36.D03.1.454.CMB.2.raw
  modified_base (202)..(202): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccagggganagagccaccctctcctgcgggccagtcagagtgttcccagcaactatatagcctggtaccagcacaaagttgcctggcgcccaggcctcctcatctatgatacattcaccagggcccactggcatcccggacaggtcccagaggcaggtgggtatgggacagtactcactctcaccatccagcagactggaagcctggagtatttgactagtttatactggtcagctagtatggttactcgaactaaccttcggacctaagggggacctacggacgtaggaacgaagttaaacggcgtaaacgtggtaggcgtcggaccacctatcgtcgttactttccg

SEQ ID NO: 414264 - DNA, 563 bp, Homo sapiens
  misc_feature: GZ8MTXP02G9EC3.3.36.D03.1.454.CMB.2.raw
  modified_base (283)..(283): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcncccaggctcctcatctatgatacattccaccgagggcccactggacacgtccccggatacggttcccagaggcaggtggggtatgggactagacttcgactctacaccatcagcagactggagcctaggatagtttgactagtttatactgtcagctagtatggtacttacactaaccgttcgaccgaggggacacggacgtaggaacgtaagttaacggacgtaaaccgttggtacggaacgttcggacctaaccctataccgttacggttcctttacc

SEQ ID NO: 414265 - DNA, 532 bp, Homo sapiens
  misc_feature: GZ8MTXP02I2VKY.3.36.D03.1.454.CMB.2.raw
  modified_base (334)..(334): a, c, t, g, unknown or other
  modified_base (345)..(345): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttgcctggcgcccaggctcctcatctatgatacattcaccaggcccactggcactcccgganacggttccagngcaggtggtatgggacagacttcgactctcaccatccagcagacgtggagcctggagtatttgacttagtttattactgtactagactagtataggtacttacacgtaaaccttcggaccaaggggacacggacgttaggacgtaattaaacggctaacgtggagcgtagccacatctcgtacttac

SEQ ID NO: 414266 - DNA, 576 bp, Homo sapiens
  misc_feature: GZ8MTXP02F079N.3.36.D03.1.454.CMB.2.raw
  modified_base (305)..(305): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgaggggagagacgcccaccctctcctggccggggccagtcagagtcgttcccagcaactatatagcctggtaccagcaacaaagttcggcctggccgcccaggcctcctnatctatgatacattccaccgagggcccacgtgggccacgtccccggaactagggttcccaaggacggcgagggttggggtaatggggactagactttcgactcctacaccatcagcagactggagccgtgggattagtttgacttagttttatacgtgtacagctaagtataggttacttacgaacctaaaccgttcggaccgtagggacacgtacgtggaacgtagttaagccgtaagtcgtaggaacctgaccactagtctcgtcttcg

SEQ ID NO: 414267 - DNA, 513 bp, Homo sapiens
  misc_feature: GZ8MTXP02F9VUL.3.36.D03.1.454.CMB.2.raw
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccaggccactggcatcccggacaggttccagagcaggtggtatgggacagacttcactctcaccatcagcagactggagctggatattttgactagtttattactgtcagcagtatggtacttcactaaacttcggaccgaggggtacacgacgtaggaacgagttaacgcgaacgtgtaggcgtgacacatctcgtcttac

SEQ ID NO: 414268 - DNA, 605 bp, Homo sapiens
  misc_feature: GZ8MTXP02FQQL5.3.36.D03.1.454.CMB.2.raw
  modified_base (352)..(352): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctggcggggccagtcagagtgttcccagcaactatatagcctggtaccagcacaagttggcctggcgcccaggcctcctcatctatgatacattcaccgagggcccactgggccactcccggacaggttcccaggnggcaggttggggatggggacagacttcacctcctacaccatcagacagacgtggacgcctaggaagttagttttgactagttagttattacgtgtacgtaggttacttaagttcggttaacctccgtaccgttcggttctacggtcgtttacgggaccggtagggggtaacctaaggggtacggaagtacgtaacgtaaaacggtaacgttgggttacggaccgttacgacccgtaacctacgttcgtttccg

SEQ ID NO: 414269 - DNA, 551 bp, Homo sapiens
  misc_feature: GZ8MTXP02JGBRT.3.36.D03.1.454.CMB.2.raw
  modified_base (202)..(202): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccagggganagagccacctctcctgcggggccagtcagagtgttcccagcaactatatagcctggtaccagcacaagttggcctggcgcccaggctcctcatctatgatacattcaccagggcccactggcagtccccggataggttccagaggcaggtgggtatgggacagacttcactctcaccatcagcagactggagcctggagtatttgactagtttatacgttgtactagctagtataggtacttacaactaacgttcggaccgtaggggacacggtacgtaggaacgtaagttaacgacgtaaacgtggtacggtcgtacggacctaccgtatccgttacgttctttaccg

SEQ ID NO: 414270 - DNA, 536 bp, Homo sapiens
  misc_feature: GZ8MTXP02GKG2P.3.36.D03.1.454.CMB.2.raw
  modified_base (202)..(202): a, c, t, g, unknown or other
  modified_base (282)..(282): a, c, t, g, unknown or other
  modified_base (332)..(332): a, c, t, g, unknown or other
  modified_base (353)..(353): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccagggganagagccaccctctcctgcggggccagtcagagtgtcccagcaactatatagcctggtaccagcacaaagttggcctggcncccaggctcctcatctatgatacattcaccaggccactggcatcccgganaggtccagagcaggtgggtangggacagacttcactctcaccatcagcagactggagccgtggagtagtttgactagtttattactgtacagactagtataggttacttacgaactaaaccgttcggaccgaagggggacaacggacgtagggacgtaagttaaaggcgtaaacgtgtaggctagacacctatacctgtcttac

SEQ ID NO: 414271 - DNA, 550 bp, Homo sapiens
  misc_feature: GZ8MTXP02FZJ32.3.36.D03.1.454.CMB.2.raw
  modified_base (203)..(203): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgagggganagacgccaccctctcctggcggggccagtcagagtgttcccagcaactatatacgcctggtaccagacaacaaagttggcctggccgcccaggcctcctcatctatgatacattcacgaggcccatggcacgtcccggataggttccagaggcaggtgggtatggggacagacttcactctacacatcagcagactgggacgcgtgggattagtttgacttagtttattacgtgtacagctagtatagtactacaactaaccgtcggacgaggggacacggacgtaggaataagttaacggacgtaacgtggtacggaacgtcgacctacagttctcgttactttac

SEQ ID NO: 414272 - DNA, 509 bp, Homo sapiens
  misc_feature: GZ8MTXP02IYB2Z.3.36.D03.1.454.CMB.2.raw
  modified_base (283)..(283): a, c, t, g, unknown or other
  modified_base (293)..(293): a, c, t, g, unknown or other
  modified_base (328)..(328): a, c, t, g, unknown or other
  modified_base (351)..(351): a, c, t, g, unknown or other
  modified_base (384)..(384): a, c, t, g, unknown or other
  modified_base (414)..(414): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgaggggagagagccaccctctcctggccggggccagtcagagtgttcccagcaactatatagcctggtaccagcacaaagtgctggcnccagctcctnatctatgatacattcacaggccatggcatcccganggtccagagcagtggtatggganagtacttcactctcaaccatcagcagactgganctggatatttgactagtttatactgctagntagtataggtactacaactaaaccgttcggaccgaaggggactacggattagggataagttaaagcgaaacgtgtaggctgacacatctgtcttc

SEQ ID NO: 414273 - DNA, 544 bp, Homo sapiens
  misc_feature: GZ8MTXP02JHJZO.3.36.D03.1.454.CMB.2.raw
  modified_base (336)..(336): a, c, t, g, unknown or other
  modified_base (435)..(435): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaagttggcctggcgcccaggctcctcatctatgatacattcaccagggcccactggcacgtcccgganaggttcccagaggcaggtgggtatggggacagtacttcacctctacaccatccagcagacgtggacgctggagtatttgactagtttatacttgtcagntagtatggttactcaactaacgttcggaccgagggacacgacgtaggagtaattaacggccgtaaacgtgtacggctacggacctaacctatccgttacgttctttacg

SEQ ID NO: 414274 - DNA, 721 bp, Homo sapiens
  misc_feature: GZ8MTXP02J1B4W.3.36.D03.1.454.CMB.2.raw
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcgagtagtcgtaccagacaactatagtacgcgtacggtaccagacaaacgtaacggttcggaccgtcgggcccgacccgacggtccctcctactacttctagtacgtaactaactacttacccaaccggacggaccctacgtcggacaccggtcccggaagtacggtaccgagggcggacgtaggggttaggtaggtacgggacgtacgtaccttaccaccttcctaaccaaacctactaccgaacgaccgaaacggttaccggtacggggaaccgtccgggtaagggtaacgttttagttttcggaacgttttaaggttttaactacgtggtacgagtacgtaaggtttagtacgtttaccttaaccaaacccgttaaccggttcgggaaccggaacggggtacctaacggtacggtaagggaacttaaacggttacgacgtaacggttggcgtcgtacgtacaaccgttagttcgttcgttactttaccg

SEQ ID NO: 414275 - DNA, 531 bp, Homo sapiens
  misc_feature: GZ8MTXP02H4705.3.36.D03.1.454.CMB.2.raw
  modified_base (336)..(336): a, c, t, g, unknown or other
  modified_base (399)..(399): a, c, t, g, unknown or other
  modified_base (407)..(407): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgaggggagagagccaccctctcctgcggggccagtcagagtgttcccagcaactatatagcctggtaccagcacaaagttggcctggcgcccaggctcctcatctatgatacattcaccaggccactggcagtccccgganaggttccagaggtcaggtgggtatggggacagtacttcgactctcacatcagcagactggganccgtaggngtatttgctagtttattactgtactagctagtatggtactcacaacttcggactaggggactacggactggaactagttaaacgcgtaactgtcggaacgtcgactactatcgttgtactttac

SEQ ID NO: 414276 - DNA, 535 bp, Homo sapiens
  misc_feature: GZ8MTXP02JH83D.3.36.D03.1.454.CMB.2.raw
  modified_base (295)..(295): a, c, t, g, unknown or other
  modified_base (315)..(315): a, c, t, g, unknown or other
  modified_base (335)..(335): a, c, t, g, unknown or other
  modified_base (356)..(356): a, c, t, g, unknown or other
  modified_base (526)..(526): a, c, t, g, unknown or other
  modified_base (535)..(535): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggccgcccaggctccncatctatgatacattccacnggcccatggcagtcccgganaggtccagagcaggtgggtangggcagacttcactctcaccatcagcagacgtaggacgccgtagggattactttgacttagtttattacgtgtacagtctaagttagtacggtacttacaacgtaaccgttcggacgaaggggactacggacgaggagtaattaacgcgaactggtagcgtagcaccgtntcgtctctn

SEQ ID NO: 414277 - DNA, 556 bp, Homo sapiens
  misc_feature: GZ8MTXP02I5WSS.3.36.D03.1.454.CMB.2.raw
  modified_base (202)..(202): a, c, t, g, unknown or other
  modified_base (286)..(286): a, c, t, g, unknown or other
  modified_base (297)..(297): a, c, t, g, unknown or other
  modified_base (352)..(352): a, c, t, g, unknown or other
  modified_base (373)..(373): a, c, t, g, unknown or other
  modified_base (443)..(443): a, c, t, g, unknown or other
  modified_base (541)..(541): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccagggganagagccaccctctcctggccggggccagtcagagtcgttcccagcaactatatagcctggtaccagcaacaaagttgcctggcnccaggctcctnatctatgatacattcaccgagggcccagtggcacgtccccggatacggttccagnggcaggttgggtatggggacngtacttcactctacaccatcagcagacgtggacgtcgtggagttattttgattagtttatactgtacagntaggttaatggtacttcaactaaaccgttcggacgaagggacctaacggacttaggacgtaaattaaaggccgtaaacgttggagcgtcgactacgtnttacgtcgtacttac

SEQ ID NO: 414278 - DNA, 608 bp, Homo sapiens
  misc_feature: GZ8MTXP02FQ8OO.3.36.D03.1.454.CMB.2.raw
  modified_base (202)..(202): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccagggganagagccaccctctcctgcggggccagtcagagtgttcccagcaactatatagcctggtaccagcacaaagttgcctggcgcccaggctcctcatctatgatacattcaccagggcccactggcacgtcccggacaggttcccagacggcaggtgggtatggggcagacttcactctcaccatcagcagacgtggacgccgtggtagtattttgacttagtttattacgttgtacgtagtactagttagttacggttacttaccgaaaccttaaacccgttccggacccggtaacgggggaaccaaccggtacgttagggaacgtaaagtttaaacggaccggtaaacgttcggtacgggtaaccgtacggacctaacccgtatttaccgtacggtttcctttaccg

SEQ ID NO: 414279 - DNA, 575 bp, Homo sapiens
  misc_feature: GZ8MTXP02H8VB3.3.36.D03.1.454.CMB.2.raw
  modified_base (202)..(202): a, c, t, g, unknown or other
  modified_base (273)..(273): a, c, t, g, unknown or other
  modified_base (288)..(288): a, c, t, g, unknown or other
  modified_base (339)..(339): a, c, t, g, unknown or other
  modified_base (361)..(361): a, c, t, g, unknown or other
  modified_base (365)..(365): a, c, t, g, unknown or other
  modified_base (370)..(370): a, c, t, g, unknown or other
  modified_base (381)..(381): a, c, t, g, unknown or other
  modified_base (393)..(393): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccagggganagacgccaccctctccgtggccggggccagtcagagtgttcccagcaactatatacgcctggtaccagcanaaagttgcctggccncccaggcctctcatctatgatacattcacgaggccagtggcagtcccgganaggtccagaggcagtgagtagngganatctnacctcacacancagacagtacgnggacgtacgtaggtacttagtttacacgttatttagttacgtcgtacgagtagtagttagtacgttactacgaaaccgttaaccggttacgacggtaacgggtactaacggtagtaacggtaagtaaagtaacgaccgtaggtacggtaacgtacgtacgacgaacctcgtacttcgttacc

SEQ ID NO: 414280 - DNA, 574 bp, Homo sapiens
  misc_feature: GZ8MTXP02GHNI0.3.36.D03.1.454.CMB.2.raw
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggcccactggcagtccccggacaggttccagaggcaggtgggtatggggacagacttcactctacaccatcagcagacgtggagccgtggatattttgctagtttattactgtacagctagtatggtacttacaactaaacgttcggaccgtaaggggacaacggacgtagggaacgtaacgttaaacggacgtaaaccgttggtacggtaaccgttacggacctaacccgtaacttccgttacggtttccgtttaccg

SEQ ID NO: 414281 - DNA, 663 bp, Homo sapiens
  misc_feature: GZ8MTXP02IIKWK.3.36.D03.1.454.CMB.2.raw
  modified_base (313)..(313): a, c, t, g, unknown or other
  modified_base (325)..(325): a, c, t, g, unknown or other
  modified_base (327)..(327): a, c, t, g, unknown or other
  modified_base (334)..(334): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctgcgcccaggctcctcatctatgatacattcaccngggccactggcncncccgganaggtccgagaggcgtagtggtagtgggacagaacttcactctacacactacacgacgacgacgtagggacgtacccgtggggtaagtttaagtttttgtacgttaaagtttttaaactttaacgttcgttaccgttaagaccgtaggttaagttacgggttacctttactaaacctaaaacccggtttccgggtaacccgggaaacgggggaaccgaaaccgggtaccgtaagggaaacggttaaaacgacgttttaaaaagggcggaaaaccggttcgttgggggaccctttaacggcacccccgtaagttccctttacggtttaccc

SEQ ID NO: 414282 - DNA, 573 bp, Homo sapiens
  misc_feature: GZ8MTXP02F9Q1C.3.36.D03.1.454.CMB.2.raw
  modified_base (284)..(284): a, c, t, g, unknown or other
  modified_base (295)..(295): a, c, t, g, unknown or other
tcagagacgcactccacgaccggtgctcgatttagctgcgtcacgatctctcttgggggaggaactgctcagttaggacccacagggaaccatggaaaccccagcgcagcttctcttcctcctgctactctggctcccagatacgaccggagaaattgtgttgacgcagtctccagccaccctgtcctttgtctccgaggggagagacgccaccctctcctgcggggccagtcagagtcgttcccagcaactatatagcctggtaccagcacaagtggctggcnccaggctcctnatctatgatacattcaccagggcccacgtgggccacgtccccggaactacggttcccaggacggcaggtggggtaatggggacagacttacgaccttcgtacacctatcagcagacgtggacgccgtggagtactttgacttagtttattactgtctagctaaggttatcggttacttacgaactaaaccgttcggaccgaggggacacggagtacggagtagttaacgacgtaacgtggtagcgtacggacctaccgtattacgtcgttacttaccg

SEQ ID NO: 414283 - DNA, 550 bp, Homo sapiens
  misc_feature: GZ8MTXP02JWA2H.3.36.D03.1.454.CMB.2.raw
  modified_base (290)..(290): a, c, t, g, unknown or other
  modified_base (384)..(384): a, c, t, g, unknown or other
  modified_base (541)..(541): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaagtgctggcgccaggctcctnatctatgatacattcaccgagggcccacgtggacactccccggataggttcccaggaggcaggtgggtatggggacagacttcactctcacctntcagcagacgtggaagtccgtaggagttatttcgacgttaagttttattacgttcggtacaggtcctagttatggttaccttacgaactaaaccgttcggacgtaggggactaccgagtacggagtagtaacgacgaacgtgtagcgtcgacacgtntctcgtctc

SEQ ID NO: 414284 - DNA, 557 bp, Homo sapiens
  misc_feature: GZ8MTXP02FMYEF.3.36.D03.1.454.CMB.2.raw
  modified_base (202)..(202): a, c, t, g, unknown or other
  modified_base (280)..(280): a, c, t, g, unknown or other
  modified_base (292)..(292): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccagggganagagccaccctctcctgcgggccagtcagagtgttcccagcaactatatagcctggtaccagcacaaagtgcctggcncccaggctcctnatctatgatacattcaccgagggcccacgtggcactccccggactaggttccagaggcaggtggggtatggggacagacttcacgttctcaccatcagcagacgtggagccgtggagtagtttgactagtttattactgtcagctagtatgttacttcactaaaccttcgggaccgtaggggaccaacgtacgtaggagtaacttaaacggacgtaaacgttggtacggtcgtacggaccaaccctatccgttcgttcctttacg

SEQ ID NO: 414285 - DNA, 654 bp, Homo sapiens
  misc_feature: GZ8MTXP02J0OOE.3.36.D03.1.454.CMB.2.raw
  modified_base (285)..(285): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgaggggagagacgcccaccctctcctggccggggccagtcagagtgtcccagcaactatatagcctggtaccagcacaagtgcctggccncccaggcctcctcatctatgatacattccaaccacgggcccacgtggaccacgtccccggaatacggttccacggaggctaggggttgggtaagtggggacctaaggtacctttccgaacttcctaccaacctatacccgaaggtacccaaggacgttacgggaacgtcccgtaggggtaacgttaagtttttcggacttaaggtttttacttacgtgtacgagtccgtaagttattacggttaccttacgaaaccgttaaaccgttcggaccccgtaggggtaccaacggtacgtaggaacgtaacgttaaacgccgtaaagtcggtacggaacttacggacctactacgttcgtacgttcctttacc

SEQ ID NO: 414286 - DNA, 555 bp, Homo sapiens
  misc_feature: GZ8MTXP02FLSJZ.3.36.D03.1.454.CMB.2.raw
  modified_base (202)..(202): a, c, t, g, unknown or other
  modified_base (332)..(332): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccagggganagagccaccctctcctgcggggccagtcagagtgttcccagcaactatatagcctggtaccagcacaaagtgcctggcgccaggctcctcatctatgatacattcaccaggcccactggcactcccgganaggtcccagaggcaggtgggtatggggacaggacttcactctcaaccatacagcagactggagccgtgagtatttgactagtttattacgtgtcagctagttatcggtactttacaacgtaaaccgttcggaccgtacggggactaacggacgtaggaagtaagttaaacggaccgaaacgttggtaggcgtcggaccgaacctcttaccgtcgtcctttacc

SEQ ID NO: 414287 - DNA, 721 bp, Homo sapiens
  misc_feature: GZ8MTXP02GGC1F.3.36.D03.1.454.CMB.2.raw
  modified_base (205)..(205): a, c, t, g, unknown or other
tcagagacgcactccacgaccggtgctcgatttagctgcgtcacgatctctcttgggggaggaactgctcagttaggacccagagggaaccatggaagccccagcgcagcttctcttcctcctgctactctggctcccagatgccactggagaagtggtgatgacgcagtctccagccaccctgtctgtgtctccgaaggggaancgcccaccctctcctgcagggccagtcagagtatagcagcaacttgcctggaccagcacgaacctggacccaggcctacccgaggtccctcctactactctatcgctcgacctactcccgaacgaccggggccctaacgtcggtaacccctcccgacggtcccgtagggtttccgaggtcgggcgtagggttcggggtccgtagggggaacctagggttactttcgactttcccgtaccaacctacgtaccgacgaccgtacgtcccgttcgaccgttagttaccgtaaggttaaacgttttacttttacggtaactttaaagttttaacgtttactacggttaccgtaaggtaccttaaagttaaagtttaaccggttaaggttaccgggggttacggtacccgggtttaacggggaaaccccggttaaacgggggaaacccgtaaaagggtaaacgaaaaccttaacggaaaaaccgttcggtaagggtacgtacgtacgtaccgtaacttacg

SEQ ID NO: 414288 - DNA, 565 bp, Homo sapiens
  misc_feature: GZ8MTXP02JY7V8.3.36.D03.1.454.CMB.2.raw
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcgggccagtcagagtgttcccagcaactatatagcctggtaccagcacaaagttggcctggcgcccaggctcctcatctatgatacattccaccgagggcccacgtggccacgtccccggactaggttccaggaggcaggtgggtagtggggacaggacttcgactctcacctatcagcagacgtggacgccgtgggagtagttttgcttagtttattacgttgtcagctagttatcggttacttacaactaaaccgttccggacgaggggaaccacggacgtggaacgtagttaacgacgtaacgtggtcggcgttaggcctacctatccgttggtacctttacg

SEQ ID NO: 414289 - DNA, 573 bp, Homo sapiens
  misc_feature: GZ8MTXP02HVFEU.3.36.D03.1.454.CMB.2.raw
  modified_base (287)..(287): a, c, t, g, unknown or other
  modified_base (297)..(297): a, c, t, g, unknown or other
  modified_base (356)..(356): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgttctttgtctccgaggggagagagccacctctcctggcggggccagtcagagtgttcccagcaaactatatagcctggtaccagacacaaagttggcctggcnccaggcctcncatctatgatacattcaccgaggccactggcactccgataggtccagagcaggtggtangggacagacttcactctcacatcagcagcgtggagtctggactattttgactagtttattactgttcagtctaagtatagttaacttacgaaaccgtaaaccgttacggaccgtaaaagggggaccaaccggtagttaggggaaactaaagttaaaacggccgtaaaacttgggttcggaactacggactaccgtaattccgtttacgtttcttacc

SEQ ID NO: 414290 - DNA, 620 bp, Homo sapiens
  misc_feature: GZ8MTXP02GVM6H.3.36.D03.1.454.CMB.2.raw
  modified_base (374)..(374): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgttctttgtcctccgaggggagagacgcccaccctctccgtggccggggccagtcaggagtcgttcccagcaactatatacgcctggtaccagcaacaaaggttcggcctgggccgcccaggcctcctcatctatgatactatacacgcggccatcgacactcccggataggtccagaggcaggtgggtangggacagtacttcacctctacacatcagccagacgtggacgtccgtagggacgttagttttagactttaagttttaacgtacgttagtactaggtactaagggttatcggttaaacttaccgtaaacgtaaaccggttccgggaccggtaaacggggaacctaacggaccggtagaacgtaacggtttaaacgaccggtaacgtggtacgtcgtaggaaccctacgactttcggtacttccttacg

SEQ ID NO: 414291 - DNA, 731 bp, Homo sapiens
  misc_feature: GZ8MTXP02HU59A.3.36.D03.1.454.CMB.2.raw
  modified_base (203)..(203): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgagggganagacgccaccctctccgtggccgggccagtcagtagtcgttcccagacaactatatagccctggtaccagcaacgaaagttcggcctggccgcccaggcctcctcatctatgactaactattccacgacgggcccacgtcggacacgtccccggaatacgggttaccaacgggtacggcgtaaggggttaggggtacgttaggggacctaaggtaccctttacgaaccgttaccctacgaaaaccctagttccaaacgggtaccaaagggtacccgttaggggaaaccgtcccggtttagggggtaactttaacgtttttgggaaccttttaagtttttaaatttccggtttaagtaccgttaaggtaccgttaaaggttactttaacgggttaacctttaccgaaacgtttaaacccgttcgggaacccgaacgggggtaaccacggtacggttaggaaagtaaacgttaaacggcgtaaacgtcgtaggtaacctaggaccctacgtacttcctcgtttcttaccg

SEQ ID NO: 414292 - DNA, 587 bp, Homo sapiens
  misc_feature: GZ8MTXP02JRU9E.3.36.D03.1.454.CMB.2.raw
  modified_base (388)..(388): a, c, t, g, unknown or other
  modified_base (435)..(435): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgaggggagagacgccaccctctcctgcggggccagtcagagtcgttcccagcaactatatagcctggtaaccagacaacgaaagttcggacctggccgccccaggcctcctcattctatagatacacttccaaccgagggcccacgtggaccacgtcccggataggttcccaggagcgaggtgggtatggganagacttcactctcaccatcagcagacgtggagctgggattactttgntaagtttaattccgtgttacgagcttaggtaattggtaccttacgaaaccgttaaccgtcggaccgtaagggaccacggtacgtaggtaacgaaagtttaacggaccgtaacgtgtcggaactcggaccactagttcctacgttaccttccg

SEQ ID NO: 414293 - DNA, 656 bp, Homo sapiens
  misc_feature: GZ8MTXP02FQ6D8.3.36.D03.1.454.CMB.2.raw
  modified_base (203)..(203): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgagggganagacgccaccctctcctggcggggccagtcagagtcgttcccagcaactatatagcctggtaccagcaacaaagttggcctggcgcccaggctcctcatctatgatacattcaccaggcccatggcacgtccccggataggttccagaggcaggtggggtatggggacagacttcaactctacaccatcagcagactggacgtccgtggagttagttttgacgtagttagttaactttacgttacgtacgtagggttaccttaagttacgggtttaaccttacgtaaccccgtttacggggtttcctaacggttccgttttacggggacccggtaaacgggggtaacccggtaaaagggggttacgggaaaggtaacgtaaaccgtaaaaacggtaaaccggtgggttacgggtacgttacgggacctaacccggtaacgtttcctttaccgg

SEQ ID NO: 414294 - DNA, 641 bp, Homo sapiens
  misc_feature: GZ8MTXP02I3TLZ.3.36.D03.1.454.CMB.2.raw
  modified_base (281)..(281): a, c, t, g, unknown or other
  modified_base (501)..(501): a, c, t, g, unknown or other
  modified_base (518)..(518): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccagggtgagagccaccctcctcctcgtcggggccggacgtcacgaagtgttcccgtacgacaactaactatagacctcggtacgacncacaaagtagccgcgtcgcccacggctcctccatctactagactaactacttcaaccgacgggcccgaacctacggtcgaacctacccgggtaccgtaaggttacccgtaacgagggcgtaacggtggggttagacgggtcgacgtaacgttacctactcctaccaacctactacgacgaccaagaacgttcggaggacctcggggtaataagttttcgngtaagtttaaatttccncgtacgagtacagttagtcgttaacgttaccaacgtaaccgttacggacggtaacgggactaacgagtagtaacgtacgtaaacgacgacgtaggtcgaacgtacgacactatcttacgtctc

SEQ ID NO: 414295 - DNA, 729 bp, Homo sapiens
  misc_feature: GZ8MTXP02I8RI9.3.36.D03.1.454.CMB.2.raw
  modified_base (308)..(308): a, c, t, g, unknown or other
tcagagacgcactccacgaccggtgctcgatttagctgcgtcacgatctctcttggggggaggaactgctcagttaggacccagagggaaccatggaaaccccagcgcagcttctcttcctcctgctactctggctcccagatacgaccggagaaattgtgttgacgcagtctccagccaccctgtctttgtctccgaggggagagagccaccctctccgtggccggggccagtcagagtcgttcccagacaactatatagcctaggtaccagacaacaaagttcggcctggccgcccgaggcctccncatctatgatacattcacgacggccacgtcggcacgtccccggaatacggtccaggacggcgtagggttggtagtcgggacgaggtaccttcgaccttcctaccaaccgtataccgaagaccgaagacggtcgggaacgtccggtagggtaacgttagtttttacggacgtttaacggttttaactttacgttacggttacgtaaggtaccttaagggttaagttaccgggtttaaccttaacgtaaaaccccggtttaaaacccggtttcccgggaaaccgggtaaccgggggtaaaccctaaccggggtaaccggttagggtaaacgtaaaacggtttaaccggaaccggttaaacgtacgggttacgggtaaccttacgacccgtacctaacgtttccgttacgtttaccctttaacg

SEQ ID NO: 414296 - DNA, 750 bp, Homo sapiens
  misc_feature: GZ8MTXP02GWYP1.3.36.D03.1.454.CMB.2.raw
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccacccttgtctttgtcctccgaggggagagagcccaccctctccgtggccggggccagtcagagttcgttcccagaccaatatatacgccgtacggtaccagacaacgtaaagttcggccgtcggaccgcccgaggtcctcctcattctatagactactacttacgaaccgacggcccacgtggaccacgtacccggacgtacgtccgaaggacggtacgaggggttgggtagtcggggactacgtacttcaccttacctacacccgtatacgacgtacgaagtacggtaggacgtccggttaggtaagtttacgttttagaccgtttagtttttaaacgtttcgtacgttaacgtacgtacggtttaaacgtttacgtaccggtttaacttaaccctaaaaccggttaaaccccggttaccggggaaccgggaaacgggggttaaacccgaacgggtaacggttaacggggtaaacggttaaacggttaaacggtaccgttaaacggtcgggtacgggtaacttaccggacccttaaaccggtttacgtaccggtttacgttacctttaccg

SEQ ID NO: 414297 - DNA, 611 bp, Homo sapiens
  misc_feature: GZ8MTXP02HUFMX.3.36.D03.1.454.CMB.2.raw
  modified_base (204)..(204): a, c, t, g, unknown or other
  modified_base (273)..(273): a, c, t, g, unknown or other
  modified_base (287)..(287): a, c, t, g, unknown or other
  modified_base (296)..(296): a, c, t, g, unknown or other
  modified_base (424)..(424): a, c, t, g, unknown or other
  modified_base (583)..(583): a, c, t, g, unknown or other
tcagagacgcactccacgaccggtgctcgatttagctgcgtcacgatctctcttgggggaggaactgctcagttaggacccagagggaaccatggaaacccccagcgcagcttctcttcctcctgctactctggctcccagatacgaccggagaaattgtgttgacgcagtctccagccaccctgtctttgtctccgagggganagagccaccctctccgtggcggggccagtcagagtcgtcccagccaatatactagcctggtaccagcanaaagttgcctggcnccaggctcnatctatgatacattcaccgaggaccacgtcggctacgtcccggaataggttcccgagacggcgagggttacgggtaggaggggacctaggtacttcaccttcaccaactatcgacgtacacggtaacncgggactacgtagggtagttaagtttcggtattaaacgttttattacgtcgtaacgtagtacgttagtaagtttcggtaactttaccaaaccgttaaaccgttcgggtaccggaacggggaccctaggtacgtaggaaacgttagtaaacggcgtaagnggtcgaagtcgactaccatcgtatctac

SEQ ID NO: 414298 - DNA, 547 bp, Homo sapiens
  misc_feature: GZ8MTXP02I3ZRQ.3.36.D03.1.454.CMB.2.raw
  modified_base (203)..(203): a, c, t, g, unknown or other
  modified_base (314)..(314): a, c, t, g, unknown or other
  modified_base (353)..(353): a, c, t, g, unknown or other
  modified_base (366)..(366): a, c, t, g, unknown or other
  modified_base (372)..(372): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgagggganagagccaccctctcctggccggggccagtcagagtcgtcccagcaactatatagcctggtaccagacaacgaagttcggcctggccgcccaggctcctcatctatgatacnttcacgaggcccagtggcacgtcccggatacggtccagngcaggtgggtagngggacngacttcactctcaccatcagcagacgtggacgtctaggagttatttgacttagtttatacgtgtcagtctagtatcgtactacaactaacgtcggacgaggggacacggtacgtaggaagtaacgttaacgacgtaacgtggtaaggcgtagtacactattcgtacgttcttacg

SEQ ID NO: 414299 - DNA, 583 bp, Homo sapiens
  misc_feature: GZ8MTXP02H89J0.3.36.D03.1.454.CMB.2.raw
  modified_base (203)..(203): a, c, t, g, unknown or other
  modified_base (357)..(357): a, c, t, g, unknown or other
  modified_base (393)..(393): a, c, t, g, unknown or other
  modified_base (395)..(395): a, c, t, g, unknown or other
  modified_base (400)..(400): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgttctttgtctccagggganagagccacctctccgtgccgggccagtcagagtcgttcccagcaactatatagcctggtaccagcaacgaagttcggacctggccgcccgaggctcctcatctatgatacattacaccgacggccacgtggcaccgtccgagtacgtcgagcgngtaggtggtagaggactgtactctacctctacactncnacganaggagcgtcgtaggtatttgttgtagttagttacgttatgagtagcgtagttacgtacgttacctacgtaaccgtaacgtcggaacggtacgggaacctacggaagtaggtaaacgtaagtaaaccggtcgtaaaccgttggacccgtgtaccggtactactagttcgttacttacgttcccg

SEQ ID NO: 414300 - DNA, 570 bp, Homo sapiens
  misc_feature: GZ8MTXP02I4K5K.3.36.D03.1.454.CMB.2.raw
  modified_base (202)..(202): a, c, t, g, unknown or other
  modified_base (381)..(381): a, c, t, g, unknown or other
  modified_base (385)..(385): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgctccgagggganagagccaccctctcctggccggggccagtcagagtcgttcccagcaactatatagcctggtaccagcacaagtgctgcgccaggctcctcatctatgatacattcaccagggccacgtggcacgtccccggataggttccagaggcaggtgggtatgggctagacttcgactctcaccntcancagactggacgcgtggatatttgacttagtttattatgtccagtctagttacttaggtacttacgactaaaaccgttcggacgtaaggggacctaacgtacgtacggaagtaataaacggtacgaaaacgttcggtaacggccgttacggaccgtaaccacgtttacctcggtttactttacccg

SEQ ID NO: 414301 - DNA, 206 bp, Homo sapiens
  misc_feature: GZ8MTXP02IL8Z6.3.36.D03.1.454.CMB.2.raw
  modified_base (201)..(201): a, c, t, g, unknown or other
tcagagacgcactccacgaccggtgctcgatttagctgcgtcacgatctctcttggggaggaactgctcagttaggacccagagggaaccatggaaaccccagcgcagcttctcttcctcctgctactctggctcccagatacgaccggagaaattgtgttgacgcagtctccagccaccctgtctttgtctccagggganagacg

SEQ ID NO: 414302 - DNA, 628 bp, Homo sapiens
  misc_feature: GZ8MTXP02FSN4Q.3.36.D03.1.454.CMB.2.raw
  modified_base (203)..(203): a, c, t, g, unknown or other
  modified_base (284)..(284): a, c, t, g, unknown or other
  modified_base (303)..(303): a, c, t, g, unknown or other
tcagagacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccgagggganagagccaccctctcctggcgggccagtcagtagtcgttcccagcaactatatacgcctggtaccagcacaagtgcctggcnccaggctcctcatcctatnatactattccaccgagggcccatcgggccacgtcccgggaactaggttccccaggtacggcgtagggtggggtaagtggggacaggtactttcacttcctacaccatcagcagaacgtggacgccgtggacgttagtttcgacgttagttttacgttaacttcggttacacggtatagttaagttacggtaccttacaaacttaaacccgttcgaacgggaacgggactaacggtacgtaagggtaagtaaacgttaacggaccgttaaaccggtggttaaacggcgtttaccggacaaccttacgtcgttacgtactttacccc

SEQ ID NO: 414303 - DNA, 535 bp, Homo sapiens
  misc_feature: GZ8MTXP01AUZSP.21.53.E09.1.454.CMB.2.raw
  modified_base (271)..(271): a, c, t, g, unknown or other
  modified_base (341)..(341): a, c, t, g, unknown or other
  modified_base (383)..(383): a, c, t, g, unknown or other
  modified_base (386)..(386): a, c, t, g, unknown or other
  modified_base (401)..(402): a, c, t, g, unknown or other
  modified_base (489)..(489): a, c, t, g, unknown or other
  modified_base (514)..(514): a, c, t, g, unknown or other
tcagtcgtcgctcgcacgaccggtgctcgatttagagagagtgtgttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagttggtggagtcgtgggggagcttggtcaagcctggacgggtccctgagactctcctgtgcagcctcgnggattcaccttcagtgactactacatgggctggactccgcaggctacgaggggagggctggagtggtctnatatattagtagtagtggtacgtcccgtatctacgcagactntgngaacgggccatcacnncgcaggacacgcaagactcacagtatcagccagtatcgaatacgcctaggagacggccgagggaacctcgggttccgtgttattcgnggttcgcggagaacgacgtcccggngagttgaacgttgggaaccgg

SEQ ID NO: 414304 - DNA, 553 bp, Homo sapiens
  misc_feature: GZ8MTXP02JQ3X4.21.53.E09.1.454.CMB.2.raw
  modified_base (346)..(346): a, c, t, g, unknown or other
  modified_base (537)..(537): a, c, t, g, unknown or other
tcagtcgtcgctcgcacgaccggtgctcgatttagagagagtgtgttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagttggtggagtcgtgggggaggcttggtcaagcctgggagggtccctgagactctcctgtgcagcctctggattcaccttcagtgactactacatgggctggatcccgccaggcctccgaggggaggggctgggagtgggtctnatatattagtagtagtggtacgtcccgtatctacgcagactcgtgtggaaacggggcccgtattccacccatccgcccgaggggaccaacgccaaagactcaacagtatctgcagatagaatacgcctagagacggccgaaggaccgtcgggccgttgtaacttacgtgtcgacgagaagacgtcccgggnagtggacgtcggacgg

SEQ ID NO: 414305 - DNA, 668 bp, Homo sapiens
  misc_feature: GZ8MTXP02JTRZM.21.53.E09.1.454.CMB.2.raw
tcagtcgtcgctcgcacgaccggtgctcgatttagagagagtgtgttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagttggtggagtctgggggaggcttggtcaagcctggagggtccctgagactctcctgtgcagcctctggattcaccttcagtcgactactacagtgggctggactcccgccaggcctccgaggggagggctgggagtgggtctcatatattagtagtagtggtacgtcccgtataccgtacgcagtactctggtaggaaacgggggccctaagttcccaaccacgtcccggacccgaacgggggacccaaaccggacccaaaacggaaacctccgaaacgtacggttaaattcccgagaccaaggtatagaaaagttacggccctaggaacggacggaccccgggaaagggtaccgtccgggggacccggtttaggttaacctttaacggtcggttacgggaccggaagggaacggtaccggttacccccgggggagtaagtcgggaagttcgggggaacccgggg

SEQ ID NO: 414306 - DNA, 506 bp, Homo sapiens
  misc_feature: GZ8MTXP02IOUJL.21.53.E09.1.454.CMB.2.raw
  modified_base (418)..(418): a, c, t, g, unknown or other
  modified_base (421)..(421): a, c, t, g, unknown or other
  modified_base (456)..(456): a, c, t, g, unknown or other
  modified_base (493)..(493): a, c, t, g, unknown or other
tcagtcgtcgctcgcacgaccggtgctcgatttagagagagtgtgttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagttggtggagtcgtgggggaggcttggtcaagcctggagggtccctgagactctcctgtgcagcctctggattcaccttcagtgactactacatgggctggatcccgccaggctccgaggggagggctgggagtgggtctcatatatagtagtagtggtagtcccgtatctacgcagactctgtgaggccatcacatcgcaggacaacgcaagacncanagtatctgcagatgaatagctagagagccgaggcncggtctgtacttacgtgtcgcgagaagacgtcccggnatcgagtcggacg

SEQ ID NO: 414307 - DNA, 518 bp, Homo sapiens
  misc_feature: GZ8MTXP02ICGMG.21.53.E09.1.454.CMB.2.raw
  modified_base (337)..(337): a, c, t, g, unknown or other
  modified_base (344)..(344): a, c, t, g, unknown or other
  modified_base (431)..(431): a, c, t, g, unknown or other
  modified_base (476)..(476): a, c, t, g, unknown or other
  modified_base (505)..(505): a, c, t, g, unknown or other
tcagtcgtcgctcgcacgaccggtgctcgatttagagagagtgtgttgggtttggggagctctgggagaagagccccagccccagaattcccaggagtttccattcggtgatcagcactgaacacagaggactcaccatggagtttgggctgagcttgggttttccttgttgctattataaaaggtgtccagtgtcaggtgcaggttggtggagtcgtgggggaggtcttggtcaagcctgggagggtccctgagactctcctgtgcagcctctggattccaccttcagtgactactacagtgggctggactccgcaggctccgaggggaggctggngtggctnatatattagtagtgtgtagtcccgtatactacgcagtactctggtagacgggcctatccacagtcgacagggacacgaccaaagacncacagtatctgcagatgaatgctgacgagccgaggcgtcggcgtntactacgtcgtagcgagaagctacccggnatcgagtcgggcg

SEQ ID NO: 414308 - DNA, 641 bp, Homo sapiens
  misc_feature: GZ8MTXP02GF17R.21.53.E09.1.454.CMB.2.raw
tcagtcgtcgctcgcacgaccggtgctcgatttagagagagtgtgttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagttggtggagtcgtgggggagcttggtcaagcctggaggatccctgagactctcctgtgcagcctctggattcaccttcagtgactactacagtgggctggactccgcaggctccgaggggaagggctgggagtgggtctcgatatattagtagtaggttggtacgtcccgtataccgtacgcacgtactcgtgtaggaaacggggcccgtaattccaaccctaagttcccggacccgaagggggaaccaaaacccggacccaaaagaacctaccgaacaagttactctagacaagaactagaaagttacgccttaggaagacggcccggaaggtacccgtccggggtacccgttaggttaaacgtttaccgttggttacggaccggaaaggtacgggaaaccgttcccccgggggagtaagtcgggaaagttcggggg

SEQ ID NO: 414309 - DNA, 560 bp, Homo sapiens
  misc_feature: GZ8MTXP02GJCGK.21.53.E09.1.454.CMB.2.raw
  modified_base (340)..(340): a, c, t, g, unknown or other
  modified_base (521)..(521): a, c, t, g, unknown or other
  modified_base (530)..(530): a, c, t, g, unknown or other
tcagtcgtcgctcgcacgaccggtgctcgatttagagagagtgtgttgggtttggggagctctgggagaagagccccagccccagaattcccaggagtttccattcggtgatcagcactgaacacagaggactcaccatggagtttgggctgagctggtttcctgtgctattataaaggtgtccagtgtcaggtgcagttggtggagtcgtgggggaggcttggtcaagcctggagggtccctgagactctcctgtgcagcctctggattcaccttcagtgactactacagtgggctggactccgccaggctccgaggggagggcgtgggagtgggtctnatatagtagtagtagtggtacgtcccgtatcctacgcagtacctcgtgtggaacggggcctagttccacctagtccgcccgaaggggaccaaacggacccaaagaacctcaactagtactcgtgacaggatgaaatcggcctaggacgacgcccggaggacctcgggccgttggtattcgnggtgcgagngtacgtcccggagagtggacgtcgggaccg

SEQ ID NO: 414310 - DNA, 615 bp, Homo sapiens
  misc_feature: GZ8MTXP02HPR2O.21.53.E09.1.454.CMB.2.raw
  modified_base (344)..(344): a, c, t, g, unknown or other
tcagtcgtcgctcgcacgaccggtgctcgatttagagagagtgtgttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagttggtggagtcgtgggggaggcttggtcaagcctgggacgggtccctgagactctcctgtgcagcctcgtggattcaccttcagtgactactacagtggctggactcccgcaggctccgaggggagggctggagtggtctnatatattagtagttagtggtacgtcccttaataccgtacgacagtacctcgtggtaggaaacggggcctaattcccgacctagtccggacccgaaggggaacccaaacggcccaaagaacctcaaacgtagttatcgtagacaaggtaatagaaactcgaccgtagggaacgaccggacggacggtaccgtccgggtacgttattacgttaccgtaggcgacggaaggtaacgtaccgggcccggagtagtacggaacggtcgggaaccgg

SEQ ID NO: 414311 - DNA, 563 bp, Homo sapiens
  misc_feature: GZ8MTXP02I0117.21.53.E09.1.454.CMB.2.raw
  modified_base (342)..(342): a, c, t, g, unknown or other
  modified_base (345)..(345): a, c, t, g, unknown or other
  modified_base (375)..(375): a, c, t, g, unknown or other
  modified_base (432)..(432): a, c, t, g, unknown or other
  modified_base (539)..(539): a, c, t, g, unknown or other
tcagtcgtcgctcgcacgaccggtgctcgatttagagagagtgtgttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagttggtggagtcgtgggggagcttggtcaagcctgggacgggtccctgagactctcctgtgcagcctctggattccaccttcagtgactactacagtgggctggactccgcaggcctcgaggggagggctggagtggctnatntattgtagtagtggtatcccgtatctacgnagactcgtgagacgggcctatccacagtccgcgaacgggacaaccgccaaaagaccncaacagtactctagcaaggatagaaagttcgcgtagagacggccgaggaccgtcggtccgtagtaacttacgtggacgtacggaagaacggtacgtacccccggggngtagtacggacgtcggggacccgg

SEQ ID NO: 414312 - DNA, 597 bp, Homo sapiens
  misc_feature: GZ8MTXP02GTJ64.21.53.E09.1.454.CMB.2.raw
  modified_base (284)..(284): a, c, t, g, unknown or other
  modified_base (288)..(288): a, c, t, g, unknown or other
  modified_base (347)..(347): a, c, t, g, unknown or other
tcagtcgtcgctcgcacgaccggtgctcgatttagagagagtgtgttgggtttggggagctctgggagaagagccccagccccagaattcccaggagtttccattcggtgatcagcactgaacacagaggactcaccatggagtttgggctgagctgggttttccttgttgctattaataaaaggtgtccagtgtcaggtgcagttggtggagtcgtgggggagcttggtcaagcctgggagggtccctgagactctcctgtgcagcctctggacttcaccttnagtnactactacagtggctggactcccgccaggcctccgaggggacgggctggagtgggtctnatatattagtagtagtggtacgtcccgtatctacgcagactctggtacgaacggggccattaccacctagtccgaccgagggaccaacgcccaaagaacctcaactagtactcgtcgactaaggatagaaactacgccgtaggaacggacggaccggaaggaccgtccggggtacccgtttaggttaacgttacgttggtacggcggaaggaagtaccgtccccggagaagtggacggtacgggaccggg

SEQ ID NO: 414313 - DNA, 589 bp, Homo sapiens
  misc_feature: GZ8MTXP02GQ3R5.21.53.E09.1.454.CMB.2.raw
  modified_base (346)..(346): a, c, t, g, unknown or other
  modified_base (397)..(397): a, c, t, g, unknown or other
tcagtcgtcgctcgcacgaccggtgctcgatttagagagagtgtgttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagttggtggagtcgtgggggagcttggtcaagcctggagggtccctgagactctcctgtgcagcctctggattcaccttcagtgactactacagtgggctggactcccgcaggcctaccggaggggagggctgggagtgggtctnatatattagtagtagtggtacgtcccgtaatccgtacgcagtactcgtagnggaaacgggccgtattccacctagtccgaccgaagggaccaaacggcctaaagacctcaacgtagtactcgtagcaaggtatagaatcgcctagacgacgccggaggtaccgtcgggccgttagtaacttaccgtgtacgaccggtaaggaacgtacccggtcccggacgacgtcggaagtcggggaaccgg

SEQ ID NO: 414314 - DNA, 753 bp, Homo sapiens
  misc_feature: GZ8MTXP02FKECJ.21.53.E09.1.454.CMB.2.raw
  modified_base (271)..(271): a, c, t, g, unknown or other
  modified_base (289)..(289): a, c, t, g, unknown or other
  modified_base (297)..(297): a, c, t, g, unknown or other
tcagtcgtcgctcgcacgaccggtgctcgatttagagagagtgtgttgggtttggggagctctgggagaagagccccagccccagaattcccaggagtttccattcggtgatcagcactgaacacagaggactcaccatggagtttgggctgagctgggttttccttgttgctattataaaaggtgtccagtgtcaggtgcagttggtggagtcgtgggggaggcgttggtcaagcctgggagggtccctgagactctcctgtgcagcctntggacttcaccttcagtnactactanagtgggctggactcccgccgaggtccctccggaagggggaacggggcgtgggtaagggttcgggtctacgaagttaatacgtttaggtagttagtaggggttacgttaccccggttaataccgtaccgactaaagtaccgttcgttagggtacggtaacgggggcccgtaagtttacccaaacccgtaacgttacccggacccgggtaaaacggggaacccaaaacccgggaacccaaaaggtaaaacctcccgaaaacgttaacggttaacttcgagaccgtaagggtaaattacgggaaaagttcgacccgttaggaacgggaaccgaccggggtaccgggtaccttcccggggtacccgtttaggttaccgtttaaaccggtgggttacggacggaacggaacggtaacggtacccccgggacgtacgagggtaacgtcgggggtaacccggg

SEQ ID NO: 414315 - DNA, 628 bp, Homo sapiens
  misc_feature: GZ8MTXP02I4NI7.21.53.E09.1.454.CMB.2.raw
  modified_base (207)..(207): a, c, t, g, unknown or other
  modified_base (294)..(294): a, c, t, g, unknown or other
  modified_base (436)..(436): a, c, t, g, unknown or other
  modified_base (520)..(520): a, c, t, g, unknown or other
  modified_base (607)..(607): a, c, t, g, unknown or other
tcagtcgtcgctcgcacgaccggtgctcgatttagagagagtgtgttgggtttggggagctctgggagaagagccccagccccagaattcccaggagtttccattcggtgatcagcactgaacacagaggactcaccatggagtttgggctgagctgggttttcctgttgctattataaaggtgtccagtgtcaggtgcaggttggnggagtcgtgggggaggtcgttggtcaagcccgtgggacgggtccctgagaccttctccctagtgcgagcctctggtactccaccttnagtcgacctaactacgagtgggctcggaactcccgaccgaggccctaccgagggggaaggggctggggaagttcggggtcctgaattattacgttaagtaggttagtaggtacgtacccgttatacgtccgacagtaccttntagggtagaaacggggtcccattacccgacgtacgccgcccgaaaggggacccaaacgccgaaaagacctcgaatacgtatcgngacagtataagataggcctagagacgtcgaagtcgtacgggtcagtttacgttacaggttcaccggagtaacggtccgacccggtangttagggactttcggaccggg

SEQ ID NO: 414316 - DNA, 498 bp, Homo sapiens
  misc_feature: GZ8MTXP01DU3BZ.51.40.D07.1.454.CMB.2.raw
  modified_base (412)..(412): a, c, t, g, unknown or other
  modified_base (472)..(472): a, c, t, g, unknown or other
  modified_base (494)..(494): a, c, t, g, unknown or other
tcagcgatcgtatacacgaccggtgctcgatttagtgatagagcgtaacaacagaggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactattaaatggtatcagcagaaaccagggcaaagcccctaaactcctgatctacgatgcatccaatttggaaacacggggtccatcaagttcaagtgaagtggtctgggacagatttacttcaccatcagcagccttcaccctgaacgatcttgacaacattaattacgtntcaaacagtatgaataaatctcccaactgaactttcggcggagggaccaaagggtggagnttacaaagaactgtggcttgcnccaa

SEQ ID NO: 414317 - DNA, 588 bp, Homo sapiens
  misc_feature: GZ8MTXP01A7KAN.51.40.D07.1.454.CMB.2.raw
  modified_base (307)..(307): a, c, t, g, unknown or other
  modified_base (352)..(352): a, c, t, g, unknown or other
  modified_base (378)..(378): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtagtccagcctgggagtccctgagctctcctgtgtagtctctggattcaccttgagggtgtacgacatgcacgtcggggtcccnccaggcctccgaggcgaagggggctgggagtggggtgctatttanactcatagtgataagggaaaataacnttaactatgcgagagtcccgtagaacggcacgtcacatctacagacgaacaactacaagaacactacttgtttcacgacaacataagaaaacgcctagacgtacgcgtaaggaacggacgtacggttcgttagtttaattacgttgttacgtaacgtaacgttaacgtaccgaacgggaaccggtaaccgaaccccgggttaacccccgg

SEQ ID NO: 414318 - DNA, 584 bp, Homo sapiens
  misc_feature: GZ8MTXP01A3CMA.51.40.D07.1.454.CMB.2.raw
  modified_base (351)..(351): a, c, t, g, unknown or other
  modified_base (436)..(436): a, c, t, g, unknown or other
  modified_base (450)..(450): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggagcgtggtccagcctgggagtccctgagactctcctgtgtagtctctggattcaccttcgagggtgtacgacatgcacgtggggtcccgccagggctccgaggcgaagggggctgggagtgggtgctatttanactcacatgattagggaaaagttaaacataactatgacaggagtccgtagaagggccgattcaccatctacagagacaatacaanaacacactgtttcngcacatagaaacgcctagacgagctaaggacggacgtacggcgttagtttaacttacgttggttacgaaccggtaaactttaacgaccgtaacggggaacgggtaaccgttaaacccggggttaacccccccgg

SEQ ID NO: 414319 - DNA, 609 bp, Homo sapiens
  misc_feature: GZ8MTXP01D6BMA.51.40.D07.1.454.CMB.2.raw
  modified_base (445)..(445): a, c, t, g, unknown or other
tcagcgatcgtatacacgaccggtgctcgatttagtgatagagcgtaacaacagagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagatcacatcacttgccaggcgagtgaggacattaagtaactatttaaatggtatcagcaagaaaccagggacaaacgacccctaaactcctagatctagatgcatacctaaagtttaggaaactacggggtacccatacgaaggttcaaaggtggtaagttgggttacgtaggggtactagttattttactttacaacctatacagcacgtccctttaccaccttagaaactataccgttaanaactaactagttaacttacgtataactaatagtatagtaactactcctaccctacgttccttaacgtttcgggttacgggaacgggttaacgtaaagggtacggaacgttaacgttaaaccgtaaacggtacgttgggtcgtacgttacgtaaccgttaacgtg

SEQ ID NO: 414320 - DNA, 501 bp, Homo sapiens
  misc_feature: GZ8MTXP01C78OM.51.40.D07.1.454.CMB.2.raw
  modified_base (475)..(475): a, c, t, g, unknown or other
tcagcgatcgtatacacgaccggtgctcgatttagtgatagagcgtaacaacagagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaatcctgatctacgatgcatccaatttggaaacagggtccatcaagtcaagtgaagtgtctgggacagtatttacttcaccatcagcagccttacaccctgaagatcttgactaacattattactgtacaacagtatgaattaactcctacccactcgaactttcgggacggtagggaccgaaggtggaagnttacaaagactgtggcttgcaactaa

SEQ ID NO: 414321 - DNA, 606 bp, Homo sapiens
  misc_feature: GZ8MTXP01A1E70.51.40.D07.1.454.CMB.2.raw
tcagcgatcgtatacacgaccggtgctcgatttagtgatagagcgtaacaacagagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactattaaatggtatcagcaagaaaccagggacaaacgcccctaaactcctagaatctacgatcgactataccaaagtttggaaacgtacggggtaccccagtacgaaaggttcaaagggttagggtaaggttgggtttaccgtaggggaactaggttacttttactttacacctatcagtcaacgtccctttaccacccttagaacgtacttcttacgactaaactagttaattacctgtaaccaaagtattatagaattaactcctacccgtacttctaacggtttcggacgggtaacgggaccgtaaaggggtggttaagacttaccgaaaagtactggtacgggcttacgcttaaccgtaa

SEQ ID NO: 414322 - DNA, 750 bp, Homo sapiens
  misc_feature: GZ8MTXP01B924Q.51.40.D07.1.454.CMB.2.raw
  modified_base (291)..(291): a, c, t, g, unknown or other
  modified_base (320)..(320): a, c, t, g, unknown or other
  modified_base (426)..(426): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcttgggttttcctcgttgctcttttaagaggtgtccagtgtcaggtgcagctcgtggagtcgtgggggagcgtggtccagccgtgggacgtccctgagctctcctgtgtagtctcgtggtacttcaccttgaggggttntaacgacatcgcctacgtcggggtccccnccgagggcctaccggagggcggaaggggggtccttgggggaggttgggggtgacttaagtttttacacttccaactagttaggaagttaaagggaaaacttaaacnttaaactagtgacctaagggtacgtacccggtagggaacgggtccgtaacttaccaacctactcctaccgaagaacgaactaaacttaaccgaaacgtaacctaaccgttaacgtttcggtttacctacgtaccaaacgtaacgtaaggaaaaccgtccgtaaggagacggtcgtaacgggaacggaccggtaaccgggtttacgtttaacggttttaacgttacgttcggttaacggtaaccgtttaaaacgttaacggtaacccgggtaaccggggttaaacccgggtaaaccccgggttaaacccccgggttaacccccgg

SEQ ID NO: 414323 - DNA, 552 bp, Homo sapiens
  misc_feature: GZ8MTXP01C0BB6.51.40.D07.1.454.CMB.2.raw
  modified_base (286)..(286): a, c, t, g, unknown or other
  modified_base (308)..(308): a, c, t, g, unknown or other
  modified_base (351)..(351): a, c, t, g, unknown or other
  modified_base (373)..(373): a, c, t, g, unknown or other
  modified_base (414)..(414): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggaggcgtggtccagcctggggagtccctgagactctcctgtgtagtctctggattcaccttcagggtntaacgacatgcactggggtccnccaggcctccgaggcaagggggctgggagtggggtgcatttanactcacatgataggaaataacntaactatgcagagtccgtagaaggccgatcacatctcaganacatcaagaacacactgttctgcacatagaaaagcctaggagagctaaggaggacgacggcgtttagtttattaacgttgttacgtaagtaaaccttaataccgacggttaacgaaccgaacccgggttaaccccccg

SEQ ID NO: 414324 - DNA, 781 bp, Homo sapiens
  misc_feature: GZ8MTXP01BWD4U.51.40.D07.1.454.CMB.2.raw
  modified_base (267)..(267): a, c, t, g, unknown or other
tcagcgatcgtatacacgaccggtgctcgatttagtgatagagcgtaacaacagagggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccatcacttgccaggcgagtgaggacattagtaactatttaaatggtatcagcagaaacnggacaacgcccctaaatcctagactctacgatcgactacttacctaaatttacggggaaaaccgtaccgggggtacccaagtacccgtaaaaggggtttccaaaaggggttgggtaaggttcgggtttaacgtgggggtaacctagggttaatttttttaacctttcctaaccctatttaccgaacgggtcctaacggttaccccttttaccaacccccgtttaggaaacggttaactttccgtttaacggaaccttaaaaccgttagtttaaacttttaaccgttacggttaaacccctaaaacgtaaacgggtttaaacttaggtaaaacttttaaaccgtcccctttacccccgtaacctttacccgttaaaacccggggtttttccggggggaaccgggggttaaaccgggggaaacccgtaaaaggggggttacgggaaagttacgtttaaaacccgaaaccgggtaattcgggttacggggccttacgggtaaccaacccggtttaag

SEQ ID NO: 414325 - DNA, 620 bp, Homo sapiens
  misc_feature: GZ8MTXP01DXLRQ.51.40.D07.1.454.CMB.2.raw
  modified_base (285)..(285): a, c, t, g, unknown or other
  modified_base (307)..(307): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagcctgggaggtccctgagactctcctgtgtagtctctggattcaccttcagggtntacgacatgcacgtggggtccnccagggcctccgagggcaaggggggcttgggaggttgggggtggactattttatactcaacattagataagggaaattaaacatacctaatcgacaggacgtcccgtaggaacgggccgtagtcaccatactaccgagacgacaaacttaccaaacgaaacccaacgtaacttacgtttacctacgtaccaacagtagaaaacgcctagagagcgtaaggaggacgtacgggttacttaggtttacttacgttgttagtaacgtaaacttaacgtacgacggacggtaaccgttaacccgggttaacccccgg

SEQ ID NO: 414326 - DNA, 572 bp, Homo sapiens
  misc_feature: GZ8MTXP01C50Z9.51.40.D07.1.454.CMB.2.raw
  modified_base (165)..(165): a, c, t, g, unknown or other
  modified_base (282)..(282): a, c, t, g, unknown or other
  modified_base (288)..(288): a, c, t, g, unknown or other
  modified_base (368)..(368): a, c, t, g, unknown or other
  modified_base (428)..(428): a, c, t, g, unknown or other
  modified_base (442)..(442): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcgtgggttttccncgttgctcttttaagaggtgtccagtgtcaggtgcagctcggtggagtcgtggggggagcgtggtccagcctggggagtccctgagactctcctgtgtagtctctggattcaccttnagggtntaacgcatgcacgtgggcccgccaggcctccgaggcgaagggggtctggggagttgggggtgactattttatactcaacngtagattaagggaaaataaacatactatgcagagtccgtagaggcgatcacatctaccanagacaactacaaanacacacttgttctgacacatagaaaagcctagagagctaagacggacgtacgggttgtttagttattacgttgttacgtaactaacttaacgtacggacgggaccggtaaccgttaacccggtaaccccg

SEQ ID NO: 414327 - DNA, 654 bp, Homo sapiens
  misc_feature: GZ8MTXP01CMAYB.51.40.D07.1.454.CMB.2.raw
  modified_base (278)..(278): a, c, t, g, unknown or other
  modified_base (285)..(285): a, c, t, g, unknown or other
  modified_base (291)..(291): a, c, t, g, unknown or other
  modified_base (307)..(307): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagcctgggaggtcctgagactctcctgtgtagtctctggattcaccttnaggggtntacgantgctacgtcgggtccncgaggctaccggaggacggtaagggggtcggtgggtagggtgggtggtacgtattatactactagtagtagtaagtaaaggtaaaagtaaactaaataaactaagtagacgaacgtacgtacggtacggtaacggacgtacgtactacctactactacaacgaacgaactaaactaaccaaacgaaacaacgtaacttacgtttacgtacgtacaacaacgtaagtaaacgaacgtacgagacgacgtaaggaacggacgtacgttacgttacgtttaattacgttcgttacgtaacgtaacgttaacgtaacgacggaacggtaaccgttaacccggtaaccccgg

SEQ ID NO: 414328 - DNA, 545 bp, Homo sapiens
  misc_feature: GZ8MTXP01EKU4K.51.40.D07.1.454.CMB.2.raw
  modified_base (285)..(285): a, c, t, g, unknown or other
  modified_base (351)..(351): a, c, t, g, unknown or other
  modified_base (356)..(356): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagcctgggagtccctgagactctcctgtgtagtctctggattcaccttcaggggtntaacgacatgcacgtgggtcccgccaggctccgaggcaagggggctgggagtggggtgctatttanatcanatgataggaaataacntactangacagngtcgtgaggcgatcacatctcagagacaataccaagaacactactgttctcgcacatagaaaagccgtagagagctaaggacggacgacggttcgttagtttattagttgttgtaacgtaacttaagtacgacggacggtaaccgaacccggtaacccccg

SEQ ID NO: 414329 - DNA, 573 bp, Homo sapiens
  misc_feature: GZ8MTXP01AHPCS.51.40.D07.1.454.CMB.2.raw
  modified_base (285)..(285): a, c, t, g, unknown or other
  modified_base (307)..(307): a, c, t, g, unknown or other
  modified_base (350)..(350): a, c, t, g, unknown or other
  modified_base (356)..(356): a, c, t, g, unknown or other
  modified_base (373)..(373): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagcctgggagtccctgagactctcctgtgtagtctctggattcaccttcgagggtntacgacatgcacgtgggtcccnccaggctccgaggcgaagggggctgggagtgggtgctatttanactcanatgataaggaaataacntactatgcagagtccgtagaggccgatcacatctacagacgacaattaccaagaacacgtactgtttctacgacacatagaaacgcctgacgagcgtaagaggacgtacggttcttagtttaacgttacgttggttacgaacgttaacttaacgtaccgaacgggttaccggtaacccgaaccccgggttaaccccccgg

SEQ ID NO: 414330 - DNA, 578 bp, Homo sapiens
  misc_feature: GZ8MTXP01BR563.51.40.D07.1.454.CMB.2.raw
  modified_base (284)..(284): a, c, t, g, unknown or other
  modified_base (351)..(351): a, c, t, g, unknown or other
  modified_base (357)..(357): a, c, t, g, unknown or other
  modified_base (373)..(373): a, c, t, g, unknown or other
  modified_base (384)..(384): a, c, t, g, unknown or other
  modified_base (437)..(437): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagccgtgggagtccctgagctctcctgtgtagtctctggattcaccttgagggtntacgacatgcacgtgggtcccgccaggcctccgaggccgaagggggctgggagtgggtgctatttanactcanatgataggaaataacntactatgcagngtcgtgaggcgatcacatctacagacgacaatccaaagacactacttgtttcngacaacagtagaaaacgccgtagagagcgtaaggacggactacggttcgttaggtttaacttacgttggttacgtaaccgtaaacgttaacgtaccggacgggaacggtaaccccgttaaacccgggttaacccccccggg

SEQ ID NO: 414331 - DNA, 576 bp, Homo sapiens
  misc_feature: GZ8MTXP01DNIFB.51.40.D07.1.454.CMB.2.raw
  modified_base (164)..(164): a, c, t, g, unknown or other
  modified_base (289)..(289): a, c, t, g, unknown or other
  modified_base (310)..(310): a, c, t, g, unknown or other
  modified_base (351)..(351): a, c, t, g, unknown or other
  modified_base (354)..(354): a, c, t, g, unknown or other
  modified_base (357)..(357): a, c, t, g, unknown or other
  modified_base (373)..(373): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttccncgttgctcttttaagaggtgtccagtgtcaggtgcagctcgtggagtcgtggggggagcgtggtccaggcctggggacgtccctgacgactctcctgtgtagtctcgtggattcacttgagggtntaacgcatgcacgtgggtccncaggcctcgaggcaagggggctgggagtgggtgctatttanacncantgataaggaaataacntacatgactaggacgtcgagtaggccgatcacatactcacgagacaactacaacgaacacgtacttgttactagactacagtaacgaaaacgcgtagagacgtcgtaaggacggacgtacggttcttagtttacttacgttcgttacgtaacgtaaacttaacgtacgacgggacggtaaccgttaaccccgggtaaccccgg

SEQ ID NO: 414332 - DNA, 632 bp, Homo sapiens
  misc_feature: GZ8MTXP01B27MD.51.40.D07.1.454.CMB.2.raw
  modified_base (362)..(362): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcgttgggttttcctcgttgcttcttttaagaggtgtccagtgtcaggtgcagctcgtggagtcgtgggggagcgtggtccagcctggggacgtccctgagactctcctgtgtagtctcgtggacttcaccttcgagggtgtacgacatcgcacgtgggtcccgccaggcctaccgaggcgaagggggctgggaggtgggtgactatttanactcatagtagagtaagggaaaataacataactatgacaggacgtccgtaggaagggccgtatactaccactactaccagtacgaactaaacgttaccaaacgaaacctaactactttcgtttactacgtacaactagtaaggaaaacgtcgtacgaagacgtcgtaaggaacggacgtacggttacttagtttaacttacgttgttacgtaacgtaaacttaacgtaaccggacggaacggtaacccgttaaacccgggtaacccccgg

SEQ ID NO: 414333 - DNA, 554 bp, Homo sapiens
  misc_feature: GZ8MTXP01AEMDR.51.40.D07.1.454.CMB.2.raw
  modified_base (284)..(284): a, c, t, g, unknown or other
  modified_base (352)..(352): a, c, t, g, unknown or other
  modified_base (358)..(358): a, c, t, g, unknown or other
  modified_base (375)..(375): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcttgggttttcctcgttgcttcttttaagaggtgtccagtgtcaggtgcagctcgtggagtcgtgggggagcgtggtccagcctgggagtcctgagctctctgtgtagtctctggattcaccttcagggttnacgacatgcacgtggggtcccgccaggcctccgaggcgaagggggctggggagtggggtgctatttanactcanatgatagggaaataacntactatgacagacgtccgtagaaggccgattcaccatactccagagaacaactaccaaagaacacgactgtttctgacacatagaaaacgcctagagagctggaggacacggttcgttagtttattacgttgttagaacgtaattaagtcgacggaggaaccgaaccgggtaacccccg

SEQ ID NO: 414334 - DNA, 543 bp, Homo sapiens
  misc_feature: GZ8MTXP01CT92F.51.40.D07.1.454.CMB.2.raw
  modified_base (180)..(180): a, c, t, g, unknown or other
  modified_base (304)..(304): a, c, t, g, unknown or other
  modified_base (345)..(345): a, c, t, g, unknown or other
  modified_base (368)..(368): a, c, t, g, unknown or other
  modified_base (385)..(385): a, c, t, g, unknown or other
  modified_base (408)..(408): a, c, t, g, unknown or other
  modified_base (431)..(431): a, c, t, g, unknown or other
  modified_base (433)..(433): a, c, t, g, unknown or other
  modified_base (444)..(444): a, c, t, g, unknown or other
  modified_base (454)..(454): a, c, t, g, unknown or other
tcagcgatcgtatacacgaccggtgctcgatttagtgatagagcgtaacaacagaggggtctgggagaggagcccagcactagaagtcggcggcgtttccattcggtgatcaacactgaacacagaggactcaccatggagtttgggctgagctgggttttcctcgttgctcttttaagnggtgtccagtgtcaggtgcagctcgtggagtcgtgggggagcgtggtccagcctgggagtccctgagctctcctgtgtagtctctggattcaccttcgagggtgtacgacatgcactgggtccnccaggctccgaggcaagggggctgggagtgggtgcatttanactcacatgataaggaaataacntactatgcagagtccgngaggcgattcaccatctccaganaacatcaaagacacactgtttcngnacatacgaaancctagagagngtgaaggttacaccggttgttaggtttattacgttgttacgtaacgtaattaacgtcgaaggacgaaccgttaacccggtaacccccgg

SEQ ID NO: 414335 - DNA, 620 bp, Homo sapiens
  misc_feature: GZ8MTXP01BABVM.51.40.D07.1.454.CMB.2.raw
  modified_base (261)..(261): a, c, t, g, unknown or other
tcagcgatcgtatacacgaccggtgctcgatttagtgatagagcgtaacaacagagggggagtcagtcccaaccaggacacagcatggacatgagggtccctgctcagctcctggggctcctgctgctctggctctcaggtgccagatgtgacatccagatcgacccagtctccatccctccctgtctgcatctgtaggagacagacgtcaccatcacttgccagggcgagtgaggactattagtaactattaatggtatnagacaacgaaacgaggaccaaacgtacccctaaatcctagactctacgatgctactacctaaagtttacggaaacgtaccggggtacccaagtaccgtaaagggtttcgaaagggttagggtaaggttcgggttacgtaggggaacttaggttacttttacttacacctatcgacgctacgtccttaccacccttaggaactcttactacgaactaactagttactttacgtctaactaaacgtagtatataactaacctcctaccctactcgtaacgttcgggacggggtacgaacggtaagggtacgaacgttacaaccgtaaacgtacgttggcggtacttacggccttaacttcg

SEQ ID NO: 414336 - DNA, 578 bp, Homo sapiens
  misc_feature: GZ8MTXP01DXRSN.51.40.D07.1.454.CMB.2.raw
  modified_base (288)..(288): a, c, t, g, unknown or other
  modified_base (310)..(310): a, c, t, g, unknown or other
  modified_base (353)..(353): a, c, t, g, unknown or other
  modified_base (359)..(359): a, c, t, g, unknown or other
  modified_base (379)..(379): a, c, t, g, unknown or other
  modified_base (386)..(386): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcggtggagtcgtggggggagcgtggtccagcctggggagtccctgagactctcctgtgtagtctctggattcaccttcgagggtntacgacatgcacgtgggtcccnccaggcctccgaggcaagggggctgggagtgggtgctatttanactcanatgataacgggaaataaacntactagngacagtacgtcgtaggacggctactacacactacacagacgaacaactacaaacgaactacgtacttgttactacgacaacagtaagaaacgtctagagacgcgaagacggacgtacgttgttagttacttacgttgttacgtaacgtaacgttaacgacgacggacggtaaccgttaacccggtaaccccg

SEQ ID NO: 414337 - DNA, 714 bp, Homo sapiens
  misc_feature: GZ8MTXP01EPO4F.51.40.D07.1.454.CMB.2.raw
  modified_base (291)..(291): a, c, t, g, unknown or other
  modified_base (358)..(358): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgcttcttttaagaggtgtccagtgtcaggtgcagctcggtggagtcgtgggggaggcgtggtccagccgtggggaggtccctgagactctcctgtgtagtctctggattcaccttcgagggtntacgacatgcacgtcggggtcccgccgaggcctacgaggacggaaggggtcgtagggtaggtggggngtacttagtttatactcctaatagtagtaagtaaaagggaaaataaactattaaactagtcgacgtaacgggacggttaccggtagggaacggggtacctaacttaccaacctactttacccgaaccgaagggaaacctaaaccttaaacctaaaccgaaaacgtaaacccaacttacgtttaacggtttccacgaactaaacaacgttaaacgaaaaccgttcgtaggaacggacgtaccggtaaggaacggaccgtacgggtttattagtttaacgttacgttgttaaccggtaaacttacgtaacggaaccggacgggaacccggtaacccggttaaccccgggtaaccccgg

SEQ ID NO: 414338 - DNA, 622 bp, Homo sapiens
  misc_feature: GZ8MTXP01DC1LU.51.40.D07.1.454.CMB.2.raw
  modified_base (285)..(285): a, c, t, g, unknown or other
  modified_base (358)..(358): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtggggggagcgtggttcagcctgggagtccctgagactctcctgtgtagtctctggattcaccttcagggtntacgacatgcacgtcgggtcccgccaggcctccgaggcgaagggggctgggagtgggtgctatttatactcanagtagagtaaagggaaagtaaacattaacgtatacggacaaggtacgtcccggtaggaacgggccgtaattaccaacctactacctaccgagaacgaacctaaacttaccaaagaaccaactaaccgttgtttacctacgacaacgaataacgaaaacgccgtagagagctaaggacggacacggttcttagtttattacgttgttacgtaacgtaaacttaacgtacggacggacggtaacccgaacccgggttaacccccgg

SEQ ID NO: 414339 - DNA, 611 bp, Homo sapiens
  misc_feature: GZ8MTXP01EM4LY.51.40.D07.1.454.CMB.2.raw
  modified_base (291)..(291): a, c, t, g, unknown or other
  modified_base (355)..(355): a, c, t, g, unknown or other
  modified_base (361)..(361): a, c, t, g, unknown or other
  modified_base (380)..(380): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcttgggttttcctcgttgcttcttttaagaggtgtccagtgtcaggtgcagctcggtggagtcgtgggggagcgtggtccagccgtggggacgtccctgacgactctcctgtgtagtctctggattcaccttcagggtntacgacatgcacgtgggtcccgccaggctccgaggcaagggggctggagtgggtggctatttanactcanatgataagggaaataaacntaactatgacagagtccgtagaagggccgattcaccatcctacagacgacaactaccaaagaacacgacttgtttctagacaacatagaaaactcctagacgagcgtaagaacggacgtacggttcgttaggttttaacttaaccgttggttacgtaacgttaaacctttaacgttaccgtaaaccggggacggtaaaccccggttaacccgggtttaaaccccccccggg

SEQ ID NO: 414340 - DNA, 615 bp, Homo sapiens
  misc_feature: GZ8MTXP01CQKXY.51.40.D07.1.454.CMB.2.raw
  modified_base (180)..(180): a, c, t, g, unknown or other
  modified_base (285)..(285): a, c, t, g, unknown or other
  modified_base (307)..(307): a, c, t, g, unknown or other
  modified_base (357)..(357): a, c, t, g, unknown or other
  modified_base (363)..(363): a, c, t, g, unknown or other
  modified_base (388)..(388): a, c, t, g, unknown or other
  modified_base (497)..(497): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagnggtgtccagtgtcaggtgcagctcgtggagtcgtgggggagcgtggtccagccgtgggaggtccctgagctctcctgtgtagtctctggattcaccttgagggtntacgacatgcacgtgggtcccnccgaggcctccgagggccgaagggggctggggagtggggtgctattttanactcanagtagaattaaagggaaactaaacntaaaccgtatggacaaggtacggtccggtaggaacgggtccgtattccaacctatccttaccgagtaacgactaaacttaccaaacgaaccacttaacttcgtttaccngaccaactaagtaagaaaacgtcctagacgagctggacgacgacggttctttagttattacgttgttagaacgtaactttaagcgacgggaacgtaaccgaacccgggttaacccccg

SEQ ID NO: 414341 - DNA, 636 bp, Homo sapiens
  misc_feature: GZ8MTXP01D0ZH7.51.40.D07.1.454.CMB.2.raw
  modified_base (456)..(456): a, c, t, g, unknown or other
  modified_base (461)..(461): a, c, t, g, unknown or other
tcagcgatcgtatacacgaccggtgctcgatttagtgatagagcgtaacaacagagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggactattagtaactattaaatggtatcagcagaaaccaggacaacgacccctaaatcctagactctacgattgactatacctaaagtttcgggaaaaccgtacgggggtaccccaagtaccgtaaaggttccgaaagggttagggtaaggttgggttaccgtgggggtaacctaggttacttttactttaccaacctatccagcagtcccttacacctagaagtntctanactaactagttacttactagtaccaaagtagtatacgtaaacttaactccctacccgtacttcgtaaccgtttcgggggaccgggtaaacgggaccgtaaagggggttggaaacgttacgttaaccgaaaacgggtactgggttacgggaccttacggcccttaaccgtttaacg

SEQ ID NO: 414342 - DNA, 639 bp, Homo sapiens
  misc_feature: GZ8MTXP01BQN7P.51.40.D07.1.454.CMB.2.raw
  modified_base (284)..(284): a, c, t, g, unknown or other
  modified_base (306)..(306): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgcttcttttaagaggtgtccagtgtcaggtgcagctcgtggagtcgtgggggagcgtggtccagcctgggagtcctgagactctctgtgtagtctctggattcaccttcgagggtntacgacatgcacgtgggtcccncctaggcctccgaggcgaagggggctgggagtggggtgactatttagtactccgatagtgaagtaacgggaaaattaaacattaacgtatcggaccaggtacggtcccgtaggaacgggaccgtattaccacctatacctaccaagaacaactaaacttaccaaagtaaccaacgtacttacgtttcacgtacaaccgaataaggaaaacgtctaggagacgcgtaaggacggacgtacgggttcttagtttaacttacgttcggttacgtaaccgttaaacttaagtaccgaacggggaacggtaacccgttaaccccgggtaacccccggg

SEQ ID NO: 414343 - DNA, 569 bp, Homo sapiens
  misc_feature: GZ8MTXP01CPCEQ.51.40.D07.1.454.CMB.2.raw
  modified_base (288)..(288): a, c, t, g, unknown or other
  modified_base (352)..(352): a, c, t, g, unknown or other
  modified_base (378)..(378): a, c, t, g, unknown or other
  modified_base (452)..(452): a, c, t, g, unknown or other
  modified_base (466)..(466): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggaggcgtggtccagcctggggaggtccctgagactctcctgtgtagtctctggattcaccttcgagggtntacgacatgcacgtggtcccgccaggctccgaggcaagggggctgggagtgggtgctagtttanactcacatgaataagggaaataaacntaacatgcagtagtccgtaggaacggcgtattcacactctaccagagacaactacaaagaacacgacttgttcngacacatagaaaanccgtagagacgctggacgacgtacggcgttaggtttattacgttggttcgaacgtaacttaacgacgtaacgggacgaacccgttaacccgggtaacccccgg

SEQ ID NO: 414344 - DNA, 754 bp, Homo sapiens
  misc_feature: GZ8MTXP01DV55Q.51.40.D07.1.454.CMB.2.raw
  modified_base (269)..(269): a, c, t, g, unknown or other
  modified_base (290)..(290): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggaggcgtggtccagccgtgggacgtccctgagtactctcctgtgtagtctntggtattcaccttcgagggtntacgacagtgcgacgtcgggtcccgccgaggccctaccgaggcggaagggggcgttagggagggtggggtggtactaagttttaatactcaactagtagaacgttaaagggaaaactaaactattaacgtaagtgaccgaggtacgggtcccgtagggaacgggtaccgtagttaccacctacgttaccgtacccgaagaaaccggaaaccttaaaccgttaacccgaaaaacggtaaaccctaaaccgttaaccgttttacggtttttaccgacggtaaccctaaaccgtaaagtaaacggtaaaaaacgtcccgttaaggaacggtacggtaccggtaagggaacgggaaccgttacgggttaccgtttagttttaacgtttacgttgttacgtaaccgttaaacgttaacgtacggaacgggttaacggtaaccccgttaaccccgggttaaccccccggg

SEQ ID NO: 414345 - DNA, 617 bp, Homo sapiens
  misc_feature: GZ8MTXP01DQ88Q.51.40.D07.1.454.CMB.2.raw
  modified_base (288)..(288): a, c, t, g, unknown or other
  modified_base (312)..(312): a, c, t, g, unknown or other
  modified_base (362)..(362): a, c, t, g, unknown or other
  modified_base (470)..(470): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcggtggagtcgtggggggagcgtggtccagccgtgggagtccctgagactctcctgtgtagtctctggattcaccttcgagggtntaacgacatcgcacgtcgggtccnccaggcctccgaggcgaagggggctgggagtgggtgctatttatactcanatgagtaaggaaataaacataactatcgcaggtacgtccgtagaacgggcgtactacaccatactacagtacgaacaactaccaaagaaccaacacttgtttacgtanaccaacagtaagaaaacgccgtagagtacgcgtaacggaacggacgtacggttcgtttacgtttaattacgttggttacgtaaccgttaaacttaacgttaccggaacgggaaccggtaaccgttaaccccgggttaaccccccggg

SEQ ID NO: 414346 - DNA, 715 bp, Homo sapiens
  misc_feature: GZ8MTXP01EO77A.51.40.D07.1.454.CMB.2.raw
  modified_base (203)..(203): a, c, t, g, unknown or other
tcagcgatcgtatacacgaccggtgctcgatttagtgatagagcgtaacaacaggagggggagtcagtcccaaccaggacacagcatggacatgagggtccctgctcagctcctggggctcctgctgctctggctctcaggtgccagatgtgacatccagatcgacccagtcctccatccctccctgtctgcatctgtagganacagagtcaccatcacttcgccaggcagtgaggactattagtaactatttaaatggtatacagacaagaaaccagggaccaaaccgacccctaaactcctagactctacgattgactacttacctaaagtttacgggaaaccgtacggggtaccccaagtacgtaaaggttcgaaagggttaggtaagggttgggtttacggtaggggtactaaggtttaactttttactttacaacctaatcgaagtcctaacggtccctttaaccgaccccgttaggaaacgtacttacgttacaaacctaaccgttaatttaaactttaccgttacgtaaaccgtaaaacctaggttaaccttagtaaactttaaccttcccttaccccggtaacttaccggttaacccggtttcgggggaaacggtaacggggttaaaccgtaaggggtaagaaacggttacttaaacgtaaacccggtaagttcggtcggaccgttacgaacccttaacgttaaccg

SEQ ID NO: 414347 - DNA, 682 bp, Homo sapiens
  misc_feature: GZ8MTXP01ALPZF.51.40.D07.1.454.CMB.2.raw
  modified_base (329)..(329): a, c, t, g, unknown or other
  modified_base (398)..(398): a, c, t, g, unknown or other
  modified_base (435)..(435): a, c, t, g, unknown or other
  modified_base (443)..(443): a, c, t, g, unknown or other
  modified_base (562)..(562): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgcttcttttaagaggtgtccagtgtcaggtgcagctcgtggagtcgtgggggagcgtggccagccgtgggacgtcctgacgtctctctgtgtagtctcgtggtacttcaccgttcgaggggttctaacgactagttcggccgtacggtccggggtaccccncccgagggtcctacccggagggaccggaagggggtctagggggaggtgggggttagacttaagttttanactaccaatagtagaagtaaaagggaaaattaaaccnttaactancgacgaggtacgttccggtaggaacgggccgtataccacctactacctacaagacgaactaacttaaccaaacgtaacaacgtacgttacgtttctacgtacacgaataacggaaaacnccgtagagacgcgtaacggacggacgtacggttacgttacgtttaacttacgttgttacgtaacggttaactaacgtaccgaacgggaaccgtaacccggttaaccccggtaacccccgg

SEQ ID NO: 414348 - DNA, 610 bp, Homo sapiens
  misc_feature: GZ8MTXP01AZT6G.51.40.D07.1.454.CMB.2.raw
  modified_base (200)..(200): a, c, t, g, unknown or other
  modified_base (318)..(318): a, c, t, g, unknown or other
  modified_base (401)..(401): a, c, t, g, unknown or other
  modified_base (579)..(579): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcttgggttttcctcgttgcttcttttaagaggtgtccagtgtcaggtncagctcgtggagtcgtgggggagcgtggtccagccgtgggacgtccctgacgctctctgtgtagtctcgtggtattccaccgttgaggggttctacgactatcgcacgtcgggtcccncgagggcctaccgagggcgaagggggctagggaggtgggtgactattttacgactcaatagtgaattaagggaaaattaaacnttaaactagtacggcaagggtacgtcccggtaggaacgggtccgtattccaaccgtatcctaccgaagacgaactaactacaaagaaccactacttgttcagacaatgtaagaaacgctagagtacgctaaggagactacggttcttagtttacttagttgttacaacgtaattaacncgacggacgtaaccgttaacccgtaaccccg

SEQ ID NO: 414349 - DNA, 711 bp, Homo sapiens
  misc_feature: GZ8MTXP01EVDMG.51.40.D07.1.454.CMB.2.raw
  modified_base (285)..(285): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagcctgggagtccctgagactctcctgtgtagtctctggattcaccttcgagggtntacgacatgcacgtgggtcccgcaggcctccgaggcgaagggggctggggagtggggtgctatttatactcaacatggaataagggaaaagtaaactataactagtgaccgaaggtacggttcccggtaggaacggggtacccgtaagttccaacccgtaacttacccgtacccgtaaaggaacgtaaacccgtaaactttaaccccaaaacggaaaccctaaaccttaaaccgtttacggtttttacctacggtaccgtaaacctaaagttaacgggaaaaaacgtcccgttaaggaaggtacggacgtaaggaacgggaacggacggttacgtttagttttaacgttacgttgttacgaaccggttaaacttaaacgtacgaacgggttaacgggaacccgttaaacccgggtaacccccccgg

SEQ ID NO: 414350 - DNA, 606 bp, Homo sapiens
  misc_feature: GZ8MTXP01C9M1J.51.40.D07.1.454.CMB.2.raw
  modified_base (295)..(295): a, c, t, g, unknown or other
  modified_base (319)..(319): a, c, t, g, unknown or other
  modified_base (368)..(368): a, c, t, g, unknown or other
  modified_base (397)..(397): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcttgggtttttcctcgttgcttcttttaagaggtgtccagtgtcaggtgcagctcggtggagtcgtggggggagcgtggtcccagccgtggggacgtccctgacgactctcctgtgtagtctctggattcaccttcgagggtntacgacatcgcacgtcgggtcccnccgaggcctccgaggcgaagggggctgggaggttgggtgtctagtttanactcacatagaattaagggaaaataaacngtaactatcgacaggtacgtccgtaggacgggccgtattcacctactctaccagacgaactaactaccaaagaaccactacttgtttactacgacacaatagaaaacgctagagacgcgtaagacggacgtacggttcgttagtttattacgttcgttacgaactaaactaacgtacgacggacggtaaccgttaacccggtaaccccg

SEQ ID NO: 414351 - DNA, 707 bp, Homo sapiens
  misc_feature: GZ8MTXP01CJYQ1.51.40.D07.1.454.CMB.2.raw
  modified_base (423)..(423): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcgtgggttttcctcgttagctcttttaagaggtgtccagtgtcaggtgcagctcggtggagtcgtgggggagcgtggtccaggccgtggggacgtccctggactactctcgtgtgtagtctcgtggacttcaccttcgagggtgtaacgacagtcgacacggtcgggtcccgaccaaggcctaccgagggacgaagggggtcttgggagggttgggggtacgtctaatttacgtactaccaagtatagtaacgtaaagggaaattaaaacnttaacgagtacgacgaaggtacggtaccgtaagggacgtacctatccgaactactactaccgaagaacgaacctaaactaaccgaaacgtaaacctaaccgttacggtttacgttacacgaacctaacgaagtaacgaaacgtcgtaaggacgagtacgaacggaacgttaccggttacgttacgtttacgtttacgttaacgttacggttaaccgttaacgtaaacgttaacgaccgggtaaacgggttaaccgtaaccccggttaaccccgggtaaccccgg

SEQ ID NO: 414352 - DNA, 659 bp, Homo sapiens
  misc_feature: GZ8MTXP01AFGAX.51.40.D07.1.454.CMB.2.raw
  modified_base (199)..(199): a, c, t, g, unknown or other
  modified_base (286)..(286): a, c, t, g, unknown or other
  modified_base (389)..(389): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgcttcttttaagaggtgtccagtgtcaggtncagctcgtggagtcgtgggggagcgtggtccagccgtgggagtccctgagctctctgtgtagtctctggacttcaccttcgagggtntacgacatgctacgtgggtcccgccgaggcctccgaggcgagggggctgggagtgggtggactatttacacttacacagttgaagttaagggaaacgtaaacnttaaactagtgacgagtacgtccgtaggaacggggcctattccaaccgactactacccagacgaactaaacgttaccaaagaacaacctacgttcgtttcagtaccacaatacgaaaacgtccgtagacgacgcgtcggaacggaccgtacgggttcgtttacgtttaacgtttaccgttggttaccgtaaccggttaaaacgttaaccgtaaccggaaccgggttaaccgggtaaaaccccgttaaccccggggttaaaccccccccgg

SEQ ID NO: 414353 - DNA, 706 bp, Homo sapiens
  misc_feature: GZ8MTXP01BJMLS.51.40.D07.1.454.CMB.2.raw
  modified_base (164)..(164): a, c, t, g, unknown or other
  modified_base (291)..(291): a, c, t, g, unknown or other
  modified_base (318)..(318): a, c, t, g, unknown or other
  modified_base (374)..(374): a, c, t, g, unknown or other
  modified_base (397)..(397): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttccncgttgctcttttaagaggtgtccagtgtcaggtgcagctcggtggagtcgtgggggagcgtggtccaggccgtgggacgtccctgacgtctctcctgtgtagtctgtggacttcaccttgagggttntacgacatcgactacgtcggggtcccnccgaggtccctaccgaggcgagggggctggggaggtgggtgctagtttacactcangtagagtaacgggaaaataaccngttaaactagtcgacgtagcgtacggtacggacggtaccgtactaccaaccgtactacccgtacaacgaacgtaaccaaacttaaccgaaacgtaaaccctactaacgtttcgtttacgtacgtaaccaacgtacgttaaaggaaaaccgtccgtaaggacgaggccgtaagggaacggttaccgtacggttacgtttaacggttttaagtttacccgttggttaccgggttaactaaacgtttaacgtaaccgggaaccgggttacccgggtaaacccggttaaacccccggggttaacccccccggg

SEQ ID NO: 414354 - DNA, 783 bp, Homo sapiens
  misc_feature: GZ8MTXP01BWU2D.51.40.D07.1.454.CMB.2.raw
  modified_base (710)..(710): a, c, t, g, unknown or other
  modified_base (746)..(746): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagtcttgggttttcctcgttgcttcttttaagaggtgtccagtgtcaggtgcagctcgtggagtcgtgggggagcgtgtccagccgtgggacgtccctgacgtacttctcgtgtgtacgtctctggtacttccacctttcgaagggttgtaaccgactacgtcggacctacggttcggggtccccgcccgaagggtcccgtacccggaagggccggaaaggggggtccgttagggggtacgggttgggggtacggtactagtttttaactacgtaccgtaaacgtagttaggaaagttaaaaaggggtaaaaaaactttaaaccgagttaaacccgttaagtcgaaccgtaagggtaacggggttaccccgtaagggaaccgggtaccgtacttaacccaacctaacttccgtaaccgaaacggttaacaaacctaaacgtttaaccgaaaacgtaaaccctaaaccgttaacgtttacggttttaccacggaacctaagtaaacgttaacggaaaacgtccgtaaagacggagtacggtaaggaacgacgtaccggttntttagttaacttacgttgttacgtaactacgttaanccgaacgggacgtaacccggttaacccgtaaccccgg

SEQ ID NO: 414355 - DNA, 672 bp, Homo sapiens
  misc_feature: GZ8MTXP01BSSWH.51.40.D07.1.454.CMB.2.raw
  modified_base (164)..(164): a, c, t, g, unknown or other
  modified_base (198)..(198): a, c, t, g, unknown or other
  modified_base (438)..(438): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttccncgttgctcttttaagaggtgtccagtgtcaggtncagctcgtggagtcgtgggggagcgtggtccagcctggggacggtccctgaacgtcctctccgtgttcgtagtctcgtggtattccgactttcggaggggtctaacgactagtgcctacgtggggtccccaccgagggtcctccggaaggaccggaagggggtcctggggaaggttggggttacggacttaagtttactacctaccaagtagtcggaaattaaggggaaaacttaaactntaacgtagcgacgacggtacgtacgtacggaacggcctatccactatacgacaagacaacgtaactacaaacgaacacgtacttgttcacgaactaagtaagtaagaaacgtctaggacgacggagtaaggaacggttacgtacggttcgttagttacgttcgttgttaccgtaacgtaacgtaacgtaccggaacggttaacccggtaacccggttaaccccgggtaaccccg

SEQ ID NO: 414356 - DNA, 476 bp, Homo sapiens
  misc_feature: GZ8MTXP02JQUB2.51.40.D07.1.454.CMB.2.raw
tcagcgatcgtatacacgaccggtgctcgatttagtgatagagcgtaacaacagagggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactattaaatggtatcagcagaaaccagggcaagcccctaaactcctgatctacgatgcatccaattggaacagggtcccatcaagttcagtggagtgtctgggacagtatttacttcaccatcagcagcccttcaccctgaagatcttgcaacatattactgtacaacagtatgataatctccatcactttcggcgaggaccaaggtgagatacaaacgaactgtaggctgcacta

SEQ ID NO: 414357 - DNA, 611 bp, Homo sapiens
  misc_feature: GZ8MTXP02JMAH3.51.40.D07.1.454.CMB.2.raw
  modified_base (265)..(265): a, c, t, g, unknown or other
  modified_base (283)..(283): a, c, t, g, unknown or other
  modified_base (290)..(290): a, c, t, g, unknown or other
  modified_base (305)..(305): a, c, t, g, unknown or other
  modified_base (356)..(356): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcgtggtttcgtcgtaggctctttaagaggtgtccagtgtcaggtgcagctcgtggagtcgtgggggagcgtggtccagcctgggaggtccctgagactctcctgtgtagtctntggattcacttcagggtntacgatntgcacgtcgggtccncgaggcctccgaggacggaaggggcgtagggtaggtggggtgactatttanactacatagtgaagtaggaaaactaacaataactagtagacgagacgtacggtacggacggaccgtactactacctactactacacgaacgaactaactaacaaacgaaacaactacttacgttactacgtacacaagtaagaaacgacgtagagagacgtacgacggacgacgtacgttacgtttacgttacgttacgtacgtaacgtaacgttaacgtacgaacggaacggtaaccgtaacccggtaaccccg

SEQ ID NO: 414358 - DNA, 542 bp, Homo sapiens
  misc_feature: GZ8MTXP02I1M4H.51.40.D07.1.454.CMB.2.raw
  modified_base (346)..(346): a, c, t, g, unknown or other
  modified_base (369)..(369): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggagcgtggtccagcctgggagtccctgagactctcctgtgtagtctctggattcaccttcagggtgtacgacatgcacgtgggtccgccaggctccgaggcaaggggctgggagtgggtggctatttanatcacatgataggaaagtaaacntaactatgcagagtccgtgaaggccgatcacatctccagagacaattaccaaagaacacaacttgttctgacacatagaaaagcctagaagagctagaggacacggtcttagtttattactgtacgaacgtaaacttaactacgaacggacggaaccgaaccggtaacccccg

SEQ ID NO: 414359 - DNA, 583 bp, Homo sapiens
  misc_feature: GZ8MTXP02F9O1G.51.40.D07.1.454.CMB.2.raw
  modified_base (288)..(288): a, c, t, g, unknown or other
  modified_base (295)..(295): a, c, t, g, unknown or other
  modified_base (310)..(310): a, c, t, g, unknown or other
  modified_base (355)..(355): a, c, t, g, unknown or other
  modified_base (361)..(361): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcttgggttttcctcgttgcttcttttaagaggtgtccagtgtcaggtgcagctcgtggagtcgtgggggagcgtggtccagccgtgggaggtccctgagactctcctgtgtagtctctggattcaccttgagggtntacgacntgcacgtgggtcccnccaggcctccgagggcaaggggctggggagtggggtgctatttanactcanatgataggaaataacatactatgacaggacgtccgtagaacggccgatcaccatcctaccagaacgacaacttaccaaagaacactacttgtttctagacacatagaaaacgcctagacgagacgtaggacggacgacggtcgttacgtttacgttacgtggtacgaacgttaaacttaaacgtacgaacggtaacggaaccgtaacccggttaacccccgg

SEQ ID NO: 414360 - DNA, 537 bp, Homo sapiens
  misc_feature: GZ8MTXP02F8WPZ.51.40.D07.1.454.CMB.2.raw
  modified_base (284)..(284): a, c, t, g, unknown or other
  modified_base (347)..(347): a, c, t, g, unknown or other
  modified_base (368)..(368): a, c, t, g, unknown or other
  modified_base (374)..(374): a, c, t, g, unknown or other
  modified_base (432)..(432): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggagcgtggtccagcctgggagtccctgagactctcctgtgtagtctctggattcaccttcaggggtntacgacatgcacgtgggtccgccaggctccgaggcaaggggctggagtggggtggctatttanactcacatgatggaaataacntactangcagagtcgtgaaggccgattcacatctccagagacattccaaagaacacactgttcngacacatagaaaacgctagagagctaggaggacacggcttagtttacttactgtacgaacgtaaacttaactcgaacggacggaaccgtaaccggtaacccccgg

SEQ ID NO: 414361 - DNA, 622 bp, Homo sapiens
  misc_feature: GZ8MTXP02H8LE6.51.40.D07.1.454.CMB.2.raw
  modified_base (287)..(287): a, c, t, g, unknown or other
  modified_base (353)..(353): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcgtggtttccgtcgttaggctcttttaagaggtgtccagtgtcaggtgcagctcgtggagtcgtgggggagcgtggtccagcctgggaggtccctgagactctcctgtgtagtctctggattcaccttcagggtntacgacatgccatgggtccgccaggcctccgaggcgaaggggctgggagtgtgtcggctatttaanatcacatgataggaataaacatactatgacatacgtccgtaggaacggcctataccacctatcctaccgaagaacgtactaacgtacccgaaagaaacctacgttacttcgtttacgtacgtactactaacgtaacgtaaacgtaaccgtacgtaacgacgtacgtacggacggaacgtacggtacgttacgtttacgtttacgttacgtaacgtacgtaaacgttaaacgtaacgtaaccggtaaccggtaaacccggtaaaccccgg

SEQ ID NO: 414362 - DNA, 531 bp, Homo sapiens
  misc_feature: GZ8MTXP02IW4QU.51.40.D07.1.454.CMB.2.raw
  modified_base (348)..(348): a, c, t, g, unknown or other
  modified_base (368)..(368): a, c, t, g, unknown or other
  modified_base (399)..(399): a, c, t, g, unknown or other
  modified_base (452)..(452): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggagcgtggtccagcctgggaggtccctgagactctcctgtgtagtctctggattcaccttcagggtgtacgacatgcacgtgggtccgccaggcctccgaggcgaaggggctgggagtggggtgcatttanatcacatgataggaataacntactatgcagagtccgtgaaggccgatcacntctccagagacaatcaaagaacacactgttctgcacatacgaaagcctgaagngctaggacgacacggtcttagtttatactgtagaacgtaaacttaatccgaggtacggaacgtaacccggtaacccccg

SEQ ID NO: 414363 - DNA, 546 bp, Homo sapiens
  misc_feature: GZ8MTXP02FQKI2.51.40.D07.1.454.CMB.2.raw
  modified_base (284)..(284): a, c, t, g, unknown or other
  modified_base (306)..(306): a, c, t, g, unknown or other
  modified_base (349)..(349): a, c, t, g, unknown or other
  modified_base (371)..(371): a, c, t, g, unknown or other
  modified_base (405)..(405): a, c, t, g, unknown or other
  modified_base (410)..(410): a, c, t, g, unknown or other
  modified_base (432)..(432): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagcctgggagtccctgagactctcctgtgtagtctctggattcaccttcagggtntacgacatgcacgtggggtccnccaggctccgaggccgaaggggctgggagtggggtgcatttanactcacatgataggaaataacntacatgacagacgtcgtagagggccatcacatcncaganacatcaaagaacacactgttcngacacatagaaagtcctagagagctaggacggacacggtcttagtttattacgtgttagaacgtaaaacttaacgtacgaacgggacggaacccgtaacccggtaaaccccccg

SEQ ID NO: 414364 - DNA, 537 bp, Homo sapiens
  misc_feature: GZ8MTXP02JLUJG.51.40.D07.1.454.CMB.2.raw
  modified_base (287)..(287): a, c, t, g, unknown or other
  modified_base (307)..(307): a, c, t, g, unknown or other
  modified_base (346)..(346): a, c, t, g, unknown or other
  modified_base (368)..(368): a, c, t, g, unknown or other
  modified_base (379)..(379): a, c, t, g, unknown or other
  modified_base (448)..(448): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcgtggttttcctcgttaggctcttttaagaggtgtccagtgtcaggtgcagctcgtggagtctgggggaggcgtggtccagcctgggaggtccctgagactctcctgtgtagtctctggattcaccttcagggtntacgacatgcactgggtccnccaggctccaggcaaggggctgggagtgggtgcatttanatcacatgatggaaagtaaacntactatgcagngtccgtgaagggccgattcaccatctcagagacattaccaaagaacacactgttctgacacatagaaanctagagagagtagacgacacggtcttagtttacttacgtgtagaacgtaaacttaacgtacgaggacggaaccgaacccggtaaccccg

SEQ ID NO: 414365 - DNA, 602 bp, Homo sapiens
  misc_feature: GZ8MTXP02G219Q.51.40.D07.1.454.CMB.2.raw
  modified_base (284)..(284): a, c, t, g, unknown or other
  modified_base (351)..(351): a, c, t, g, unknown or other
  modified_base (378)..(378): a, c, t, g, unknown or other
  modified_base (437)..(437): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcttgggttttcctcgttgctcttttaagaggtgtccagtgtcaggtgcagctcgtggagtcgtgggggagcgtggtccagcctgggagtccctgagctctcctgtgtagtctcgtgattcaccttgagggtntacgacatgcacgtgggtccgccaggcctaccgaggcgaaggggctgggagtgggtgactagtttanactcatagtgaagtacggaaaataacntaactatgacagacgttccgagacggctatcacatcaccagacgaacaactaccaaaanactactacttgttacacgacaacaagtaaacgaaacgcgtagaacgtagacgtacggaacggtacgtacggttactttaacgtttacgttaacgtagtaacgtaacgttaaaacgttaacgaacggaaacggtaaccgaaacccggtaaaccccggtaacccccg

SEQ ID NO: 414366 - DNA, 552 bp, Homo sapiens
  misc_feature: GZ8MTXP02IB15S.51.40.D07.1.454.CMB.2.raw
  modified_base (284)..(284): a, c, t, g, unknown or other
  modified_base (349)..(349): a, c, t, g, unknown or other
  modified_base (370)..(370): a, c, t, g, unknown or other
  modified_base (381)..(381): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggagcgtggtccagcctgggaggtccctgagactctcctgtgtagtctctggattcaccttcagggtntacgacatgcactggggtccgccaggcctccgaggcaagggggctgggagtggggtgctatttantcacatgataggaagtaaacntactatgcagngtccgtgagggccgattcaccatctccagagacataccaaagacacacttgttctgcacatagaaaagcctagagagctaggaggacacggtacttaggttttataccgttggtacgtaacgtaaactttaacgacgaacggacggaacctaaacccgggtaaccccccgg

SEQ ID NO: 414367 - DNA, 552 bp, Homo sapiens
  misc_feature: GZ8MTXP02HO1N3.51.40.D07.1.454.CMB.2.raw
  modified_base (284)..(284): a, c, t, g, unknown or other
  modified_base (308)..(308): a, c, t, g, unknown or other
  modified_base (357)..(357): a, c, t, g, unknown or other
  modified_base (383)..(383): a, c, t, g, unknown or other
  modified_base (425)..(425): a, c, t, g, unknown or other
  modified_base (469)..(469): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggagcgtggtccagcctgggagtccctgagactctcctgtgtagtctctggattcaccttcaggggtntacgacatgccacgtggggtcccnccaggcctccagtcggcgaaggggctgggaggtggggtggctagtttanatcacattgaattaggaagtaaaacntaactatgcagacgtccgtagaacggcatcacatctacaganacaataccaaagaacactacttgtttcagacaacatagaaaacncctagacgagctaggaggacacggtcttagtttactacgtgtaagacgtaacttatacgaacggacgtaaccgtaaaccccgg

SEQ ID NO: 414368 - DNA, 684 bp, Homo sapiens
  misc_feature: GZ8MTXP02HNSUP.51.40.D07.1.454.CMB.2.raw
  modified_base (305)..(305): a, c, t, g, unknown or other
  modified_base (443)..(443): a, c, t, g, unknown or other
tcagcgatcgtatacacgaccggtgctcgatttagtgatagagcgtaacaacagagggggagtcagtcccaaccaggacacagcatggacatgagggtccctgctcagctcctggggctcctgctgctctggctctcaggtgccagatgtgacatccagatcgacccagtctccatcctccctgtcctgactatcgtaggtaggacgacagtacgtaccactatcctacgtcgaccgaggacgtagtagacgacttagttaacgtaacttaagtttaagtggtactcgagacgtaacgaaaccgngggaacctaaccggtaccccttaaagtccgtagtactacgtaagattcgactactacgttaagttacggaacgtccggtaccctagtacgtagtcaggtagtagttcgtacgagtactagtttactttacgtacactntacgagactacgttccctacgacctagtaactcttacgttacaaactacttagtttaacgttccgacgtaactaaagtgttacgtcggttaaaactccgttccctaccgtaacgttaccggtttacggttcccggggaaggacccggttaaactacggggttacggaaaccttaccggtaaacgttaaaaccgggctttacggggttaccgaccgtttaaccgccgtttaaaacgtttccg

SEQ ID NO: 414369 - DNA, 654 bp, Homo sapiens
  misc_feature: GZ8MTXP02JW9L9.51.40.D07.1.454.CMB.2.raw
  modified_base (284)..(284): a, c, t, g, unknown or other
  modified_base (306)..(306): a, c, t, g, unknown or other
  modified_base (351)..(351): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagcctgggagtccctgagactctcctgtgtagtctctggattcaccttgagggtntacgacatgcacgtcgggtccnccaggcctccgaggcgaaggggctgggagtggggtgctagtttanactcatatagataggaaataacatactatcgacgagtacgtccggtaggaacggaccgtacttacacctactcctaccgaagaacgaactaactacaaacgaactactacttcgttactacgtacaacgtagtaacggaaacgtcgtagtacggtagttaggacggtaaccgtacggttacgtttacgtttacgttacgtacggttaacggtaaccgttaaaaccgtttaaacggtaaccggtaaaccggggtaaaccggtaaaccccggtaaacccccggggttaaccccccggtacccggg

SEQ ID NO: 414370 - DNA, 544 bp, Homo sapiens
  misc_feature: GZ8MTXP02G1BBJ.51.40.D07.1.454.CMB.2.raw
  modified_base (341)..(341): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggagcgtggtccagcctgggagtccctgagactctcctgtgtagtctctggattcacttcagggtgtacgacatgcactggtccgccaggctccgaggcgaaggggctggagtgggtgcatttanatcacatgataggaaagtaacatactatgcagagtccgtagaaggccgatcaccatctccagaagaacaattaccaaagaacaacactgtttctgactacatagaaaacgctagaagagcgtagaaggacacggcttagtttactacgtgtacggaactaaacttaactacgacggaacggaccgaaacccggtaacccccgg

SEQ ID NO: 414371 - DNA, 563 bp, Homo sapiens
  misc_feature: GZ8MTXP02IIR23.51.40.D07.1.454.CMB.2.raw
  modified_base (289)..(289): a, c, t, g, unknown or other
  modified_base (352)..(352): a, c, t, g, unknown or other
  modified_base (383)..(383): a, c, t, g, unknown or other
  modified_base (458)..(458): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcggtggagtcgtgggggagcggtggtccagccgtgggaggtccctgagactctcctgtgtagtctctggattcaccttcgagggtntacgacatgcacgtgggtccgccaggctccgaggcgaaggggctgggagtgggtgctatttanactcacatgatagggaaaataacataactangacgagacgtccgtagaacgggccgtatcaccatctacagacgaactaactaccaaagaaccactacttgttacngacacagtagaaaacgcgtagagagacgtagacggacgacgtcttacgtttactacgtgtagaacgtaactaactcgaacggacgaaccgtaaccggtaaccccg

SEQ ID NO: 414372 - DNA, 609 bp, Homo sapiens
  misc_feature: GZ8MTXP02IDRP4.51.40.D07.1.454.CMB.2.raw
  modified_base (388)..(388): a, c, t, g, unknown or other
  modified_base (460)..(460): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagccgtgggagtccctgagctctctgtgtagtctctggattcaccttcgagggtgtacgacatgccactggggtcccgccaggctccgaggcaaggggctagggagtggggtggctagtttatactcacatgatagggaaataaacagtaactatgacngagtccggtagaacgggccgtatcaccatacctaccagacgaactataccgaaacaacactacttgtttacngacatagtaagaaaacgccgtagagacgtacgaggacggaccgacggtacgtttagttttaacgttacgttagtacgtaaacggttaaactttaaacgaccggtaaacgggtaccggaaaacccgtaaacccggttaacccccccgggg

SEQ ID NO: 414373 - DNA, 551 bp, Homo sapiens
  misc_feature: GZ8MTXP02IOZ3N.51.40.D07.1.454.CMB.2.raw
  modified_base (350)..(350): a, c, t, g, unknown or other
  modified_base (372)..(372): a, c, t, g, unknown or other
  modified_base (406)..(406): a, c, t, g, unknown or other
  modified_base (437)..(437): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggaggcgtggtccagcctgggaggtccctgagactctcctgtgtagtctctggattcaccttcagggtgtacgacatgcactgggtccgccaggctccgaggcaaaggggctgggagtgggtggctagtttanatcgacatgataggaaataacntaactatgacagagtccgtagaaggcgatcacanctcagagacactacaagaacacacttgttcngcacatagaaaacgctagacgagcgtaggacggacgacgtacttacgtttattacgtgtagaacgtaaacttaactacgaacggacggaaccgtaaccggttaaaccccccggg

SEQ ID NO: 414374 - DNA, 542 bp, Homo sapiens
  misc_feature: GZ8MTXP02FRQYO.51.40.D07.1.454.CMB.2.raw
  modified_base (283)..(283): a, c, t, g, unknown or other
  modified_base (347)..(347): a, c, t, g, unknown or other
  modified_base (404)..(404): a, c, t, g, unknown or other
  modified_base (456)..(456): a, c, t, g, unknown or other
  modified_base (467)..(467): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggagcgtggtccagcctgggaggtccctgagctctcctgtgtagtctctggattcaccttcagggtntacgacatgcacgtgggtccgccaggctccgaggcaaggggctgggaggtggggtgcagtttanactcacatgataggaaagtaacatactatgcagacgtcgtgaagggccatcacatcnccagacgacaatccaaagacacactgttctagacacatagaaagtcagagancgtagacgganacggtcttagtttacttacgtgttagaacgtaactttaacgacgaacggtacggaaccaaccggttaaacccccg

SEQ ID NO: 414375 - DNA, 602 bp, Homo sapiens
  misc_feature: GZ8MTXP02JDOMV.51.40.D07.1.454.CMB.2.raw
  modified_base (285)..(285): a, c, t, g, unknown or other
  modified_base (305)..(305): a, c, t, g, unknown or other
  modified_base (353)..(353): a, c, t, g, unknown or other
  modified_base (359)..(359): a, c, t, g, unknown or other
  modified_base (375)..(375): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagcctgggaggtccctgagactctcctgtgtagtctctggattcaccttcagggtntacgacatgcacgtgggccncgaggcctccgaggcgaaggggtctggggagtggggtgactagtttanactcanatgataggaaataacntaactagtagcaggacgtccggtaggaaacgggccatcaccatcctaccagtacgaactaacttaccaaaacgaactaactacgtttcgtttacaggaccaactaagtaacgaaaacgccgtagaaggagtcgaggacggaacgtacgggtctttagtttacttacgtgtacgtaacgtaaacttacgaccgaacgggaacgtaaccggaaacccggttacccccgg

SEQ ID NO: 414376 - DNA, 570 bp, Homo sapiens
  misc_feature: GZ8MTXP02HUK0G.51.40.D07.1.454.CMB.2.raw
  modified_base (284)..(284): a, c, t, g, unknown or other
  modified_base (349)..(349): a, c, t, g, unknown or other
  modified_base (372)..(372): a, c, t, g, unknown or other
  modified_base (430)..(430): a, c, t, g, unknown or other
  modified_base (459)..(459): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagcctgggagtccctgagctctcctgtgtagtctctggattccaccttcagggtntacgacatgcacgtgggtccgccaggctcccgaggcgaaggggctgggagtggggtgctatttanatcacatgataggaaagtaaacnttaactatgacagagtccgtgaaggccgatcacatcctaccagagacaattaccaaanaacacacttgttctgacacatagaaaacnctaggaagtagcgtaggaacggacacggtctttagtttacgttaacgtgtacgtaacgtaaacttaagtacgaacggtaacggtaacgttaaacccgggttaaccccccgg

SEQ ID NO: 414377 - DNA, 486 bp, Homo sapiens
  misc_feature: GZ8MTXP02G9Y6N.51.40.D07.1.454.CMB.2.raw
tcagcgatcgtatacacgaccggtgctcgatttagtgatagagcgtaacaacagaggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactattaaatggtatcagcagaaaccagggcaagcccctaaactcctgatctacgatgcatccaattggaaacaggggtcccatcaaggttcagtggagtggttctgggacagtatttacttcaccatcagcagccttcaccctgaagatcttgacaacatattactgtacaaacagtatgataatctaccatctacttcggcggtaggaccaaggtgagatacaaacgactgtaggctgcaccta

SEQ ID NO: 414378 - DNA, 606 bp, Homo sapiens
  misc_feature: GZ8MTXP02HZHYL.51.40.D07.1.454.CMB.2.raw
  modified_base (285)..(285): a, c, t, g, unknown or other
  modified_base (359)..(359): a, c, t, g, unknown or other
  modified_base (382)..(382): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagcctgggagtccctgagactctcctgtgtagtctctggattcaccttcgagggtntacgacatgcacgtgggtcccgccaggcctcccgagggccgaagggggctggggaggtggggtggactatttanactcacatgatagggaaataacnttaactatgacaagagtccgtagaacgggccgatcaccatctccagacgacaataccaaagaacactacttgtttctgacacatagaaaacgctagagagcgtaggacggacgacggtacgtttagttttacgttaacgtgttacgtaacgttaaaccgtttaaacgtaccgaaaccggggtaaccgggtaacccgtaaaaccccggggtttaaacccccccgg

SEQ ID NO: 414379 - DNA, 669 bp, Homo sapiens
  misc_feature: GZ8MTXP02G1I04.51.40.D07.1.454.CMB.2.raw
  modified_base (285)..(285): a, c, t, g, unknown or other
  modified_base (355)..(355): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagcctgggagtccctgagactctcctgtgtagtctctggattcaccttcgagggtntacgacatgcacgtggggtccgccgaggcctcccgaggccgaaggggctgggagtggggtgctattttanactcatatagataggaaataacattaatatgacgtagacgtaccgtaggacggcctactacactactactaccaagacgaactaacttaccaaaagtaaacctaactacgtttcgtttactacgtaacctaacgtaagtaaacgaaaacgtccgtaaggaacggtacgacgtaacgggaacggtaaccgtaccggttacgtttaacggttttaacgttacgttaggtaccggtaaaccgttaaaacgtttaaacgtaaccggtaaaccggggtaaaccggtaaaccccggtaaacccccgggtttaacccccgg

SEQ ID NO: 414380 - DNA, 699 bp, Homo sapiens
  misc_feature: GZ8MTXP02GQ4HC.51.40.D07.1.454.CMB.2.raw
  modified_base (534)..(534): a, c, t, g, unknown or other
  modified_base (573)..(573): a, c, t, g, unknown or other
  modified_base (621)..(621): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggaggcgtggtccagcctgggacgtccctgagacctcctcgtgtgtcgtctcgtgtactcctactcggagggtcgtaacgactagtcgacctacggtccgggtcccgacgacggtcctaccggacggacgggaacggggtcgtaggggacgggttggggtcgacttaagtttagtacctacaactagtagtaagtaaagggaaaaataaacgtacttaaacgtagtacgacgaaggtacggttacccgggaaggggaaccggtcctacttacccaactcgttacccacgaaaggactaaacctaactaccggaaaanacctacttacgtttgtcagacaaacgtagaaacggaacncgtagaacgacgcgtaaggacgacgtaacgttcgtttaaggtttaacncgttacggaacgtaacctttaaaacgtacgacggaaaaccggggtaacgtaaaccccggtaacccccggtaaccccgg

SEQ ID NO: 414381 - DNA, 585 bp, Homo sapiens
  misc_feature: GZ8MTXP02F96X9.51.40.D07.1.454.CMB.2.raw
  modified_base (286)..(286): a, c, t, g, unknown or other
  modified_base (308)..(308): a, c, t, g, unknown or other
  modified_base (356)..(356): a, c, t, g, unknown or other
  modified_base (379)..(379): a, c, t, g, unknown or other
  modified_base (413)..(413): a, c, t, g, unknown or other
  modified_base (416)..(416): a, c, t, g, unknown or other
  modified_base (421)..(421): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagccgtgggaggtccctgagactctcctgtgtagtctctggattcaccttgagggtntacgacatgcacgtgggtcccnccaggcctccgaggcgaagggggctgggaggttggggtgctattttanactcacatgaataggaaataacntaactagtgcagagtccgtagaaggccgatcacntcncaganacataccaaagacacacttagttcagacaacataagaaaacgccgtagagtagcgtaggaacggtaccgacgggtacttagttttacgttaacgtgttacggtaacgttaaaccttaagtaccggaacggaacggaacccgtaaaacccgggttaaccccccgg

SEQ ID NO: 414382 - DNA, 548 bp, Homo sapiens
  misc_feature: GZ8MTXP02JNNEE.51.40.D07.1.454.CMB.2.raw
  modified_base (284)..(284): a, c, t, g, unknown or other
  modified_base (305)..(305): a, c, t, g, unknown or other
  modified_base (348)..(348): a, c, t, g, unknown or other
  modified_base (369)..(369): a, c, t, g, unknown or other
  modified_base (375)..(375): a, c, t, g, unknown or other
  modified_base (404)..(404): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggagcgtggtccagcctgggagtccctgagactctcctgtgtagtctctggattcaccttcgagggtntacgacatgcacgtgggtccnccaggcctccgaggcaaggggctgggagtggggtgctatttanatcacatgataggaaataacntactangacagagtccgtagaggccgatcacatcnccagagacaactccaaagaacacacttgttactgacacagtagaaaacgcctagacgagcgtaggagacacggtcttaggtttacttacgtcgtagaacgtaacttaacgtcgaacggtacgaaccgtaaccgggtaacccccg

SEQ ID NO: 414383 - DNA, 539 bp, Homo sapiens
  misc_feature: GZ8MTXP02JFGZ5.51.40.D07.1.454.CMB.2.raw
  modified_base (286)..(286): a, c, t, g, unknown or other
  modified_base (306)..(306): a, c, t, g, unknown or other
  modified_base (344)..(344): a, c, t, g, unknown or other
  modified_base (368)..(368): a, c, t, g, unknown or other
  modified_base (434)..(434): a, c, t, g, unknown or other
  modified_base (447)..(447): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggccgagctgggttttcctcgttgctcttttaagaggtgtccagtgtcaggtgcagctcgtggagtctgggggaggcgtggtccagcctggggaggtccctgagactctcctgtgtagtctctggattcaccttcagggtntacgacatgcactgggtccncaggctccaggcaaggggctgggagtgggtgcatttanatccacatgatggaaagtaaaacntactatgcagagtccgtgaagggcgattcacatctccagagacaataccaagaacacactgtttcngcacatagaaacnctagagagctagacggacacggtctagtttacttactagtgacgtaaacttaatacgaacggacgaaccgtaaccggtaacccccgtaccgg

SEQ ID NO: 414384 - DNA, 541 bp, Homo sapiens
  misc_feature: GZ8MTXP02FUNUQ.51.40.D07.1.454.CMB.2.raw
  modified_base (286)..(286): a, c, t, g, unknown or other
  modified_base (350)..(350): a, c, t, g, unknown or other
  modified_base (355)..(355): a, c, t, g, unknown or other
  modified_base (371)..(371): a, c, t, g, unknown or other
  modified_base (405)..(405): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagcctgggaggtccctgagactctcctgtgtagtctctggattcaccttcgagggtntacgacatgcacgtgggtccgccaggcctccgaggcaaggggctgggaggtgggtgctatttanatcanatgataggaaataacntaactatgcagagtccgtgaggccgatcacatcnccagagacaatcaaagaacacactgttctagacacatagaaaacgtcctagagagctagacggtacacggttcttagtttactactgtacgaacgttaactaacgacgacggacgaaccgtaacccggtaaccccg

SEQ ID NO: 414385 - DNA, 495 bp, Homo sapiens
  misc_feature: GZ8MTXP02GJPSO.51.40.D07.1.454.CMB.2.raw
  modified_base (343)..(343): a, c, t, g, unknown or other
tcagcgatcgtatacacgaccggtgctcgatttagtgatagagcgtaacaacagagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactattaaattggtatcagcagaaaccagggcaagcccctaaactcctgatctacgatgcatccaattggaaacaggggtccatcaaggttcagtgagtgtntgggacagatttacttcaccatcagcagccttcaccctgaacgatcttgacaacatattactgtacaacagtatgataatctacccactcgtactttcggacggtaggaccgaaggtacgagatacaaacgaactagacggtctcgcaccta

SEQ ID NO: 414386 - DNA, 594 bp, Homo sapiens
  misc_feature: GZ8MTXP02FSGS7.51.40.D07.1.454.CMB.2.raw
  modified_base (377)..(377): a, c, t, g, unknown or other
  modified_base (383)..(383): a, c, t, g, unknown or other
  modified_base (404)..(404): a, c, t, g, unknown or other
  modified_base (410)..(410): a, c, t, g, unknown or other
  modified_base (464)..(464): a, c, t, g, unknown or other
  modified_base (468)..(468): a, c, t, g, unknown or other
  modified_base (475)..(475): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgcttcttttaagaggtgtccagtgtcaggtgcagctcgtggagtcgtgggggagcgtggtccaggccgtgggacgtccctgacgtactctcctgtgtagtctcgtggtacttccacctttgaggggtgtaaccgacagtcgacacgtcggggtcccgccgaggcctacccgagggccgaaggggcgtgggaggtcgggtgctaatttanactcanagtgaagtaggaaaattaacntactangcaggcgtcgtagaggcctatccacatcacagacacactacaaagacatacttnttcnacactanagaaacgtcagagtcgctaaggacggtacgacggttatttcgtttaagtccgttagtacgtaacgtaaacgttacgaccggaaacggtaacggaacccggtaaccccggtaacccccgg

SEQ ID NO: 414387 - DNA, 564 bp, Homo sapiens
  misc_feature: GZ8MTXP02HW1R9.51.40.D07.1.454.CMB.2.raw
  modified_base (287)..(287): a, c, t, g, unknown or other
  modified_base (361)..(361): a, c, t, g, unknown or other
  modified_base (385)..(385): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcgtgggttttcctcgttgctcttttaagaggtgtccagtgtcaggtgcagctcgtggagtcgtgggggagcgtggtccagcctgggagtccctgagactctcctgtgtagtctctggattccaccttcgagggtntacgacatgcacgtgggtccgccaggcctccgaggccgaaaggggcttaggggaggtggggtgactagttttanatcacgatgagtaggaaagtaacnttaacatgacagacgtcgtagaagggcctatcacatcaccagacgactaataccaaagaccacgacttgtttcagcaagatagaaacgacgagagagacgtagaggacgacggtcgttacgtttacgttactgtgtaacgtaactaactacgacggacggacgaaccggtaacccccgg

SEQ ID NO: 414388 - DNA, 591 bp, Homo sapiens
  misc_feature: GZ8MTXP02JW3IV.51.40.D07.1.454.CMB.2.raw
  modified_base (283)..(283): a, c, t, g, unknown or other
  modified_base (304)..(304): a, c, t, g, unknown or other
  modified_base (347)..(347): a, c, t, g, unknown or other
  modified_base (353)..(353): a, c, t, g, unknown or other
  modified_base (369)..(369): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgttcttttaagaggtgtccagtgtcaggtgcagctcgtggagtctgggggagcgtggtccagcctgggagtccctgagactctcctgtgtagtctctggattcaccttcagggtntacgacatgcacgtgggtccnccaggcctccgaggcaaggggctgggagtggggtgctatttanatccantgatggaaataaaacntactatgcagagtccgtaggaacggcgattcacactcacgagacaatacaacgaacaacactacgtttactcgtacaaccgtaataacgaaaacgaccgtacgaggacgacgtacgaggaacgacggacgttacgtttaagttactacgtagtaaccgtaacgttaaacgtacgtaacgggacggaaccgtaacccggtaacccccggtacccggtacccgg

SEQ ID NO: 414389 - DNA, 597 bp, Homo sapiens
  misc_feature: GZ8MTXP02F32WL.51.40.D07.1.454.CMB.2.raw
  modified_base (289)..(289): a, c, t, g, unknown or other
  modified_base (311)..(311): a, c, t, g, unknown or other
  modified_base (358)..(358): a, c, t, g, unknown or other
  modified_base (364)..(364): a, c, t, g, unknown or other
  modified_base (380)..(380): a, c, t, g, unknown or other
  modified_base (419)..(419): a, c, t, g, unknown or other
  modified_base (424)..(424): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggaggcgtggtccagccgtggggacgtccctgagactctcctgtgtagtctctggattcaccttcgagggtntacgacatgcacgtgggtcccnccgaggcctccgaggcgaagggggctgggaggtggggtgctatttanactcanatgataggaaataacntaactatgacagacgtccgtagaagggccattcacatcncaganacaataccaaagaacactacttgttactgactaacataacgaaaacgcctaggaagagcgtaggaacgggacacgggtacttagttttaacttacgtggttacgtaaccgttaaaactttaacgtaccggaaaccgggaacggaaacccgtaaaccccggggttaaccccccg

SEQ ID NO: 414390 - DNA, 595 bp, Homo sapiens
  misc_feature: GZ8MTXP02GLALY.51.40.D07.1.454.CMB.2.raw
  modified_base (288)..(288): a, c, t, g, unknown or other
  modified_base (318)..(318): a, c, t, g, unknown or other
  modified_base (356)..(356): a, c, t, g, unknown or other
  modified_base (361)..(361): a, c, t, g, unknown or other
  modified_base (376)..(376): a, c, t, g, unknown or other
  modified_base (506)..(506): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcttgggttttcctcgttgctcttttaagaggtgtccagtgtcaggtgcagctcgtggagtcgtgggggagcgtggtccagccgtgggacgtccctgagactctcctgtgtagtctctggattcaccttcgagggtntacgacatgcacgtgggtcccgccaggccnccgaggcgaaggggctgggaggtggggtgctagtttanatcantgataggaaataacntactatcgacagacgtccgtaggaacggggtcctattccaacatcctaccaggaacgtaacctaaacttacccaaaagaaaccaactactttcgtttacacgacaacgataagaaaacgcctagagtacncgtaggacgacgacggtcttagtttactacgtgtacgtaacgtaaactttacgacgaacgggacgtaaccgaacccgggttaacccccg

SEQ ID NO: 414391 - DNA, 572 bp, Homo sapiens
  misc_feature: GZ8MTXP02GMRZ3.51.40.D07.1.454.CMB.2.raw
  modified_base (287)..(287): a, c, t, g, unknown or other
  modified_base (308)..(308): a, c, t, g, unknown or other
  modified_base (339)..(339): a, c, t, g, unknown or other
  modified_base (348)..(348): a, c, t, g, unknown or other
  modified_base (373)..(373): a, c, t, g, unknown or other
  modified_base (417)..(417): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggagcgtggtccagccgtgggagtccctgagactctcctgtgtagtctctggacttcaccttcgaggggtntacgacatgcacgtgggtccnccaggctccaggcaaggggctgggagtgggngctatttanatcacatgattaggaaagtaaaccntaactatgcaagacgtcccggtagaacgggccgattcaccatcnccaagacgaacaatccaaagaaccactacttgttactgacaactaatacgaaaagtcctaggagagctggacggacacggtcttagtttacttactgtacgaacgtaactttaacgtacgacggaacggtaacccgtaacccggtaaccccccgg

SEQ ID NO: 414392 - DNA, 553 bp, Homo sapiens
  misc_feature: GZ8MTXP02HDX4O.51.40.D07.1.454.CMB.2.raw
  modified_base (285)..(285): a, c, t, g, unknown or other
  modified_base (350)..(350): a, c, t, g, unknown or other
  modified_base (357)..(357): a, c, t, g, unknown or other
  modified_base (373)..(373): a, c, t, g, unknown or other
  modified_base (410)..(410): a, c, t, g, unknown or other
  modified_base (414)..(414): a, c, t, g, unknown or other
  modified_base (458)..(458): a, c, t, g, unknown or other
  modified_base (465)..(465): a, c, t, g, unknown or other
  modified_base (482)..(482): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagcctgggagtccctgagactctcctgtgtagtctctggattcaccttcgagggtntacgacatgcacgtgggtccgccaggcctccgaggcaaggggctgggagtggggtgctagtttanactcacntgatggaaaataaacntaactatgcagagtccgtagaagggccatcacactcnccanagacactacaaagacactacttgtctagacactataacgaaacnctagagngactaggacgacacgtnttagtttactacgtgtacgtaacgtaaacttaacgacgaaacggtacgaacccgtaacccggtacccccgg

SEQ ID NO: 414393 - DNA, 616 bp, Homo sapiens
  misc_feature: GZ8MTXP02F7HT5.51.40.D07.1.454.CMB.2.raw
  modified_base (181)..(181): a, c, t, g, unknown or other
  modified_base (386)..(386): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgcttcttttaagnggtgtccagtgtcaggtgcagctcgtggagtcgtgggggagcgtggtccaggcctggggacgtccctgagactctctgtgtagtctctggattcaccttcgagggtgtacgacagtgcacgtgggtccgccaggcctccgaggccgaaggggctgggagtggggtgctatttagactcaactatagacgttagggaaaataaacngtaaactagtgacaaggtacggtccggtaggaacgggcccgtattaccaaccgtatcctaccagaacgaactaacttaccaaacgaacactacttgttactgacaactataacgaaaacgtccagagacgtcgtaggacggactacgggttacttagtttacttacgttggtacgtaacgtaaacttaacgtacggaacggaacggaacccgtaacccggttaacccccg

SEQ ID NO: 414394 - DNA, 719 bp, Homo sapiens
  misc_feature: GZ8MTXP02I7V7O.51.40.D07.1.454.CMB.2.raw
  modified_base (284)..(284): a, c, t, g, unknown or other
  modified_base (306)..(306): a, c, t, g, unknown or other
  modified_base (360)..(360): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagccgtgggagtccctgagctctcctgtgtagtctctggattcaccttcagggtntacgacatgcacgtcgggtccnccgaggtcctccgagggccgaaggggctgggaggttggggtggctaagttttanactcgaactatagagtaaggaaaacgtaaacagttaactagtcgacgaaggtacggttcccggtaaggaacgggtcccgtaacttccgaacctaactcctacccgaagtaacgtaactaaacgttacccaaaaaggtaaaccctaacgtaaccgttttgtttaccctacggtaccaaacgtaacgttaaaggaaaacgtccgtaaggagaacggtacgtaggggaaacggtaaccggtaaaccggttacgtttaacggtttttaacttaaccgtggttacgtaaaccgttaaaaccgtttaaagacccggtaaaacgggtaaccggaaaccccggtaaaacccggttaaacccccccgg

SEQ ID NO: 414395 - DNA, 562 bp, Homo sapiens
  misc_feature: GZ8MTXP02INN0W.51.40.D07.1.454.CMB.2.raw
  modified_base (284)..(284): a, c, t, g, unknown or other
  modified_base (348)..(348): a, c, t, g, unknown or other
  modified_base (370)..(370): a, c, t, g, unknown or other
  modified_base (376)..(376): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagcctgggagtccctgagactctcctgtgtagtctctggattcaccttcagggtntacgacatgccacgtgggtccgccaggcctccgaggcaaggggctggagtggggtgctatttanatcacatgatacggaaataacntactangcagagtccgtagaaggccgattcaccatctaccagagacaatcaaagaacacacttgttctgacacatagaaaacgtcctagaagagcgtaggaacggacgaacgggtcttagtttacttacgtgtagtaacgtaaacgtttaacgacgaacggtaacggaacccgtaaacccggtaacccccgg

SEQ ID NO: 414396 - DNA, 580 bp, Homo sapiens
  misc_feature: GZ8MTXP02HM7TV.51.40.D07.1.454.CMB.2.raw
  modified_base (290)..(290): a, c, t, g, unknown or other
  modified_base (365)..(365): a, c, t, g, unknown or other
  modified_base (456)..(456): a, c, t, g, unknown or other
  modified_base (467)..(467): a, c, t, g, unknown or other
  modified_base (485)..(485): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagccgtgggagtccctgacgactctcctgtgtagtctctggacttccaccttcgagggttntacgacatgccacgtcgggtccgccaggcctcgaggcgaaggggctgggaggtggggcgctagtttacatccgantagactagggaaataacattaacatgcaaggagtacccggtagaacgggcctatcactatcaccagacactactacaaagacactacgttnttcagacctanagtaagaaacgtcagagntcgaggacggacacggtctttaagtttactacgttagtcaacggttaaacttaacgaccggaaacggaccgtaaccgtaaccccgggtacccccg

SEQ ID NO: 414397 - DNA, 584 bp, Homo sapiens
  misc_feature: GZ8MTXP02IHOKI.51.40.D07.1.454.CMB.2.raw
  modified_base (199)..(199): a, c, t, g, unknown or other
  modified_base (308)..(308): a, c, t, g, unknown or other
  modified_base (356)..(356): a, c, t, g, unknown or other
  modified_base (362)..(362): a, c, t, g, unknown or other
  modified_base (380)..(380): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctctttttaagaggtgtccagtgtcaggtncagctcgtggagtcgtgggggagcgtggtccagcctgggagtccctgagctctcctgtgtagtctctggattcaccttgagggtctacgacatcgctacgtcgggtccnccgacggcctccgaaggccgaaaggggctagggagtgggtgctatttnactcanatgataggaaagttaacnttactagtgcagagtccgtagaggcgtatcgacatctacagagaacactacaaagacacacttgttctgacacatagaaaacgtcgtagacgagacgtaggaacgaccgtacggtacgttagttttacgttacgttagtacgtaacgtaacttaaacgtaccggaacggtaaccggtaaccgtaaaccccgggttaacccccgg

SEQ ID NO: 414398 - DNA, 546 bp, Homo sapiens
  misc_feature: GZ8MTXP02IHQ9G.51.40.D07.1.454.CMB.2.raw
  modified_base (287)..(287): a, c, t, g, unknown or other
  modified_base (308)..(308): a, c, t, g, unknown or other
  modified_base (351)..(351): a, c, t, g, unknown or other
  modified_base (372)..(372): a, c, t, g, unknown or other
  modified_base (425)..(425): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctggggtttttcctcgttgctctttttaagaggtgtccagtgtcaggtgcagctcgtggagtctgggggaggcgtggtccagcctgggagtccctgagactctcctgtgtagtctctggattcaccttcagggtntacgacatgcacgtgggtccnccaggcctccgaggcgaaggggctgggagtgggtgctatttanatcacatgataggaaataacntactatgacagagtccgtagaggccgatcaccatctccagagacaatacaaanaacacacttgtttctgcacatagaaacgctagagagctagaggacacggtacttagtttacttacgttgtagtaacgtaaacttacgtacgaacggacgaaccgaacccggtaacccccgg

SEQ ID NO: 414399 - DNA, 583 bp, Homo sapiens
  misc_feature: GZ8MTXP02GZD64.51.40.D07.1.454.CMB.2.raw
  modified_base (286)..(286): a, c, t, g, unknown or other
  modified_base (352)..(352): a, c, t, g, unknown or other
  modified_base (359)..(359): a, c, t, g, unknown or other
  modified_base (502)..(502): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagccgtgggagtccctgagctctcctgtgtagtctctggattccaccttcgagggtntacgacatgcacgtgggtccgccaggcctccgaggcgaaggggctggggagtggggtgctatttanactcatntgataggaaaataacataactagtgacagacgtccggtagacggcctatcacatcacagacacaactaccaaagaacactacttgtttcacgactaacagtaacgaaacgcgtagaacgagacgtacggacggacgtacggtntttacgtttacttacgtagtacgtaacgttaaacgttaacgtacggaacggtaacggaacccgtaaccccggtaacccccg

SEQ ID NO: 414400 - DNA, 697 bp, Homo sapiens
  misc_feature: GZ8MTXP02JPLM4.51.40.D07.1.454.CMB.2.raw
  modified_base (286)..(286): a, c, t, g, unknown or other
  modified_base (306)..(306): a, c, t, g, unknown or other
  modified_base (353)..(353): a, c, t, g, unknown or other
  modified_base (383)..(383): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagccgtgggacgtccctgagctctcctgtgtagtctctggattcaccttcgagggtntacgacatgcacgtgggccncgaggctccgaggcgaaggggctggggagtggggtgctaagttttanactcactagtagaagtaggaaaataaaccnttaaactagtcgacaaggtacgtacccggtagggaaacgggtcccgtaagttacccaaccctagttaccgtaccaagtaacgaaacctaaacttaacccgaaaacgtaaacctaaccgtaacgtttcgttttaacctacggtaacctaaaccgtaagttaaacggaaaaccggttaccgtagggaaacgtaggaccgttaacgggaacggaaccggtacggtacgtttagtttaacgtacgttagtacgtaacgtaaaacgtttaacgtacggaaccggtaaccggaaacccgtaaccccggttaaacccccgg

SEQ ID NO: 414401 - DNA, 537 bp, Homo sapiens
  misc_feature: GZ8MTXP02J26GC.51.40.D07.1.454.CMB.2.raw
  modified_base (285)..(285): a, c, t, g, unknown or other
  modified_base (306)..(306): a, c, t, g, unknown or other
  modified_base (349)..(349): a, c, t, g, unknown or other
  modified_base (355)..(355): a, c, t, g, unknown or other
  modified_base (381)..(381): a, c, t, g, unknown or other
  modified_base (387)..(387): a, c, t, g, unknown or other
  modified_base (400)..(401): a, c, t, g, unknown or other
  modified_base (403)..(403): a, c, t, g, unknown or other
  modified_base (408)..(408): a, c, t, g, unknown or other
  modified_base (416)..(416): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagcctgggagtccctgagactctcctgtgtagtctctggattcaccttcgagggtntacgacatgcacgtgggtccnccaggcctccgaggcgaaggggctgggagtgggtgctatttanactcanatgataggaaataactacatgacagngtccgngaaggccatcacnncncaganacatcaanacacactgttctgacacagtagaaaacgcctagagagcgtagaggacacggtcttagtttactacgtagtacgaacgtaaacttaacgacgtaacggacgaaccgaacccggtaacccccg

SEQ ID NO: 414402 - DNA, 619 bp, Homo sapiens
  misc_feature: GZ8MTXP02ICJXX.51.40.D07.1.454.CMB.2.raw
  modified_base (286)..(286): a, c, t, g, unknown or other
  modified_base (336)..(336): a, c, t, g, unknown or other
  modified_base (345)..(345): a, c, t, g, unknown or other
  modified_base (351)..(351): a, c, t, g, unknown or other
  modified_base (366)..(366): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagccgtgggagtccctgagactctcctgtgtagtctctggattcaccttcgagggtntacgacatgcagtgggtccgcaggctccgaggcaaggggctggagtgggngctatttanatcatntgataggaaataacntaatagtgtacgagagtcccggtagaacggggcctagttccacgacttcgtaccaagacgaaactacttaaccaaagaacctaccaacgtttcgtttcagacctaacaagttaagaaaacgtcctaaggagacgacgtaaggacggaccgaacggttccttaagttttacgtaccgtttaggtacgtaaccggtaaaactttaacgaccgaaaacgggccggtaaacccgtaaacccgggttaacccccccgg

SEQ ID NO: 414403 - DNA, 708 bp, Homo sapiens
  misc_feature: GZ8MTXP02H2P24.51.40.D07.1.454.CMB.2.raw
  modified_base (246)..(246): a, c, t, g, unknown or other
  modified_base (308)..(308): a, c, t, g, unknown or other
  modified_base (358)..(358): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcggtggagtcgtgggggagcgtggtccagccgtgggagtcccngagactctcctgtgtagtctctggattcaccttcgagggtgtacgacatgcacgtgggcccnccgaggcctacgaggcgaaggggctgggagtggggtacgctaagttttanagtccaactagtagaagttaaggggaaaagttaaaccagtttaaactaagttcgactaaggacggttacccgggtaaggaaacggggacccgtacgttaccgacctaacgttacctaccgaagaacgaaactaacttaaccaaaggtaaaacctacgtaactttgtttaccgtcgacctaacgtaacgtaacggaaaacgtccgttaagacggaacgtaccgtaggaacggtaccgacggttacgttaggtttttaacgttcctacgggttacgtaaccggttaaaacgtttaaacgaccggtaaacgggtaaaccggtaaccccgtaaaaccccgggttaaccccccgg

SEQ ID NO: 414404 - DNA, 669 bp, Homo sapiens
  misc_feature: GZ8MTXP02GE0U4.51.40.D07.1.454.CMB.2.raw
  modified_base (283)..(283): a, c, t, g, unknown or other
  modified_base (349)..(349): a, c, t, g, unknown or other
  modified_base (381)..(381): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgcttcttttaagaggtgtccagtgtcaggtgcagctgtggagtctgggggagcgtggtccagcctgggagtccctgagactctctgtgtagtctctggattccaccttgagggtntacgacatgacacgtgggtccgccaggcctccgaggcgaaggggctggagtgggtgactagtttanactcactatgtataggaaaataacatactagngacgagtcgtccggtagaacggccgtactccactactactaccgaagtaacgaactaaactaaccaaaacgaaacctaactacgttacgtttactacgtaacctaacgaacgtaaacgaaaacgtcgtaacggaaggtacgtacggtaacgggtaacggaaacgtaccgggttactttacggtttaacgttacgttacgggttacgtaaaccgtttaaaaccgttaaacgtaccggtaaaccgggtaaaccggtaaaaccccggtaaaaccccggggttaacccccgg

SEQ ID NO: 414405 - DNA, 554 bp, Homo sapiens
  misc_feature: GZ8MTXP02I0IYQ.51.40.D07.1.454.CMB.2.raw
  modified_base (278)..(278): a, c, t, g, unknown or other
  modified_base (284)..(284): a, c, t, g, unknown or other
  modified_base (347)..(347): a, c, t, g, unknown or other
  modified_base (371)..(371): a, c, t, g, unknown or other
  modified_base (439)..(439): a, c, t, g, unknown or other
  modified_base (468)..(468): a, c, t, g, unknown or other
  modified_base (493)..(493): a, c, t, g, unknown or other
tcagcgatcgtatacacgaccggtgctcgatttagtgatagagcgtaacaacagagggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagcctgggagtccctgagactctctgtgtagtctctggattcaccttnagggtntacgacatgcacgtgggtccgccaggcctccgaggcaaggggctgggagtgggtgcagtttanatcacatagactaggaaataaacnttaacatgcaaggacgtccggtagaacggccgattccaactatctaccaagacgacaattaccgaaanaacacactttgttctgacacatagaaacnctagagtagctaggacgacacggtnttagtttatacgtgtagcgtaaacttaagcgaacggaccgaacgaacccggtaacccccgg

SEQ ID NO: 414406 - DNA, 683 bp, Homo sapiens
  misc_feature: GZ8MTXP02GM1L0.51.40.D07.1.454.CMB.2.raw
  modified_base (287)..(287): a, c, t, g, unknown or other
  modified_base (365)..(365): a, c, t, g, unknown or other
  modified_base (389)..(389): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcttgggttttcctcgttgcttcttttaagaggtgtccagtgtcaggtgcagctcggtggagtcgtgggggagcgtggtccagccgtgggacgtccctgagctctctgtgtagtctctggacttcacttgagggtntacgacatcgcctacggtcgggtcccgccgaggcctaccgaggcggaaggggctggggaggttggggtgactatttanatcatatgaataaggaaaataacnttaactatgacaaggacggtccggaggaacggccgtacttaccacctaagtcctaccgaagaacgtaaactaacttaacccaaaacgtaaacctaacctacgtttgtttaccgtacgaacctaaccgtaaagtaacggaaaacgtccgtaaggaacggtacgtacggtaacggaacgggtaaccgtacggttacgtttaagttttaacgttacgttggtaacgtaaccgttaaaacttaacgtaccggtaaacgggaaccggtaaacccgtaaacccccgggttaaccccccgg

SEQ ID NO: 414407 - DNA, 555 bp, Homo sapiens
  misc_feature: GZ8MTXP02JIV1Q.51.40.D07.1.454.CMB.2.raw
  modified_base (283)..(283): a, c, t, g, unknown or other
  modified_base (348)..(348): a, c, t, g, unknown or other
  modified_base (371)..(371): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagccgtgggagtccctgagctctctgtgtagtctctggattcaccttcagggtntacgacatgcacgtggtccgcaggcctaccgaggcgaaaggggctgggaggtgggtgctatttanactcacatgataggaaaataacntaactatgctaagacgtccgtagaacgggcctatcaccatccaccaaggacacaattcaaagacacacttgttactgacacagtagaaatcgagagagctagacggtacacggtacttagtttactacgtgtagaacgtaaacttaagtcgaacggacgaaccgtaaacccggtaaccccccgg

SEQ ID NO: 414408 - DNA, 702 bp, Homo sapiens
  misc_feature: GZ8MTXP02HGVEK.51.40.D07.1.454.CMB.2.raw
  modified_base (250)..(250): a, c, t, g, unknown or other
  modified_base (293)..(293): a, c, t, g, unknown or other
  modified_base (384)..(384): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcttgggttttcctcgttgcttcttttaagaggtgtccagtgtcaggtgcagcgtcggtggagtcggtgggggagcgtggtccagccgtgggacgtccngacgctctctgtgtagtctgtgtacttccacgttgacgggttnacgacagtcgccgtacggtcgggtcccgaccgaggccctaccggagggtacggaaggggtcgtggggtaggttgggtacgtacttatttanactacaatagtagtaagtaaggtaaaaactaactacttaactagtacgacgtaaggacggttacccgggtaagggaaccggtaccctaacttacccgaaccgttataccgtaccgaaaggaaacctaaacctaacttaacccgaaaactaaccttaaccgtacggtttattaccgtaaggaccctaaagtaggtaaacggaaaacgtcggaagaggtaccgtcggaaggaccggtacgttaccgttattagtttacgtagtcggtaactaacgttaaactacgacggtaacggtaccgaacccgtaacccggtccccg

SEQ ID NO: 414409 - DNA, 550 bp, Homo sapiens
  misc_feature: GZ8MTXP02GVFKX.51.40.D07.1.454.CMB.2.raw
  modified_base (285)..(285): a, c, t, g, unknown or other
  modified_base (306)..(306): a, c, t, g, unknown or other
  modified_base (346)..(346): a, c, t, g, unknown or other
  modified_base (436)..(436): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggaggcgtggtccagcctgggagtccctgagactctcctgtgtagtctctggattcaccttcagggtntacgacatgcacgtgggtccnccaggcctccgaggcaaggggctggagtgggtgcatttanatcacatgataggaaagtaacatactagtgacagagtccgtagaagggccgtatcgaccatcctaccagacgaacaataccaaagaacanacttgttactgacacatagaaaagctagagagcgtagacggacacggtcttagtttattactgtagaacgtaacttaactcgaacggtacggaccgaaaccggttaacccccgg

SEQ ID NO: 414410 - DNA, 561 bp, Homo sapiens
  misc_feature: GZ8MTXP02JWABA.51.40.D07.1.454.CMB.2.raw
  modified_base (288)..(288): a, c, t, g, unknown or other
  modified_base (311)..(311): a, c, t, g, unknown or other
  modified_base (357)..(357): a, c, t, g, unknown or other
  modified_base (364)..(364): a, c, t, g, unknown or other
  modified_base (380)..(380): a, c, t, g, unknown or other
  modified_base (387)..(387): a, c, t, g, unknown or other
  modified_base (421)..(421): a, c, t, g, unknown or other
  modified_base (444)..(444): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggaggcgtggtccagccgtggggagtccctgagactctcctgtgtagtctctggattcaccttcgagggtntacgacatgccacgtgggtcccnccgaggcctccgaggcgaaggggctggggagtggggtgctatttanactcatntagataggaaataacntaactangacagacgtcgtagacggcgatcacatctcaganacgggactacaacgaacacactnttctgcacagtagaaacgctagagagcgtaggacggacgacgtcgttacgtttattacgttgtacgtaacgtaacttacgtacgacggaacggtaaccgtaacccggtaacccccgg

SEQ ID NO: 414411 - DNA, 602 bp, Homo sapiens
  misc_feature: GZ8MTXP02IAG7X.51.40.D07.1.454.CMB.2.raw
  modified_base (286)..(286): a, c, t, g, unknown or other
  modified_base (359)..(359): a, c, t, g, unknown or other
  modified_base (381)..(381): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcggtggagtcgtgggggagcgtggtccagcctgggagtccctgagactctcctgtgtagtctctggattcaccttcgagggtnacgacatcgctagtcggggtccgccaggcctccgagggccgaagggggctggggaggtggggtgctagtttanactcacatgataggaaataacnttactatgacagacgtccgtagaacggccgtattccaccatcctaccaagacgaactaaacttaccgaaagaaccactacttagtttcagacaacaatagaaaacgccgtagaacgagacgtaggacggactacggtacttagtttactacgttagtacgtaacgtaacttaacgtacgtaacgggtaaccggtaaccggtaaaccccggtaaccccccgg

SEQ ID NO: 414412 - DNA, 586 bp, Homo sapiens
  misc_feature: GZ8MTXP02HR7KD.51.40.D07.1.454.CMB.2.raw
  modified_base (198)..(198): a, c, t, g, unknown or other
  modified_base (341)..(341): a, c, t, g, unknown or other
  modified_base (348)..(348): a, c, t, g, unknown or other
  modified_base (352)..(352): a, c, t, g, unknown or other
  modified_base (370)..(370): a, c, t, g, unknown or other
  modified_base (380)..(380): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtncagctcgtggagtcgtgggggagcgtggtccagcctgggaggtccctgagctctcctgtgtagtctctggattcaccttcgagggtgtacgacatgcacgtcgggtccgcaggctccgaggcgaaggggctgggagtgggtgntatttanactnacatgataggaaataacntactatcganagacgtccgagaacggcgatcacatctaccagacgacactaccaaagaaccactacttgttactagacaacataagaaactcgtagagtacgcgtaggacggaccgaacggtctttacggttttaacttacgttacggtacgtaacgttaaacttaacggtacgaaacggtaaccggaaacccgtaaacccccggttaacccccgg

SEQ ID NO: 414413 - DNA, 559 bp, Homo sapiens
  misc_feature: GZ8MTXP02GW105.51.40.D07.1.454.CMB.2.raw
  modified_base (287)..(287): a, c, t, g, unknown or other
  modified_base (358)..(358): a, c, t, g, unknown or other
  modified_base (365)..(365): a, c, t, g, unknown or other
  modified_base (381)..(381): a, c, t, g, unknown or other
  modified_base (414)..(414): a, c, t, g, unknown or other
  modified_base (420)..(420): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagccgtgggacgtccctgagctctcctgtgtagtctctggattccaccttcgagggtntacgacatgcacgtcggggtcccgccaggcctaccgaggacgaaggggctgggaggtggggtgctatttanacgtcantagataggaaataacntactatgacagcgtcgagacggctatcacatcnccaganacactacaaagacactattgttctgacaacagtaagaaacgctagagagcgtaggacggacacggtcttagtttactacgtagtacgtaacgtaaactacgtacgaacgggaaccgaaccgtaaacccggtacccccgg

SEQ ID NO: 414414 - DNA, 852 bp, Homo sapiens
  misc_feature: GZ8MTXP02I7062.51.40.D07.1.454.CMB.2.raw
  modified_base (391)..(391): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagccgtgggacgtccctgagactctcctgtgtagtctctggacttcacctttcgagggttacgtacgactagtcgacctacggtcgggtcccgccgtaggcctacccgagggaccggaagggggtcctaggggacggttgggggtagcgttaaagtttttanaacgtcctaacagttaggtaagttaaggggaaaaaacgttaaaacctagttaaaccttaaagttaccgggaagaaacgggtaaccgggttacccggggttaaacggggaaaacgggggtacccccgttaaactttaccccgaaacccctaaacgttcccttaacccgaaagggtaaacgtaaacctaaaacctttaaaccccgaaaagaaacccctaaacgtacccttttacgtttaccctacgtaaccccgtaaaacgtaaacgttaaaacggaaaacgtaccgtaaggaaacgggtacgtacggtaacggggaacggtaaacccggtacggttaacgttttaacggttttaaccgttaaccggttacggtaaccgtaaaaccgttaaaacgtttaacgaacccgggaaaacggggtaaacccggtaaaacccggtaaacccccgggtttaaacccccgg

SEQ ID NO: 414415 - DNA, 760 bp, Homo sapiens
  misc_feature: GZ8MTXP02GCRAV.51.40.D07.1.454.CMB.2.raw
  modified_base (285)..(285): a, c, t, g, unknown or other
  modified_base (306)..(306): a, c, t, g, unknown or other
  modified_base (357)..(357): a, c, t, g, unknown or other
  modified_base (390)..(390): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagcctgggagtccctgagactctcctgtgtagtctctggattcaccttcgagggtntacgacatgcacgtgggtccnccaggcctccgagggccgaagggggctgggaggttggggtgctaattttanactcaactagtgaagttagggaaaattaaacgnttaaactagtgacgtaaggacggttccggtagggaaacggggtcccggtaattaccgaaccctacttacccgtacccgaaaggaaccggtaaactaaacctttaacccgaaaacggtaaaccctaaaccgtaaccgttttacgttttacctacggtacctaaaccgtaaagttaaacggaaaaacgtcccgttaagggaagaacgggtacctaaggggaaccgggtaaacggtaccggggttacgtttacggtttttaacgttaaaccgttggttaacggtaaccggttaaaactttaaacggtacccgggaaaccggggtaaaccgggtaaaccccgtaaaacccccgggggtttaaaccccccccggg

SEQ ID NO: 414416 - DNA, 640 bp, Homo sapiens
  misc_feature: GZ8MTXP02H4MYL.51.40.D07.1.454.CMB.2.raw
  modified_base (200)..(200): a, c, t, g, unknown or other
  modified_base (319)..(319): a, c, t, g, unknown or other
  modified_base (374)..(374): a, c, t, g, unknown or other
  modified_base (410)..(410): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcttgggttttcctcgttgcttcttttaagaggtgtccagtgtcaggtncagctcgtggagtcgtgggggagcgtggtccagccgtgggagtccctgacgctctcctgtgtagtctctggtattccaccttcgaggggttctacgacagtgcctacgtcggggtcccnccgaggcctaccggaggcgaagggggtctggggaggtggggtcgtctaagtttanaccgtcaactagtggaactaagggtaaaactaaacnttaactagtgacaggtactccgtagaacgggcgtactcacactacctaccgaagaacgaacctaacttaaccgaaataacctactaactttgtttcacgtacaactaacgtaagaaaacgtccgaagagagacgtaggaacgtacgtacgtctttacgtttagtacgttcgtacgaacgttaaacttaacgacgtaacggacgaaacccggtaacccggttaacccccgg

SEQ ID NO: 414417 - DNA, 575 bp, Homo sapiens
  misc_feature: GZ8MTXP02H22UX.51.40.D07.1.454.CMB.2.raw
  modified_base (248)..(248): a, c, t, g, unknown or other
  modified_base (289)..(289): a, c, t, g, unknown or other
  modified_base (377)..(377): a, c, t, g, unknown or other
  modified_base (454)..(454): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcggtggagtcgtgggggagcgtggtccagccgtggggacgtcccngagcttctcctgtgtagtctctggattcaccttcaggggtntacgacatgcacgtgggtcccgcaggcctcgaggcgaaggggctgggaggtggggtgctattatatcacatgataggaaaattaaacntaatatgactagcgtcgagaacggcactacactatcacagacaacactacaaagaaacactacttgttactagacanataagaaacgctaagagagacgtacggacgaacgtacgtacttacgttttaactacgttagtacgtaacgtaaacgttaacgtacggaacggtaacggtaaccgtaaacccggtacccccg

SEQ ID NO: 414418 - DNA, 672 bp, Homo sapiens
  misc_feature: GZ8MTXP02JBIT5.51.40.D07.1.454.CMB.2.raw
  modified_base (198)..(198): a, c, t, g, unknown or other
  modified_base (285)..(285): a, c, t, g, unknown or other
  modified_base (305)..(305): a, c, t, g, unknown or other
  modified_base (341)..(341): a, c, t, g, unknown or other
  modified_base (351)..(351): a, c, t, g, unknown or other
  modified_base (378)..(378): a, c, t, g, unknown or other
  modified_base (386)..(386): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtncagctcgtggagtcgtgggggagcgtggtccagcctgggagtccctgagtctctcctggtgtagtctctggatcaccttcgagggtntacgacatgcacgtgggccnccgaggcctcgaggcgaaggggctggggagtggggngctagtttanactcatagtgagtagaaaagtaaactntaactagngacgagtacgtcggaggaacggtaccgtactacactactaccgaccaacgaacaactaactaaccgaaacgaaacctacgtacttacgtttacacgtacaacgtaagtaacggaaacgtaccggtaagaacggtacgtacggtacgggtaacgggtaaccgtaacgggttacgtttaacggttttaacgttacgttaacggttacggtaaccgttaaaacgtttaacggtaaccggtaaaccgggtaaccggtaaaacccggttaaacccccgggttaacccccgg

SEQ ID NO: 414419 - DNA, 579 bp, Homo sapiens
  misc_feature: GZ8MTXP02H1GKN.51.40.D07.1.454.CMB.2.raw
  modified_base (277)..(277): a, c, t, g, unknown or other
  modified_base (283)..(283): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggaggcgtggtccagcctgggagtccctgagctctcctgtgtagtctctgattcaccttnagggtntacgacatgcacgtgggtcccgccaggcctccgaggcaaggggctgggagtggggtggactagtttatatcactagtgatagggaaaataacattaactagtgacaggagtcccgtagaggcagtcaccatcaccagagacaacttaccaaagaaccacacttgttctcgactacatagaaaacgccgtagacgagctacggacggacgtacggtcgtttagtttacttaacgtgtacgtaacgtaaaacttaacgtaccgaaggtaaccggtaaccgaaaccccggtaacccccg

SEQ ID NO: 414420 - DNA, 592 bp, Homo sapiens
  misc_feature: GZ8MTXP02JP46K.51.40.D07.1.454.CMB.2.raw
  modified_base (442)..(442): a, c, t, g, unknown or other
tcagcgatcgtatacacgaccggtgctcgatttagtgatagagcgtaacaacagagggggagtcagtcccaaccaggacacagcatggacatgagggtccctgctcagctcctggggctcctgctgctctggctctcaggtgccagatgtgacatccagatgacccagtctccatcctccctgtctgcatctggtaggagacagagtcaccatcacttgccaggcgagtgaggactattagtaacttaattaaatgtatcagacaagaaaccgagggacaaacgacccctaaactcctagactctaacgatcgactatacctaagtttacggaaacgtccggggtacccagtacgtaaggttcgaggttgggagttggttcgtagggactagttacttttacttcaactatacagcacgtcccttacgaccctagaaacgtnttacgtactacaaactattacttactagtacaacgtatatagtaataaccttctaccctacttcgttacgttacgggacggaacggaaccgtaaggtacggaacgtaactaacgaaaccgtagtacggtcggactacgacaccgttaacg

SEQ ID NO: 414421 - DNA, 722 bp, Homo sapiens
  misc_feature: GZ8MTXP02IVCOW.51.40.D07.1.454.CMB.2.raw
  modified_base (286)..(286): a, c, t, g, unknown or other
  modified_base (309)..(309): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagccgtgggacgtccctgagactctcctgtgtagtctctggattcacttcgagggtntacgacatgcacgtggggtcccnccaggcctaccgagggcgaaagggggtcttaggggagttggggtgctaagtttttacactccaacgtagtggaagttaggggaaaaactaaaccattaactagtcgacgtaaggtacggttcccggtagggaaacgggggtccctaagttacccaaccgtagttcctaccgaaggaacgaaacctaacttaccaaaacgaaacctaacctacgttttacggttttaccaggtacctaaacgtaagttaacggaaaaaaccggtcccttaagggaaacggacggtacccgtaggggaaaaccggtacggtaacccgggttactttagggtttttactacgttaggtacgtaacgttaaactttaacgacggaaacggtaacggaaaccccggtaacccggttaaacccccccgg

SEQ ID NO: 414422 - DNA, 557 bp, Homo sapiens
  misc_feature: GZ8MTXP02I9D0Z.51.40.D07.1.454.CMB.2.raw
  modified_base (352)..(352): a, c, t, g, unknown or other
  modified_base (358)..(358): a, c, t, g, unknown or other
  modified_base (374)..(374): a, c, t, g, unknown or other
  modified_base (445)..(445): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagccgtgggacgtccctgagactctcctgtgtagtctctggattccaccttcgagggtgtacgacatgcacgtcgggtccgccaggctccgaggcgaaggggctgggagtgggtgctatttanactcanatgataggaaataacntactatgacagacgtcgtgaaggtccattcacatctcagacgaacaacttacaaagaacactacttgttcngactacatacgaaacgctagacgagcgtaggaggacacggtcttagtttacgtacgtgtacgaacgtaaattacgacgtaacggacggtaaccgaaacccggtaacccccgg

SEQ ID NO: 414423 - DNA, 684 bp, Homo sapiens
  misc_feature: GZ8MTXP02IQE2P.51.40.D07.1.454.CMB.2.raw
  modified_base (312)..(312): a, c, t, g, unknown or other
  modified_base (358)..(358): a, c, t, g, unknown or other
  modified_base (368)..(368): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcggtggagtcgtgggggaggcgtggtccagccgtggggacgtccctgagactctcctgtgtagtctctggattcaccttcgagggtgtacgacatgcacgtcgggtccnccaggcctaccgaggcgaaggggctgggagtggggtgctagtttanacgtcaactntagatagggaaaataacattactatcgacaggtacgtccgtagaacgggcccgtattccgacctacgtcctaccgaagaacgaactaacgttaaccaaagaaacctactaaccgtttgtttaccgtacgtaacctaaactaacttaaacggaaaacgtcctaaggaacgtacgaccgtaggaaacgggtacgtaccggttaactttagggttttaacttaccggttaggttacggtaaaccgttaaaacgttaaacggttaccggaaaaccgggtaaccggaaaacccgtaaacccccgggggttaaaccccccgg

SEQ ID NO: 414424 - DNA, 636 bp, Homo sapiens
  misc_feature: GZ8MTXP02JN06K.51.40.D07.1.454.CMB.2.raw
  modified_base (315)..(315): a, c, t, g, unknown or other
  modified_base (364)..(364): a, c, t, g, unknown or other
  modified_base (393)..(393): a, c, t, g, unknown or other
  modified_base (518)..(518): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcttgggttttcctcgttgcttcttttaagaggtgtccagtgtcaggtgcagctcgtggagtcgtgggggagcgtggtccagccgtgggacgtccctgacgctctcctgtgtagtctctggacttccaccttcgagggtctacgacatgcctacgtcgggtccnccgaggcctaccgaggacgaaggggctgggagtggggtgactagtttanactcactatagtaagtaggaaaataaacnttaacgtagtcgactaggtacggttccggaaggaacgggtcctactccaccgtatccctaccgaagaacgaactaacttaaccgaaaagacctaactaccttgttccagacacgaataagaaacncgtagacgagacgtacgacggtacgacggttactttagtttactacgttagtacgtaacgttaaacttaacgtacggaaccggtaaccggtaaacccgtaacccccggttacccccgg

SEQ ID NO: 414425 - DNA, 592 bp, Homo sapiens
  misc_feature: GZ8MTXP02HF4V8.51.40.D07.1.454.CMB.2.raw
  modified_base (201)..(201): a, c, t, g, unknown or other
  modified_base (303)..(303): a, c, t, g, unknown or other
  modified_base (318)..(318): a, c, t, g, unknown or other
  modified_base (358)..(358): a, c, t, g, unknown or other
  modified_base (383)..(383): a, c, t, g, unknown or other
  modified_base (386)..(386): a, c, t, g, unknown or other
  modified_base (391)..(391): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcttgggttttcctcgttgcttctttttaagaggtgtccagtgtcaggtncagctcgtggagtcggtgggggaggcgtggtccaggccgtggggacggtccctgagactctcctgtgtacgtctcgtggacttcaccttcgagggtcacgantgcacgtcgggtccncaggcctacgaggcgaagggctggagtggtgactatttanactcatagtagagtacgaaataacntanatganagacgtcgagacgcactcactactacacagaacaactaactaacaaacgaacactacgttcgttactacgactaactaacgtaacgaaacgcgagaacgacgtacgacgacggtacgtacgtacgttacgttacgttacgtagtacgtaacgtaacgttaacgacgaacggaaccgtaaacccgtaaaccccggtaccccg

SEQ ID NO: 414426 - DNA, 595 bp, Homo sapiens
  misc_feature: GZ8MTXP02IXC52.51.40.D07.1.454.CMB.2.raw
  modified_base (286)..(286): a, c, t, g, unknown or other
  modified_base (339)..(339): a, c, t, g, unknown or other
  modified_base (348)..(348): a, c, t, g, unknown or other
  modified_base (377)..(377): a, c, t, g, unknown or other
  modified_base (441)..(441): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagcctgggaggtccctgagcctctcctgtgtagtctctggacttcaccttgagggtntacgacatgcagtcgggtccgccaggctccgaggcaaggggctgggagtgggngctatttanatcactagtgaatacgggaaaataaactntaactagtcgacaggtacgtcgagacggcctatccacactccacgaagacgaactactacaaanaaccactacgttgttacacgacaacgtagaacgaaacgctagaagacgacgtacggacgaccgtacgtagtttacgtttacgttacgtgtaacgtaaccgttaaaacttaacgtacgaacgggtaccggtaaacccgtaaccccggtacccccg

SEQ ID NO: 414427 - DNA, 643 bp, Homo sapiens
  misc_feature: GZ8MTXP02GOSU3.51.40.D07.1.454.CMB.2.raw
  modified_base (366)..(366): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagccgtgggacggtccctgacgactctcctgtgtagtctctggacttccaccttcgagggtcgtacgacatgccacgtcgggtcccgccgaggtcctaccgaggcgaagggggctggggaggtgggtgctagtttanactcatatagataggaaaagtaacataactagtgacagtacgtccgtagaacggggccgtagttaccacctacttacctacccgaagaacgaactaaacgttaaccaaaacgtaaaccaactaacctttagtttcctacggacaaaccgtaagtaacgaaaacgtaccgtaggaagtacgacgtaggacggacgacggtcttagtttactacgtgttacggaacctaaagttaacgtacgaaccgggtaacgtaacccggaacccggtaacccccgg

SEQ ID NO: 414428 - DNA, 653 bp, Homo sapiens
  misc_feature: GZ8MTXP02JZT89.51.40.D07.1.454.CMB.2.raw
  modified_base (289)..(289): a, c, t, g, unknown or other
  modified_base (312)..(312): a, c, t, g, unknown or other
  modified_base (361)..(361): a, c, t, g, unknown or other
  modified_base (388)..(388): a, c, t, g, unknown or other
  modified_base (398)..(398): a, c, t, g, unknown or other
  modified_base (488)..(488): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgcttcttttaagaggtgtccagtgtcaggtgcagctcgtggagtcgtgggggagcgtggtccagcctggggacgtccctgagactctccgtgtgtagtctctggattcaccttcgagggtntacgacatgacacgtcgggtccnccgaggcctccgaggccgaaggggctgggaggtggggtggctagtttanactcactagtgagtaggaaaagtaacntaactatganaggagttcggagaacgggcctattccgaaccctagtcaccaagaacgaactaaacttaccaaaagaaacctacgtaacctttggtttacncggaaccaactacgtaaacgaaaacgtccgtagacgacgacgtaggaacggtaacgaccggttacgttagttttacgtaccgttaggtacgtaaaccgttaaaacgttaacgaccgtaaacggggaaaccggtaaacccggaaacccccgggtttaaccccccgg

SEQ ID NO: 414429 - DNA, 763 bp, Homo sapiens
  misc_feature: GZ8MTXP02IDRMK.51.40.D07.1.454.CMB.2.raw
tcagcgatcgtatacacgaccggtgctcgatttagtgatagagcgtaacaacaggagggggagtcagtcccaaccaggacacagcatggacatgagggtccctgctcagctcctggggctcctgctgctctggctctcaggtgccagatgtgacatccagatcgacccagtcctccatccctccctgtctgcatctgaggagacagacgtcacatctattgccaggcgaggtgaggactattaagtaacttattaaattgatcagacaagaaaccagggacaaaccgtacccctaaactcctagactctacgatacgcactaccgtaaagtttacgggaaaactcccggggtacccctaagtaccggtaagggtttcgaaagggttagggtagggtttacgggtttaccgtagggggtaactaacgttttacttttaactttacccgaaacttacgtactaggtacctaacggtcccctttaacacccgttaggaaaacgttaccgttacgttaacgacccttaaaattaaacttttaacgttttaactacggttaaaccctaaaaacgtaggttaaattaacggttaaactttaaccgttaccctaccccctttaaacgtaccgtttaacccgggttttacgggggaccggggaaaaccgggggttaacccgaagggggtttaaacggaacgtaaaacgttaacccggaaaaaaccggttcgttacggttacggggacctttacggacccttaacttaccgg

SEQ ID NO: 414430 - DNA, 648 bp, Homo sapiens
  misc_feature: GZ8MTXP02JUGXB.51.40.D07.1.454.CMB.2.raw
  modified_base (288)..(288): a, c, t, g, unknown or other
  modified_base (388)..(388): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgcttcttttaagaggtgtccagtgtcaggtgcagctcgtggagtcgtgggggagcgtggtccagccgtgggagtccctgagactctcctgtgtagtctcgtggattcaccttcaggggtntacgacatgccacgtcgggtcccgccaggcctccgagggccgaaggggctggggagtggggtggctattttagactcaacatgatagggaaaataaactntaactagtgcaaggacggtccggtaggaaacggggcctaattaccaacctatacctacccaaggaacgaactaaacttacccaaaagtaaccaactaccgttgtttacctacggtacaaacctagtaacggaaaacgccgttagaagaggacgtaggaacgggacgtacggggtactttaggtttacttacgtaggttacgaacgttaaactttaacgacgtaacgggacggtaaccgtaaacccgggttaaccccccgg

SEQ ID NO: 414431 - DNA, 749 bp, Homo sapiens
  misc_feature: GZ8MTXP02HT7TL.51.40.D07.1.454.CMB.2.raw
  modified_base (295)..(295): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcgaggtgcagctcggtggagtcggtgggggagcggtggtccagccgtgggacggtccctggacgtctctcctgtgtagtctcgtgacttcaccttcgagggtntacgactagtcgactacgtcggggtcccaccgaggcctacccggaggaccggaaggggtctggggagttggggtgtactaatttagctacgactagtagtacgtaaggaaaataaacgtattactagtcgacgaagtacggttaccgtagggaaacggtccgtattacccacctattcccgtaccgaagacgtaaactacttaaccaaacgtaaacctacttacgtttacgttactacgtaccaaacgtaaacgtaaacggaaaacgtccgtaaggaaagtacgtaccggttaaacggaaccgggtaaaccgtcgggtttacgttttaacgttttaacgtaccggttaggttaacgggtaaaccctttaaaacgtttaaacccgtacggggaaaaccgggtttaaaccccgggaaaaccccggtttaaaaaccccccggggttaacccccccgg

SEQ ID NO: 414432 - DNA, 673 bp, Homo sapiens
  misc_feature: GZ8MTXP02JM812.51.40.D07.1.454.CMB.2.raw
  modified_base (355)..(355): a, c, t, g, unknown or other
  modified_base (366)..(366): a, c, t, g, unknown or other
  modified_base (397)..(397): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgcttcttttaagaggtgtccagtgtcaggtgcagctcgtggagtcgtgggggagcgtggtccagccgtgggacgtccctgacgactctccgtgtgtagtctctggacttccaccttcgagggttgtacgacatgccacgtgggtcccgccgaggcctaccgaggcgaaggggctgggaggttggggngtctaatttanactcgatagtagaagtagggaaaataaccgnttaactagtcgacgaaggtacgtcccggtaggacggggccctaattccaacctatcctacccgagaaacgtaacctaacttaaccaaagaaccctaacttacgtttacgtttctacggaacctaacgtattaacgaaaacgtcccgttaggaacgtacgacgtaacgggacgtacggtacggtctttagttttaacgtacgtacggtacgaacgttaaaccgttagtaacccgggaacggtaaccggaccccgtttaaaaccccggtaccccccgg

SEQ ID NO: 414433 - DNA, 715 bp, Homo sapiens
  misc_feature: GZ8MTXP02FPHPF.51.40.D07.1.454.CMB.2.raw
  modified_base (180)..(180): a, c, t, g, unknown or other
  modified_base (267)..(267): a, c, t, g, unknown or other
  modified_base (376)..(376): a, c, t, g, unknown or other
  modified_base (405)..(405): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagnggtgtccagtgtcaggtgcagctcgtggagtcgtgggggaggcgtggtccagccgtgggacgtccctgacgctctctgtgtagtctntggattcaccttcgagggtctacgactatgcctacgtcggggtcccgccgtaggcctacccgagggtcggaaagggggctaggggagggttggggtggactagttttanactcactagtagatagggaaaactaaacnttaactagtcgactaaggaggttcccgtagggaacgggacccgtaacttccaactacgttaccacccgtaaggaaacgtaactaaaacttacccaaaacggtaaaccctaactaacgtttacgttttaccgtacggtacctaaacgtaagttaaacggaaaaaccgtccgtaagaaacgggtacgtccgtaaggtaaacgggaaaccgtacgggttacgtttacggtttaattaccggttagttacgtaacgtaaaacttaacgtaccggaacggtacggtaacccgtaaacccgggtttaaccccccgg

SEQ ID NO: 414434 - DNA, 596 bp, Homo sapiens
  misc_feature: GZ8MTXP02GFWJU.51.40.D07.1.454.CMB.2.raw
  modified_base (285)..(285): a, c, t, g, unknown or other
  modified_base (308)..(308): a, c, t, g, unknown or other
  modified_base (337)..(337): a, c, t, g, unknown or other
  modified_base (346)..(346): a, c, t, g, unknown or other
  modified_base (349)..(349): a, c, t, g, unknown or other
  modified_base (352)..(352): a, c, t, g, unknown or other
  modified_base (367)..(367): a, c, t, g, unknown or other
  modified_base (373)..(373): a, c, t, g, unknown or other
  modified_base (376)..(376): a, c, t, g, unknown or other
  modified_base (413)..(413): a, c, t, g, unknown or other
  modified_base (450)..(450): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagagactcaccatggagtttgggctgagctgggttttcctcgttgcttcttttaagaggtgtccagtgtcaggtgcagctcgtggagtcgtgggggagcgtggtccagcctgggacgtcctgagctctcctagtgtatctctggtacttcacttcgagggtntacgacagtgcacgtcgggtccncagctcgaggcgaggggctgggagtgggngctatttanacncantgataggaaataacntactanganaaggtgtccgtagacggtcctatcactatcaccgaanacgaaacactacaaaacgaactactacgttgtttacncgtacaactaagtagaaaacgtcgtagaagtagcgtaacggacggtaaccgtacggtaccgtttagtttactaaccgttgtacgtaaacgtaaacgtttaacgaccggaccggtaaacggaccccgtaaacccgggttacccccgg

SEQ ID NO: 414435 - DNA, 581 bp, Homo sapiens
  misc_feature: GZ8MTXP02H6WCL.51.40.D07.1.454.CMB.2.raw
  modified_base (353)..(353): a, c, t, g, unknown or other
  modified_base (374)..(374): a, c, t, g, unknown or other
  modified_base (408)..(408): a, c, t, g, unknown or other
  modified_base (411)..(411): a, c, t, g, unknown or other
  modified_base (453)..(453): a, c, t, g, unknown or other
  modified_base (474)..(474): a, c, t, g, unknown or other
  modified_base (501)..(501): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctctttttaagaggtgtccagtgtcaggtgcagctcggtggagtcgtgggggaggcgtggtccagccgtgggaggtccctgagactctcctgtgtagtctctggattcaccttcagggtgtacgacatgcacgtgggtccgccaggctccgaggcgaaggggctgggagtggggtgctatttanctcacatgataggaaataacntactatgcagagtcccgtagaaggccgatcaccntcnccagacgaactaactaccaaacgaaccactactttacgttcncgtacacgtatacggaaaacncctagagacgctaggacgacgacggtnttacgttttactacgttgtacgtaacgtaaactttaacgtaccgaacgggacgtaaccggtaaccccggtaaacccccgg

SEQ ID NO: 414436 - DNA, 581 bp, Homo sapiens
  misc_feature: GZ8MTXP02JBQ81.51.40.D07.1.454.CMB.2.raw
  modified_base (356)..(356): a, c, t, g, unknown or other
  modified_base (383)..(383): a, c, t, g, unknown or other
  modified_base (424)..(424): a, c, t, g, unknown or other
  modified_base (456)..(456): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagcctgggacgtccctgagactctctgtgtagtctctggattcaccttcagggtgtacgacatgcacgtgggtccgccaggcctccgagggcgaagggggctggggaggtggggtggctaagtttanacgtcactatggataggaaactaaacntaactatgacaggacgtccgtagacggccgattcaccatcnccagacaacatacaaagacacaacttgttacngtacaacgataagaaaacgccgtagacgagactaggacggactacgggtcttagtttacgttaactgtacgtaaccgtaaaacttaacgaccgaacggaacggaaccgtaaacccggtacccccg

SEQ ID NO: 414437 - DNA, 605 bp, Homo sapiens
  misc_feature: GZ8MTXP02GR8YF.51.40.D07.1.454.CMB.2.raw
  modified_base (270)..(270): a, c, t, g, unknown or other
  modified_base (290)..(290): a, c, t, g, unknown or other
  modified_base (312)..(312): a, c, t, g, unknown or other
  modified_base (336)..(336): a, c, t, g, unknown or other
  modified_base (358)..(358): a, c, t, g, unknown or other
  modified_base (365)..(365): a, c, t, g, unknown or other
  modified_base (383)..(383): a, c, t, g, unknown or other
  modified_base (390)..(390): a, c, t, g, unknown or other
  modified_base (448)..(448): a, c, t, g, unknown or other
tcagcgatcgtatacacgaccggtgctcgatttagtgatagagcgtaacaacagagggggtctgggagaggagcccagcactagaagtcggcggtgtttccattcggtgatcaacactgaacacagaggactcaccatggagtttgggctgagctgggttttcctcgttgcttcttttaagaggtgtccagtgtcaggtgcagctcgtggagtcgtgggggagcgtggtccagcctggggagtccctgacgactctcctagtgtagtctntggattcaccttcgagggtnacgtacatgcacgtcgggtccncgaggctccgaggcgtaaggggcngggaggtggggtgctattttanacctcanatgataagaaacgtaacntaactgngactagtaggtacgagacggctactacactatccacgaagaacaactaactacgaaanaacctactacttacgttactacgactaaacaacgtaagaaacgtcgagagtacgacgtacggaacggtacgacggttacttagtttacgtacgttagtacgaacgttaaacgtaacgaccggaacggaacggtaacccgtaaaccccggtaacccgg

SEQ ID NO: 414438 - DNA, 627 bp, Homo sapiens
  misc_feature: GZ8MTXP02F6PIQ.51.40.D07.1.454.CMB.2.raw
  modified_base (287)..(287): a, c, t, g, unknown or other
  modified_base (340)..(340): a, c, t, g, unknown or other
  modified_base (387)..(387): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgcttcttttaagaggtgtccagtgtcaggtgcagctcgtggagtcgtgggggagcggtggtccagccgtgggacgtccctgagctctcctgtgtgtctctggattccaccttgagggtntacgacatgcacgtggtcccgccaggcctccgagggcgaaggggtctaggggnggttcgggtggctaattttagactcactatgatagggaaaataaacntaactagtcgacgtaagacggttcccgtaggaacggggtccctattaccgaccactacctaccgaagacgaacctaaacttaccgaaacgtaaaccacctaacttcgttactacgacaactagtaagaaacgtcctaggaagtcgacgtacggacggtacgtacggtcgttagtttactacgtagtacgaacgtaacttacgacgaacgggaacgtaacccgtaacccggttaacccccg

SEQ ID NO: 414439 - DNA, 715 bp, Homo sapiens
  misc_feature: GZ8MTXP02F7R3S.51.40.D07.1.454.CMB.2.raw
  modified_base (285)..(285): a, c, t, g, unknown or other
  modified_base (307)..(307): a, c, t, g, unknown or other
  modified_base (359)..(359): a, c, t, g, unknown or other
  modified_base (391)..(391): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcttgggttttcctcgttgctcttttaagaggtgtccagtgtcaggtgcagctcgtggagtcgtgggggagcgtggtccagcctgggagtccctgagctctcctgtgtagtctctggattcaccttcgagggtntacgacatgctacgtgggtccnccgaggcctccgaggcgaacgggggtcgtggggggtgggtggactagtttanatccaactagtgattagggaaaactaaaacgntaactaatcgtacagtacgtaccgtaggaaacgggtccgtatccaacctatcctaccgagtaagaacctaaacttaaccgaaagtaaaccctactaaaccgtttcggtttacctaggacctaaaccgtaagttaacggaaaaacgtcccttaaggggaacgtaacgggtaccgtaagggtaaaccggaaccggtaaaccgggttccgttttaaaggttttaacgtttaaccgttaggtcgtaaaaccggttaaactttaaacgaccggtaaaccggggaaacggtaacccgtaaaacccccggggttaacccccgttacccggg

SEQ ID NO: 414440 - DNA, 660 bp, Homo sapiens
  misc_feature: GZ8MTXP02GKM7J.51.40.D07.1.454.CMB.2.raw
  modified_base (199)..(199): a, c, t, g, unknown or other
  modified_base (311)..(311): a, c, t, g, unknown or other
  modified_base (355)..(355): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgcttcttttaagaggtgtccagtgtcaggtncagctcgtggagtcgtgggggagcgtggtccagccgtgggacgtccctgagactctcctgtgtagtctctggacttcaccttcgagggtctacgacatgcacgtcgggtccncaggcctccgaggcgaaggggctagggagtgggtgctattttanactcatagtagaagtaggaaataactataactagtacgacgaagtacggtaccggtagggaacggtaccgtactaccaacctactccaccgaagaacaactaaactaaccgaaaacgtaaacctaaccttacgttcgttacacgtaccaacgtaagtaaacgtaaacgtcgtaggaagacggtacgtaacggacggacgtacggttacgtttacgtttacgttacgtaggtaacgtaaccgttaaaacgttaacgtaccgggaaaccggtaaccggtaaacccgtaaacccccgggtaacccccg

SEQ ID NO: 414441 - DNA, 837 bp, Homo sapiens
  misc_feature: GZ8MTXP02GZNJT.51.40.D07.1.454.CMB.2.raw
  modified_base (293)..(293): a, c, t, g, unknown or other
  modified_base (321)..(321): a, c, t, g, unknown or other
  modified_base (335)..(335): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgcttcttttaagaggtgtccagtgtcaggtgcagctcgtggagtcgtgggggagcgtggtccagccgtgggacggtccctgagtcctctcctgtgtagtctcgtggattccaccttcgagggttntaccgactagtcgctacgtcggggtccnccaggtcctaccgngggtacggaaggggtcgtggggacggttggggtggctaagttttacactacactagtaggataaggggaaaacttaaacattaacgtatacggaccgtaaaggtacggttacccgggtaggaaaccggggtacccgtaagttaccccaaacccgtaactttaccgtaccccgaaaggtaaacccgtaaaccttaaaaccgttaacccaaaaaaggtaaaccctaaaacccttaaccgttttacggttttacctacgggtaacccaaaacccgttaagttaaaacgggaaaaacggttaccccgttaagggtaaacccggtaacggacggtttaaacgggacggggtaaaccctaaccggggtttacgtttaaacgggtttttaacttaaacccgggttggtttacccggtaaaacggtttaaaactttaaccggtaaaccggaaaccgggggtaaaaccggttaaacccccgtaaaacccccgggggtttaaacccccccgg

SEQ ID NO: 414442 - DNA, 555 bp, Homo sapiens
  misc_feature: GZ8MTXP02FF12K.51.40.D07.1.454.CMB.2.raw
  modified_base (350)..(350): a, c, t, g, unknown or other
  modified_base (375)..(375): a, c, t, g, unknown or other
  modified_base (412)..(412): a, c, t, g, unknown or other
  modified_base (417)..(417): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggtttcctcgttgctcttttaagaggtgtccagtgtcaggtgcagctcgtggagtcgtgggggagcgtggtccagcctgggaggtccctgagactctcctgtgtagtctctggattcaccttcgagggtgtacgacatgcacgtgggccgcaggcctccgaggcaagggggctgggaggtggggtgctaatttanactcacatgataggaaaagtaaacntaactatgacagagtccgtagaaggccgatcacatcncaganacaatacaaagacacactgttctgcacaatagaaaacgcctagagagactaggacggacgacggtcttacgtttacttacgtgtacgtaacgtaaacttaacgacgacggtaacggaaccgtaaccggtaacccccgg

SEQ ID NO: 414443 - DNA, 617 bp, Homo sapiens
  misc_feature: GZ8MTXP02FW73B.51.40.D07.1.454.CMB.2.raw
  modified_base (288)..(288): a, c, t, g, unknown or other
  modified_base (350)..(350): a, c, t, g, unknown or other
  modified_base (362)..(362): a, c, t, g, unknown or other
  modified_base (370)..(370): a, c, t, g, unknown or other
  modified_base (387)..(387): a, c, t, g, unknown or other
  modified_base (394)..(394): a, c, t, g, unknown or other
  modified_base (446)..(446): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagagactcaccatggagtttgggctgagctgggttttcctcgttgcttcttttaagaggtgtccagtgtcaggtgcagctcgtggagtcgtgggggagcgtggtccaggccgtgggacgtccctgacgactctctgtgtatctctggattcacctttcgagggtntacgactatgcacgtcgggtcccgccgacggcctaccgaggcgaaggggctgggaggtgggnggctaagtttanacgtcacngtgataggaaataactntaactancgcaaggagtcccgtagggaacggtcccgtattaccgactaagtccaccganaacgactaaactccaaagaacactacgttcgtttacacgacaacgtagtaacgaaacgttcgagagaccgtagtacggaacgaccgtacgtatttaacggtttataccgtggtacgtaacgttaaccttaagacggtaaacgggacgtaacccgaacccggtttacccccg

SEQ ID NO: 414444 - DNA, 649 bp, Homo sapiens
  misc_feature: GZ8MTXP02JDG6S.51.40.D07.1.454.CMB.2.raw
  modified_base (289)..(289): a, c, t, g, unknown or other
  modified_base (357)..(357): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagccgtgggagtccctgagactctcctgtgtagtctctggattcgacctttcgaggggtntacgacatgcacgtgggtcccgccaggcctccgaggcgaaggggctgggaggtggggtgctattttanactcagtatgagtaggaaaactaactataactatgacgaaggtacggtaccggtaagggaacggggtaccctaacgtccacctacgtactaccgaagtaacgaactaaacttaccgaaaagtaacctaacgtacgtttgttactacgaacctacgtaaagtaacgaaacgtacgaggtaacgacggtacgtacgggacggtacgtacggtacgtttacgtttacgttacgtggtacgtaacgtaaacttacgaccggaacggaccggtaaccgtaaaccccgggtacccccg

SEQ ID NO: 414445 - DNA, 576 bp, Homo sapiens
  misc_feature: GZ8MTXP02JSM6Y.51.40.D07.1.454.CMB.2.raw
  modified_base (286)..(286): a, c, t, g, unknown or other
  modified_base (306)..(306): a, c, t, g, unknown or other
  modified_base (359)..(359): a, c, t, g, unknown or other
  modified_base (388)..(388): a, c, t, g, unknown or other
  modified_base (431)..(431): a, c, t, g, unknown or other
  modified_base (445)..(445): a, c, t, g, unknown or other
  modified_base (480)..(480): a, c, t, g, unknown or other
  modified_base (503)..(503): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtctgggggagcgtggtccagcctggggaggtccctgagactctcctgtgtagtctctggattccaccttcagggtntacgacatgcactgggtccnccaggctcccgaggcgaaagggggtctgggaggtggggtggcctaagttttanaactcaacattgattaggaaagttaaacntactatgcaagagtccgtgaacggccgatcaccatctccaganacatcaaagacacnctagttctgcaacagtacgaaaagcctagaagacncgtaggaacggacaaccgggttntttacgtttacttacgtgtacgaacgtaaacttaacgaccgtaacggacgtaaccgtaacccggtaacccccg

SEQ ID NO: 414446 - DNA, 624 bp, Homo sapiens
  misc_feature: GZ8MTXP02FY0QU.51.40.D07.1.454.CMB.2.raw
  modified_base (287)..(287): a, c, t, g, unknown or other
  modified_base (360)..(360): a, c, t, g, unknown or other
  modified_base (509)..(509): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcttgggttttcctcgttgcttcttttaaagaggtgtccagtgtcaggtgcagctcggtggagtcgtgggggagcgtggtccagccgtgggagtccctgagactctcctgtgtagtctctgattcacttcagggtntacgacatgcacgtcgggtccgcaggcctaccgaggacaagggggctgggaggttggggtaggctaagtttanactacacgtatacgaagtaagaaaacgttaacattaactagtagacgaaggtacgtaccggtaggaacggtaccgtataccacataccaccaagaacgaactaaactaccgaaaagaaaccaactacttgttaccacgaccaacgtaanaacgtaaacgacacgaagagacgtacgacggaacgtacgtacgttacgttacgttacgtagtacgtaacgtaacgtaacgtacgaacggaacggtaaaccgtaacccgtaacccg

SEQ ID NO: 414447 - DNA, 626 bp, Homo sapiens
  misc_feature: GZ8MTXP02F79EL.51.40.D07.1.454.CMB.2.raw
  modified_base (288)..(288): a, c, t, g, unknown or other
  modified_base (316)..(316): a, c, t, g, unknown or other
  modified_base (373)..(373): a, c, t, g, unknown or other
  modified_base (476)..(476): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagccgtgggacgtccctgagactctcctgtgtagtctctggattcaccttcgaggggtntacgacagtcgaccacgtcggggtcccnccgaggcctacccgaggccgaagggggctggggacggttggggtggctaagttttanacctcatagtagagtaaggaaaataacataactagtgacaaggtacggtccggtaggaacgggaccgtactaccactactcaccgagacaacaactaccaaanaacctactacttcgttacacgacacagtaacgaaacgcgtagacgacgacgtacggacggacgtacggtacttacgtttacgttacgtagtacgtaacgtaaacgtaacgtacggtaacggaaccgtaacccgtaaccccggtaaccccg

SEQ ID NO: 414448 - DNA, 587 bp, Homo sapiens
  misc_feature: GZ8MTXP02H8NKS.51.40.D07.1.454.CMB.2.raw
  modified_base (196)..(196): a, c, t, g, unknown or other
  modified_base (496)..(496): a, c, t, g, unknown or other
tcagcgatcgtatacacgaccggtgctcgatttagtgatagagcgtaacaacagaggggagtcagtcccaaccaggacacagcatggacatgagggtccctgctcagctcctggggctcctgctgctctgctctcaggtgccagatgtgacatccagatcgacccagtctccatcctcctgtctgcatctgagganacagagtcaccatcacttgccaggcgagtgagactattagtaacttattaaatggtatcagacaacgaaaccagggacaacgacccctaaactcctgatctacgatcgacactacctaatttaggaaacgtcggggtacccagtacgtaaggttcgaagttggtaggtggtttacgacggggtactaggttacttttacttaccacccgtatccaggactacggtacccctttaccgacccttaggaaacgtcttcttagacctaaactaccttagttactacgtacctaagtactagtntaactatcccttaccaactcttacgttgggacgtacgggaaccagggtacgaactgtaacaacgtagtacggttcgcgtacacctaacctg

SEQ ID NO: 414449 - DNA, 669 bp, Homo sapiens
  misc_feature: GZ8MTXP02G1MOB.51.40.D07.1.454.CMB.2.raw
  modified_base (271)..(271): a, c, t, g, unknown or other
  modified_base (297)..(297): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcttgggttttcctcgttgcttcttttaagaggtgtccagtgtcaggtgcagctcggtggagtcggtggggggagcgtggtccagccgtgggagtccctagagactctcctgtgtgtctntggacttcacttcgagggtgtacganatgacgacgtcgggtacccgccgacggctacccgagggacggaacggggtcgtaggggacggtggggtcggacttatttataccgtacaagtagtaggaagtaaggggaaaactaaacctagttaactatagccaaggacggttccgtagggaacggccgtactacacccgtatccctacgaagaacgtaaacaaacttaccgaaaagtaccaaactctttcgttacacgtacaacgtaagttaacggaaacgtccgtagaggtacgtacggtaagacggaaacgtccggttattaggttttaaactcgtaggttactaaacgttactaaagtaccgaacggtaacggtaaccctaaccccgggtttacccg

SEQ ID NO: 414450 - DNA, 614 bp, Homo sapiens
  misc_feature: GZ8MTXP02FI1Q8.51.40.D07.1.454.CMB.2.raw
  modified_base (285)..(285): a, c, t, g, unknown or other
  modified_base (347)..(347): a, c, t, g, unknown or other
  modified_base (356)..(356): a, c, t, g, unknown or other
  modified_base (361)..(361): a, c, t, g, unknown or other
  modified_base (376)..(376): a, c, t, g, unknown or other
  modified_base (381)..(381): a, c, t, g, unknown or other
  modified_base (384)..(384): a, c, t, g, unknown or other
  modified_base (405)..(405): a, c, t, g, unknown or other
  modified_base (408)..(408): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagcctgggagtcctgagactctcctgtgtagtctctggacttcaccttcgagggtntacgacatgccacgtcgggtccgccgaggcctccgagggtcgaaggggctgggaggtggggngctatttanctcantgataggaaataacntacanganagacgtcgagacgctatcacntcncagacaactaactacaaacgaactacgtacttgttacacgacaacgtaagtaaacgaaaacgtcgtaggaacgacggtacgtaacggacggtacgtacggttacgtttaacgttttaacgttacgtacggttaacgtaacgttaaaacttaacgtaaccggaacgggtaaaccggtaaaccccggtaaccccgggttaacccccgg

SEQ ID NO: 414451 - DNA, 821 bp, Homo sapiens
  misc_feature: GZ8MTXP02IDPZV.51.40.D07.1.454.CMB.2.raw
  modified_base (198)..(198): a, c, t, g, unknown or other
  modified_base (282)..(282): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtncagctcgtggagtcgtgggggagcgtggccagcctgggacgtcctgagactctcctgtgtagtctctgattcacttcgagggtntacgacagtcgccgacgtcggggtccccaccgaggggccttacccgaggggtaccggaaacggggggtcccttagggggaacgggttgggggttacgggtaaccttaagttttttaacgaccctttaccgaaaccgttaggttaacgtaacgtttaaaggggaaaaacgtttaaaacccgagttttaaaccttaaacgttaggacccgtaaagggttaacccggggttacccgggttaggggtaaaaccgggggacccttaaacgtttcccaaaacccgtcttacccgttacccgaaaggaacggaaaacccttaacttaacccgtaaaacggaaaacccttaaccgtaaacggttttccttttacgaccggtaccaaaccgtaagttaaaccgaaacggttaccgtaggaaccgtaggaccgttacgggaaacgggtaccgtacggtttaccttaacgggtttttataccggtttagcgtaaaccgttaactaaacgtacgaaacggtacggaaacccgtaaccccggtaaccccggg

SEQ ID NO: 414452 - DNA, 917 bp, Homo sapiens
  misc_feature: GZ8MTXP02G1CVI.51.40.D07.1.454.CMB.2.raw
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctgttgctcttttaagaggtgtccagtgtcaggtgcagctcgtggagtctgggggagcgtggtccagcctgggagtccctgagacctctcctgtgtagtctctggtattccaccttcgaggggttctacggacatcgcctacgtcgggtcccgccgtaaggcctcccgagggccgaaaggggggtcctaggggtaggttggggttcggccttaagtttttactactacccgacctaagttcggtaagttaggggaaaacgttaaaaccctaggtttaaacccttaagttaccgaaccgtaaagggtacgggttcccccgggtaaggggtaaacccgggggtccccggtaaactttacccggtaaacccgtaaccgttacccgttaccccgaaaggtaaccgggtaaacccttaaaaaccgtttaaccccaaaaaccggggtaaaaccctaaaccgttaaacccggtttacgtttttaccgttacgggtacccgtaaaacctaacgtttaaaacggtaaaaaaccgggtccccgtttaagggaaacggggtaaacggtacccggttaaggggaaccggggtaaacccgtaaaccgggggtccgttttaaacgggtttttaacgttttaaacccggtttagggtttaccgtaaccgggtttaaaaaccgttttaaaaccggttacccggttaaaacgggggaaacccggggttaaaaccccgtaaaacccccgggggtttaaaacccccccccgggg

SEQ ID NO: 414453 - DNA, 589 bp, Homo sapiens
  misc_feature: GZ8MTXP02FSQL4.51.40.D07.1.454.CMB.2.raw
  modified_base (285)..(285): a, c, t, g, unknown or other
  modified_base (343)..(343): a, c, t, g, unknown or other
  modified_base (348)..(348): a, c, t, g, unknown or other
  modified_base (365)..(365): a, c, t, g, unknown or other
  modified_base (379)..(379): a, c, t, g, unknown or other
  modified_base (406)..(406): a, c, t, g, unknown or other
  modified_base (456)..(456): a, c, t, g, unknown or other
  modified_base (466)..(466): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagctgggttttcctcgttgctcttttaagaggtgtccagtgtcaggtgcagctcgtggagtcgtgggggagcgtggtccagcctgggagtccctgagctctcctgtgtagtctcgtggattcaccttcgagggtntacgacatgcacgtggccgcaggctccgagcgaaggggctggagtgggtgctatttanatcanatgagtaggaaataacntactagtgacaggngtccgtagaacgggcctattacacctntcctaccgaagaacgactaaacgtaccaaagaaccactaacttgtttacncgacctaaanagtaagaaacgtcgagagacgtacgtacggacgtacgtacgtctttacgtttacgttacgtaggtacgtaaccgttaaactaacgtacggtaacggaaccgtaacccgtaaccccggtacccg

SEQ ID NO: 414454 - DNA, 650 bp, Homo sapiens
  misc_feature: GZ8MTXP02G9MMF.51.40.D07.1.454.CMB.2.raw
  modified_base (210)..(210): a, c, t, g, unknown or other
  modified_base (289)..(289): a, c, t, g, unknown or other
  modified_base (294)..(294): a, c, t, g, unknown or other
  modified_base (334)..(334): a, c, t, g, unknown or other
  modified_base (356)..(356): a, c, t, g, unknown or other
  modified_base (573)..(573): a, c, t, g, unknown or other
tcagcgatcgtatacacgaccggtgctcgatttagtgatagagcgtaacaacagaggggtctgggagaggagcccagcactagaagtcggcggtgtttccattcggtgatcaacactgaacacagaggactcaccatggagtttgggctgagcttgggttttcctcgttgctctttttaagaggtgtccaggtgtcaggtgcagctcggnggagtcgtgggggagcgtggtccagccgtgggagtccctgcgactctctgtgtagtctgtgattcaccttgacgggttnacganatgcacgtcggccgccaggcctcgaggcgaggggctgggngtgggtgactatttagactcanatagaatacgggtaaataaacgctactatagactagacggtccgtagggaacgggcctataccacccgtatccgtaccaagtacgaaactaacgttaacaaaacgaactaccgttacgttactttcgaaccgataaccgataaaacggaaacgtccgagaaaggcggtactaaggggaacgtaccggaccgtttagttacgttttaaccgttaacgnggtttacgtaaaaccgtaacctttaacggtacggaacgggtaaaccgaaccccggtaaacccccggtaacccccggg

SEQ ID NO: 414455 - DNA, 544 bp, Homo sapiens
  misc_feature: GZ8MTXP01EOST3.13.25.C03.1.454.CMB.2.raw
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagaagcctgaggcctcagtgaaggtctcctgcaaggcttccggatacaccctcaatggaaactatgtccactatgtgcgacaggccccaggacaagggcttctgtggagtgggggtggatcaacctaatagtggtcgacacaaactatgaaagaagaatttgagggccgggtcaccatgaccaggacacgtcatcaatacagcttcatgaactagaccaggactgacctcgtcgacgacgacggccgtgtacttactgtgcggtcgaaactcacgcctaacttacgttgttaagtttggggcctaagggagcccgttggtccgttaaccggtcc

SEQ ID NO: 414456 - DNA, 573 bp, Homo sapiens
  misc_feature: GZ8MTXP01CSHME.13.25.C03.1.454.CMB.2.raw
  modified_base (567)..(567): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagaagcctgaggcctcagtgaaggtctcctgcaaggcttccggatacaccctcaatggaaactatgtccactatgtgcgacacggccccaggacaagggcttcgtgtggagtgggggtgataccaaacctaatgtggtcgaacaacaaactatagaaagaaagtaagtttgggacggggcccgggtacaaccgatcgaccgagggacacgtcatcaaatacacgtccttacatggaaactcgaaccaggacctgaccctcgtagaaccgacgacggtaccgtgtacttactgtcgcgtacgaaactcagtacctaacttacgtttgttagtttgggaccaagggcgccgttggtccncgttcc

SEQ ID NO: 414457 - DNA, 592 bp, Homo sapiens
  misc_feature: GZ8MTXP01DDVQQ.13.25.C03.1.454.CMB.2.raw
  modified_base (193)..(193): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacngtccggggctgaggtgaagaagcctgaggcctcagtgaaggtctcctgcaaggcttcggatacaccctcaatggaaactatcgtccactatgtgcgacacggccccaggacaagggcttctgtggagtgggggtggatacaaacctaagtagtggtacgacaacaaactatagaaagaaagtaacgtttggaaaggggcccgggtacaccagtcgaaccgagggacacgtaccatacaaatacagtccttacatacggaaactgaacccaaggggacttacggaaccttcgacgacgaccacggaccgtgtatacgtgtcgcgttacgaaactcacgccttaacttacgtttgttaacgtttcggggcctaagggtacgccgttggtccaaccgttccc

SEQ ID NO: 414458 - DNA, 700 bp, Homo sapiens
  misc_feature: GZ8MTXP01AMXR9.13.25.C03.1.454.CMB.2.raw
  modified_base (263)..(263): a, c, t, g, unknown or other
  modified_base (274)..(274): a, c, t, g, unknown or other
  modified_base (354)..(354): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccgggctgaggtgaagaagcctgaggcctcagtgaaggtctcctgcaaggcttccggataccaccctnaatggaaactntgtccactatgtgcgacaggccccaggacaagggcttctggtggagtgggggtgatcaaacctaagtagtggtacgacanaaactagtagaaaagaaagtaagtttggaacggggtacccgggtacaaccgagtcggaacccgaaggggaccacggtaccaataccgaaattaaccacggtaccctttacaagttacgggaaaccttacggaacccaacgggggtaaccttacggtaaccccttaccgttaacggaacccgtaaccgaaccgggtaccccgttagttaacgtttaaccgtgggtacggtaaccgggttaacggaaacctccgaacgtacccttaaacgttaccgttttaggttaacgttttcgggggacccgtaagggggaccgtcccggttacgggtcccgttaaccggttcccg

SEQ ID NO: 414459 - DNA, 609 bp, Homo sapiens
  misc_feature: GZ8MTXP01EDTIJ.13.25.C03.1.454.CMB.2.raw
  modified_base (193)..(193): a, c, t, g, unknown or other
  modified_base (202)..(202): a, c, t, g, unknown or other
  modified_base (257)..(257): a, c, t, g, unknown or other
  modified_base (268)..(268): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacnggtccgggntgaggtgaagaagcctgagcctcagtgaagtctctgcaggctccgatacaccctnaatggaaactntgtccatatgtgcgacacggaccccaggacaagggtcttcgtggtggagtgggggtgatctaaaccgtaagtaggtggtacgaacaaacgaaactaagtaggaaaagaaagtaagtttgggacggggtcccgggtacaaccgagtcgaaccgagggacacgtaccatacaaatacacgtccttagattacggaactacgaccagtactcgacctcgtagaccgacgacggtccgttgtaacttacgtggtcgtaacggtacgaaactcgaagtacccttaaacttcgtttgttaacggttttcgggaccgaagggtcgtccgttcggtccgaaccgttccc

SEQ ID NO: 414460 - DNA, 620 bp, Homo sapiens
  misc_feature: GZ8MTXP01CRCRT.13.25.C03.1.454.CMB.2.raw
  modified_base (262)..(262): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagaagcctgaggcctcagtgaaggtctctgcaaggcttccggatacaccctnaatggaaacatgccactatgtgcgacacggccccaggacaagggcttacgtggtggagtgggggtgatacaaccctaagtagtggtacgacaactaacgtataggaaacgaaagtaagtttggacggggtaccggggtacaaccgagtacggaccgagggacaccgtacagttacaaatacacgtccttacagttacgaactagaccagggtactcgaccttacgacgaccgacgacggtaccgtagtacttacgtggttggaacggttacgaaacttcgacgtaccctaattaccgtttagttacgttttcggggaccgtaaggggtacgcccgttcgtaaccgttaaccgttcccg

SEQ ID NO: 414461 - DNA, 594 bp, Homo sapiens
  misc_feature: GZ8MTXP01AUKI3.13.25.C03.1.454.CMB.2.raw
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccgggctgaggtgaagaagcctgaggcctcagtgaaggtctcctgcaaggcttccggatacaccctcaatggaaactatgtccactatgtgcgacaggccccaggacaagggcttcgtgtggagtggggtgatcaacctatagtggtgacacaaactatagaaagaaagtaagtttggaacggggtccggggtacaaccgagtacgacccgagggacacgtccatacaaatacagccttacagtaggaactgaccagggaactcgacctcgtagaccgacgaccggcgtagttattactgtcggcggtccgaaactcaaacggtaccctaactttacgtttgttaaacttttggggacgtcccggaggggtaccgttacccgttggttcccgtaacccg

SEQ ID NO: 414462 - DNA, 246 bp, Homo sapiens
  misc_feature: GZ8MTXP01CCUO2.13.25.C03.1.454.CMB.2.raw
  modified_base (244)..(246): a, c, t, g, unknown or other
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgcccctcggtcactctgttccgccctcctctagtacgtgactgagcgggcgtggcgaaggacgcatagnnn

SEQ ID NO: 414463 - DNA, 624 bp, Homo sapiens
  misc_feature: GZ8MTXP01AEY86.13.25.C03.1.454.CMB.2.raw
  modified_base (203)..(203): a, c, t, g, unknown or other
  modified_base (267)..(267): a, c, t, g, unknown or other
  modified_base (278)..(278): a, c, t, g, unknown or other
  modified_base (321)..(321): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacaggtccggggntggaggtagaaagaagcctgaggcctcagtgaaggtctcctgcaaggcttccggatacaccctnaatggaaactntgtccactatgtgcgacacggccccaggacaaggggtcttcgnggtggagtgggggtagacgtccaaacccgtaagtaggtggtacgaacaacaaacgtataggaaaagtaagtaagtttgggacggggtccgggtacaccgagtcgaccgagggacacgtacatacaaatacacgtcttacagttaggaactagaccaggtacgtcgtaccgtcgtacgaaccgacgacggtcccgtaggtacttacgtcggtcggaacggttacgaaactcaacgtaccttaacttcgtttagttaacgtttcggggactaaggggacgcccgttgggtccttaaccggttccc

SEQ ID NO: 414464 - DNA, 243 bp, Homo sapiens
  misc_feature: GZ8MTXP01B5ASP.13.25.C03.1.454.CMB.2.raw
  modified_base (243)..(243): a, c, t, g, unknown or other
tcagtcacgtactacacgaccggtgctcgatttagtagtgtagatttgggtttgggggtgtggtggtctccactcccgccttgacggggctgcctattactgctgctcatatgcaggttcttctgtggtcttcggcggagggtccaaagtgaccgtcctaggtcagcccaaggctgccccctcggtcactctgttcccaccctcctctagtacgtgactgagcgggctggcaaggcgcatagn

SEQ ID NO: 414465 - DNA, 686 bp, Homo sapiens
  misc_feature: GZ8MTXP01A7CEM.13.25.C03.1.454.CMB.2.raw
  modified_base (261)..(261): a, c, t, g, unknown or other
  modified_base (272)..(272): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccgggctgaggtgaagaagcctgagcctcagtgaaggtctcctgcaaggcttccggatacaccctnaatggaaactntcgtccactatgtgcgacacggccccaggacagggcttcgtgtggagtgggggtgatccaaacctataggtggtacgaacaacaaactataggaaagaaaggtaagtttcgggaacggggtcccgggtacaaccgtagtacggaacccgacggggaccaaccggtaccagtaccaaattacgacgtacccttacgaacgtacggtaaactacggaaccagggtaaccgtacggaccctcgtacgaacccgaccgtaccgggtccgttaggttactttacgtacggtggtaaccgggtaacgttaaacgttaccaacggtacccttaaacgttaccgttttaggttaaacggttttcgggggacccgtaagggggtaccgtcccggttacgggttaacccgttaacccgttcccg

SEQ ID NO: 414466 - DNA, 605 bp, Homo sapiens
  misc_feature: GZ8MTXP01A1Y3E.13.25.C03.1.454.CMB.2.raw
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccgggctgaggtgaagaagcctgaggcctcagtgaaggtctcctgcaaggcttccggatacaccctcaataggaaactatgtccactatgtgcgacacggccccaggacaagggcttcgtggtggagtgggggtgatacaacctaatagtggtacgacaacaaactataggaaagtaaagtaagtttgggaacggggtcccgggtacaccgagtacggacccgagggacacggtaccatacaatacacgccttcataggaactagaccaggactcgacctcgtacgacgacgaccggtccgtgttattacgtgtcggcggtacgaaacgtcacgtacctaacttacgtttgttacggttttcggggaccgtaacggggtacgtcccgttcgggtccttaacccggttccg

SEQ ID NO: 414467 - DNA, 546 bp, Homo sapiens
  misc_feature: GZ8MTXP01D11UO.13.25.C03.1.454.CMB.2.raw
  modified_base (227)..(227): a, c, t, g, unknown or other
  modified_base (415)..(415): a, c, t, g, unknown or other
  modified_base (420)..(420): a, c, t, g, unknown or other
  modified_base (440)..(440): a, c, t, g, unknown or other
  modified_base (519)..(519): a, c, t, g, unknown or other
tcagtcacgtactacacgaccggtgctcgatttagtagtgtagatttgggtttgggggggtcacaagaggcagcgctctcgggacgtctccaccatggcctgggctctgctgctcctcactctcctcactcaggacacagggtcctgggcccagtctgccctgactcagcctgcctcatgtctgggtctcctggacagtcgatcaccatctcctgcactggaaatgnagtgatggttgggacttatgaccttgtctctggaccgacaacaccaggacaaacgccccaaatcaattagttacgggtcaataagcgcctcagggtctttcgtgatcgcttctcctggctcaagtctaggcaacgacggcctcctgacatctctgactcgaggccgagacgtaggcttgtattttacngtttntactatagtagagaggaagngtagtattagttacgttgttagggaaggtcgggaactaaggtcttacgttcgttgacgacgacccgaacgacccaaccnctcgtctacttctccgttcccctaacc

SEQ ID NO: 414468 - DNA, 623 bp, Homo sapiens
  misc_feature: GZ8MTXP01B3NXK.13.25.C03.1.454.CMB.2.raw
  modified_base (201)..(201): a, c, t, g, unknown or other
  modified_base (272)..(272): a, c, t, g, unknown or other
  modified_base (352)..(352): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccgggntgaggtgaagagcctgagcctcagtgaaggtctctgcaaggcttaccggatacaccctacaatggaaactntcgtccatatgtgcgacacggccccaggacagggctcgtgtggagtggggtgatcaaacctaatgtggtacacacaatanagaaagaaagtaagtttcgggacgggtcccggtacaccgagtacgaaccgagggacacgtacatacgaaactacgacgtccttacagtacggaactacgaaccacggggtactacgtaacctcgtacggaaccgaccgtaccgggtccgttagttacgttacgtcggtcggtaacggtacgttaaacgtcgaacgtacccttaacgttacgtttcgttaacggttttcggggaccgtaacgggaccgtcccgttcggtccgttcccgtccg

SEQ ID NO: 414469 - DNA, 630 bp, Homo sapiens
  misc_feature: GZ8MTXP01AQQF8.13.25.C03.1.454.CMB.2.raw
  modified_base (271)..(271): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagaagcctgaggcctcagtgaaggtctcctgcaggcttcggatacacctcaatggaaactntgtccactatgtgcgacacggccccaggacaaggggtcttcgtggtggagtgggggtaggactaccgaaaccctaagtagtggtacgaaccaacgaaactagtaggaaaagaaagtaagtttgggaacggggcccgggtacaaccgagtacgaaccgagggacacggtaccagtcaatacagtcctacagtagaactgaccaggactgacctcgtagaccgacgacggtccgtgtacttacgtggtcggtaacggtacgaaacttcgaacgtacccttaacgttacgtttggttaaacggttttcgggggaccgtaacgggggtaccgtcccggttacgggtccttaacccgggttccc

SEQ ID NO: 414470 - DNA, 762 bp, Homo sapiens
  misc_feature: GZ8MTXP01A7ER3.13.25.C03.1.454.CMB.2.raw
  modified_base (192)..(192): a, c, t, g, unknown or other
  modified_base (223)..(223): a, c, t, g, unknown or other
  modified_base (257)..(257): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttctggtggcagcagccacagcagcccactcccaagtgctcctgaaacngtccgggctgaggtgaagagcctgaggcctnagtgaagtctctgcaggcttccggatacaccctnaatggaaactatgtccactatgtgaccgtacaggtcccccagggaacctaaggggcctttcgtaggtagggtacttggggggtacgaacttccgaaacccgttaagttaggtcggttaccgaacctaacgaaaaccgttagtacggaaaacggtaaacggtaagttttcggggaaacgggggtaccccgggttacaacccggtaagtttacggaaaccccggtaacggggtaaccgtaaccggttacccgtaacgttaccgaaacgttaacccgtaacggtaccctttaccgaacgttacgggtaaaccttacggtaacccgtaacggggtaaccgttacggtaccccttacggtacggtaaaccgtaccgtaaccggtacccgtagttaacgttacgtacgtcggtaacggtaccgttaaacgttcgacgtacttaacgttacgtttcggttacgttttcgggaccgtaacgggtacgtccgttcggtccgttaacgtaacccg

SEQ ID NO: 414471 - DNA, 858 bp, Homo sapiens
  misc_feature: GZ8MTXP01C7B4L.13.25.C03.1.454.CMB.2.raw
  modified_base (258)..(258): a, c, t, g, unknown or other
  modified_base (263)..(263): a, c, t, g, unknown or other
  modified_base (275)..(275): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctctagaaacaggtccgggctggaggtgaagagcctgagcctcgagtagaggtctctgacgagctaccggataccncctanaagtagaaactntcgtacctatatgagcgacgacggacccgaggacagggcttacgtggtggtaggtgggggtacgaactacctaaacctagtagtacggtacgaacctaaacgtaaagtagtagaaaagtaaagttaaggtttcgggaaccgggggtacccgggttaccaaccgtagtacgggaaccgacggggaacctaccggtacctaactaaccgtaaagtaccacggttacccgtttacgaacggttaaacgaaccgttaaccggaaacccgtaacggggttaaccccgtacggttaaacccccgttacggtaaccggaaaccccgggtaaaccgttaccgggtaccccgggtttaagtttaaaccggtttaacggttacgggttaaccggttaaacccggggttaaaccggttaaaaccttacccgggttaaacccgtttaaaccccggttttaaaacgttttaaccgggtttttaacggggtttaaacgggtttttaacccgggggaaacccgggttaaccgggggttaaacccgggttccccgggtttaccgggttaaccccgtttaacccccgggtttaacccccg

SEQ ID NO: 414472 - DNA, 619 bp, Homo sapiens
  misc_feature: GZ8MTXP01C0LQ1.13.25.C03.1.454.CMB.2.raw
  modified_base (193)..(193): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacngtccggggctgaggtgaagaagcctgaggcctcagtgaaggtctcctgcaaggcttccggatacaccctcaatggaaactatgtccactatgtgccgacacggccccagggacaagggcttcgtggtggagtgggggtgatcaaccctaatgtggtacacacaaactatagaaagaaagtaagtttgggacggggccgggtacaaccgagtacgaccgagggacacgtaccatacaaatacacgtccttacagttacggaactcgaaccagggactcgaccttcacggaccgacgacggtccgtgtattacgtggtcggtaaccggtaccgttaaactcgaccgtaaccttaacgttaacgtttggttaacggttttcgggggaccgtaacggggacgtcccgttacggtccgttaaccgttcccg

SEQ ID NO: 414473 - DNA, 634 bp, Homo sapiens
  misc_feature: GZ8MTXP01EH8L7.13.25.C03.1.454.CMB.2.raw
  modified_base (195)..(195): a, c, t, g, unknown or other
  modified_base (204)..(204): a, c, t, g, unknown or other
  modified_base (223)..(223): a, c, t, g, unknown or other
  modified_base (257)..(257): a, c, t, g, unknown or other
  modified_base (385)..(385): a, c, t, g, unknown or other
  modified_base (556)..(556): a, c, t, g, unknown or other
tcagtcacgtactacacgaccggtgctcgatttagtagtgtagatttggggtttgggggagcatcacccagcaaccacatctgtcctctagagaatcccctgagagctccgttcctcaccatggactggacctggaggatcctcttcttggtggcagcagccacagcagcccactcccaagtgctcctgaaacgnggtccgggntgagtgaagagctgagctnagtgagtctctgacaggcttccgatacaccctanagtagaactatcgtccatagtgtgcgacacggaccccgaggacgtaaggggtccttacgtaggtcgggtagtcgggggtagtactacctaaaccgtaagtaggtggtaacaccaaacgtaaaagttanaggaaaagaaagttaaggtttcgggaaacgggggtcccggtacaacgagtacggacccgaacggggactaaccgtacaatacaaataccacggttacccttagaagacggaatccggaacctagggtacctcggtaccttacgagaccgacgtcggacgttgtatactggngcggtacaaactcgacgtacttaagttcgtttagttacgggtttggacgaaggtccgtcttacggtccttaaccgtcc

SEQ ID NO: 414474 - DNA, 612 bp, Homo sapiens
  misc_feature: GZ8MTXP01EM8JF.13.25.C03.1.454.CMB.2.raw
  modified_base (193)..(193): a, c, t, g, unknown or other
  modified_base (201)..(201): a, c, t, g, unknown or other
  modified_base (208)..(208): a, c, t, g, unknown or other
  modified_base (223)..(223): a, c, t, g, unknown or other
  modified_base (234)..(234): a, c, t, g, unknown or other
  modified_base (247)..(247): a, c, t, g, unknown or other
  modified_base (251)..(251): a, c, t, g, unknown or other
  modified_base (259)..(259): a, c, t, g, unknown or other
  modified_base (268)..(268): a, c, t, g, unknown or other
  modified_base (294)..(294): a, c, t, g, unknown or other
  modified_base (307)..(307): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacngtccgggntgaggtnaagagcctgagcctnagtgagtctcngcagctcgatacncctnatggaacntgcatatgngcgacgagccccaggacaggcttacnggtggagtggggnggtactacaaccgtagagtggtacgacaacaaacgtagtagaaaacgtaaagtaagtttgggaacgggtcccgggtacaacccgtatcggaaaccgagggacaacggtcaatacaaatacgacgtccttacgagtacgaacacgaccaggtactcggaccttcgacggaaccgacgacgggtcccgttagttacgttacgtgtcggtaacggtacgttaaacgttcacggtaccttaaattccgtttggttaaagtttcgggggacctaagggaccgtccgttacggtcccgttaaccgtccccg

SEQ ID NO: 414475 - DNA, 243 bp, Homo sapiens; identical to SEQ ID NO: 253633
  misc_feature: GZ8MTXP02I6DQ5.13.25.C03.1.454.CMB.2.raw
  modified_base (242)..(243): a, c, t, g, unknown or other

SEQ ID NO: 414476 - DNA, 588 bp, Homo sapiens
  misc_feature: GZ8MTXP02IN1IH.13.25.C03.1.454.CMB.2.raw
tcagtcacgtactacacgaccggtgctcgatttagtagtgtagatttgggtttggggagcatcacccagcaaccacatctgtcctctagagaatcccctgagagctccgttcctcaccatggactggacctggaggatcctcttcttggtggcagcagccacagcagcccactcccaagtgctcctgaaacagtccgggctgaggtgaagaagcctgaggcctcagtgaaggtctcctgcaaggcttccggatacaccctcaatggaaactatgtccactatgtgcgacaggccccaggacaagggctctgtggagtggggtggatcaaacctatagtgtgacacaaactatgagaagatttgagggccggtacaccatagacagggacacgtacatacaatacagcctacatggaactgaccagacttcgaacctcgtacgacgaccaacggtcccgtggtaactttacgtgtacggtacggtaccggtaaaactcaacggtacccttaaacgttaaccgtttagtaaagtttttcgggggacctaacgggggtacgcccggttacggtccgtaacccggttccccg

SEQ ID NO: 414477 - DNA, 583 bp, Homo sapiens
  misc_feature: GZ8MTXP02JQ0JP.13.25.C03.1.454.CMB.2.raw
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagaagcctgaggcctcagtgaaggtctcctgcaaggcttccggatacaccctcaatggaaactatgtccactatgtgcgacaggccccaggacaaggcttctgtggagtggggtgatcaacctaatagtggtgacacaaactatagaagaaagtaagtttggaaggggccggggtacacccgagtcggacccgaaggggaccacgtccagtacaaatacacgccttacatacggaactcgaaccatactgaccctcgtacgacgacgacggccgtatattactggtcgtcggtacgaaactcacgtacctaacttactttagtaacgtttcgggggaccgtaggggacgtcccgtacggtcctacccgttccg

SEQ ID NO: 414478 - DNA, 242 bp, Homo sapiens; identical to SEQ ID NO: 253715
  misc_feature: GZ8MTXP02ILH7U.13.25.C03.1.454.CMB.2.raw
  modified_base (242)..(242): a, c, t, g, unknown or other

SEQ ID NO: 414479 - DNA, 248 bp, Homo sapiens
  misc_feature: GZ8MTXP02HUPLQ.13.25.C03.1.454.CMB.2.raw
  modified_base (246)..(248): a, c, t, g, unknown or other
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgcccctcggtcgactctgttccgtccctcctctagtacgtgactgagcgggctggcgaaggacggcatagnnn

SEQ ID NO: 414480 - DNA, 599 bp, Homo sapiens
  misc_feature: GZ8MTXP02JRY56.13.25.C03.1.454.CMB.2.raw
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagaagcctgaggcctcagtgaaggtctcctgcaaggcttccggatacaccctcaatggaaactatcgtaccactatgtgcgacacggccccaggacgaagggcttcgtggtggagtggggtagactaccaaacccgttaagtaggtggtacgaacaactaaaactagtagaaagaaagtaagtttgggaacggggtccggtacaccagtacgaccgaagggacaacgtccaatacaaatacacgccttacagtaggaactagaaccatactgacctcgacgacaccgacggccgtagtactacgtgcgacggtacaactcgacgtaccttaactacgtttagtacggtttcgggacccgtagggaccgtcccgtcggtcccacgttccc

SEQ ID NO: 414481 - DNA, 591 bp, Homo sapiens
  misc_feature: GZ8MTXP02JI057.13.25.C03.1.454.CMB.2.raw
  modified_base (226)..(226): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagaagcctgaggcctnagtgaaggtctcctgcaaggcttccggatacaccctcaatggaaactatgtccactatgtgcgacaggccccaggacaggcttcgtggtggagtggggtgactacaaacctataggtggtacgacaactaaactatagaagaaagtagtttgggaacggggtccgggtacaccgagtagaaccgagggacacgtacagtacaaatacacgccttacagtacggaactacgaaccagaccgtgacctcgtacgaaccgacgacggtccgtagttacttacgtgtcgtacggtacgaaactcgacgtacctaacttacgttagtaacgtttcgggaccgtacgggacgtccgtcggtacctacgtcc

SEQ ID NO: 414482 - DNA, 587 bp, Homo sapiens
  misc_feature: GZ8MTXP02I23NY.13.25.C03.1.454.CMB.2.raw
  modified_base (193)..(193): a, c, t, g, unknown or other
  modified_base (201)..(201): a, c, t, g, unknown or other
  modified_base (224)..(224): a, c, t, g, unknown or other
  modified_base (255)..(255): a, c, t, g, unknown or other
  modified_base (266)..(266): a, c, t, g, unknown or other
  modified_base (413)..(413): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacngtccgggntgaggtgaagagcctgaggcctnagtgaggtctctgcaggctcggatacacctnaatggaaactntgtccactatgtgcgacacggccccaggacagggcttctgtggatggggtgatcaacctataggtgtgacacaaactatagaagaaagtaagtttggaacggggtccgggtacaccgagtacgacgagggacacgtcatacaatacncgtccttacataggactagaccagactgaccttcagaccgacgacggtcgtagtacttacgtggtcgacgggtacaaacgtcgtaacgtaccttaaacttacgtttggttaaacgtttttcgggggacccgtagggggtaccgtcccggttacggtaccgtacccggtttcccg

SEQ ID NO: 414483 - DNA, 462 bp, Homo sapiens
  misc_feature: GZ8MTXP02GWTWO.13.25.C03.1.454.CMB.2.raw
  modified_base (454)..(462): a, c, t, g, unknown or other
tcagtcacgtactacacgaccggtgctcgatttagtagtgtagatttgggtttgggtccgccaggctccggggaagggactggagtggattgcatacatcagtggaggtggagccaccagatactacgcagagtctgtgaaggaccgtttcatcatttccagagacaacgccaagaactctctgttcctacaaatgaatcgcctgagccccgaggacacggctgtctactactgcgggagacgaggctttgactacgtggggccagggaaccctggtcaccgtctcctcacgcctccaccaacgggccccatccggtccttcccccctggccacccctcctccaagacgccaccctcgtcgggggcaacgacgccggccctcggggcctcgcccgtggtacaaaggactacttccgtagtaccgtgacctgagcgggctggcaaggcgcatagnnnnnnnnn

SEQ ID NO: 414484 - DNA, 599 bp, Homo sapiens
  misc_feature: GZ8MTXP02I0G9K.13.25.C03.1.454.CMB.2.raw
  modified_base (193)..(193): a, c, t, g, unknown or other
  modified_base (202)..(202): a, c, t, g, unknown or other
  modified_base (225)..(225): a, c, t, g, unknown or other
  modified_base (309)..(309): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacngtccggggntgaggtgaagagcctgaggcctnagtgaggtctcctgcaggcttccggatacaccctcaatggaaactatgtccactatgtgcgacaggccccaggacaggcttcgngtggagtggggtgatccaacctagtagtggtgacacaaactatagaagaaagtagtttggacggggtccgggtacaccgagtcgaccgaggggacaccggtaccatacaaatacacgtccttacagtacggaactaggaccagactcgaccctctacgaccgacgacggccgtagtacttacgtgtcgtacggttacgaaacctcgaacgtacctaaacgttaccgtttaggtaaacgttttcggggaccgtaggggtaccgtcccgtacggtaccctaccggtttcccg

SEQ ID NO: 414485 - DNA, 637 bp, Homo sapiens
  misc_feature: GZ8MTXP02FWKG7.13.25.C03.1.454.CMB.2.raw
  modified_base (242)..(242): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacaggtccggggctggaggtgaagaagcctgaggcctcagtgaaggtctccngcaaggcttccggatacaccctcaatggaaactatgtccactatgtgcgacaggccccaggacaagggcttctgtggatggggtgatcaaacctatagtgtgacacgaaactatgaagaagtagttgagggccgggtacaccagtgaccgaggacacgtacatacaaatacagtccttacagtaggaacttacggaaccaagtacctacggacccttacgtagaaaccgacgaacgggtcccgttaggtacttaacgtggtacggtacgggtaccgaaaacgtcgaacggttaacccttaaaacgttaaccgttttaggtaaaacggtttttcgggggaacccgtaacgggggtaaccggtaccccggttcgggtacccgtaacccggtttcccg

SEQ ID NO: 414486 - DNA, 554 bp, Homo sapiens
  misc_feature: GZ8MTXP02HOGFQ.13.25.C03.1.454.CMB.2.raw
  modified_base (312)..(312): a, c, t, g, unknown or other
  modified_base (414)..(414): a, c, t, g, unknown or other
  modified_base (432)..(432): a, c, t, g, unknown or other
tcagtcacgtactacacgaccggtgctcgatttagtagtgtagatttgggtttggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagagcctgaggcctcagtgaaggtctcctgcaaggcttccggatacaccctcaatggaaactatgtccactatgtgcgacaggccccaggacaagggctctgnggatggggtggatcaacctaatagtggtcgacacaaactatagagaagaatttggaaggggccggtacaccatgacccgagggacacgtacatcaatacacncttcatagaactgaaccngactgacctcgtgacgacgacggccgtgtattactgtgtcggtacaaacgtcaacgtcctaaactactttagtaacgttttggggccgtaaggggtcgccccgtggtacctaccgttacccg

SEQ ID NO: 414487 - DNA, 587 bp, Homo sapiens
  misc_feature: GZ8MTXP02FPAE5.13.25.C03.1.454.CMB.2.raw
  modified_base (563)..(563): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccgggctgaggtgaagagcctgaggcctcagtgaaggtctcctgcaaggcttccggatacaccctcaatggaaactatgtccactatgtgcgacaggccccaggacaagggcttcgtggtggagtggggtgatacaaaccctaagtacggtggtacgacacaaaactatagaagaaagtaagtttgggaggggtccggggtacaaccagtcgaccagggacacggtcatacaaatacagcttacatacggaactagaccagactgacctctagaccgacgaccggccgttagtacttactggttcggacgttacgaaactcgacgaccttaaacgttacgttagtaaggtttcgggacgacgggtacncccgtacggtaccgtaccggttcc

SEQ ID NO: 414488 - DNA, 612 bp, Homo sapiens
  misc_feature: GZ8MTXP02GU0S7.13.25.C03.1.454.CMB.2.raw
  modified_base (227)..(227): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacaggtccggggctgaggtgaagaagcctgaggcctnagtgaaggtctctgcaaggcttccggatacaccctcaatggaaactatcgtccactatgtgcgacacggccccaggacaggcttcgtgtggagtggggtgatcaaacctataggtggtacgacaacaaactataggaagaaagtagtttgggacggggtccggtacaccgagtcgaaccgagggacacgtcaatcaatacacgtccttagagtaggaactacggaccagactacgacctcgtacgaaccgacgtaccgggccgttgtaacttacgtggtcgtacggtacaaacgtcgaacgtacccttaacgttaccgtttagtaacggttttaacggggaccgtaacggggtaccgtcccggtacggtaccgtacccggttccg

SEQ ID NO: 414489 - DNA, 643 bp, Homo sapiens
  misc_feature: GZ8MTXP02F956E.13.25.C03.1.454.CMB.2.raw
  modified_base (264)..(264): a, c, t, g, unknown or other
  modified_base (315)..(315): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacaggtccggggctgaggtgaagaagcctgaggcctcagtgaaggtctcctgcaaggcttccggatacaccctnaatggaaactatgtccactatgtgcgacaggccccaggacaagggcttcgnggtggagtggggtgataccaaacctaagtacggtggtagaacacaaaactatagaagaaagtaagtttggaagggggtaccgggtaccaaccgtaagtcggaaaccgaaggggaaccaccggtaccaatacaaactacacgtccttacagtagggaaactcggaaccaaggaactacgaccctacgtagaaccgacgaccgggtccgttagttacgttacgtggtcggtaccggtacgaaacgtcaacggtaccttaaacgttacgtttgtaaacggttttcgggggacgtaacggggtacgcccgttcggtacccgtaccgttcccg

SEQ ID NO: 414490 - DNA, 647 bp, Homo sapiens
  misc_feature: GZ8MTXP02JMNV9.13.25.C03.1.454.CMB.2.raw
  modified_base (440)..(440): a, c, t, g, unknown or other
  modified_base (449)..(449): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctagaaacagtccggggctgaggtgaagaagcctgaggcctcagtgaaggtctctgcaaggctccggatacaccctcaatggaaactatgtccatatgtgcgacacggccccaggacaaggtcttcgtgtggagtggggtgatacaaaccctaagtagtggtacgacaacgtaaactagtaggaaagaaagtaagtttgggacgggtaccgggtacaacgtagtcgaaccgagggacacgtaccagtacaatacncgtacctanagtacgtaactagaaccaagtacacgtacctcgtacgaccgaacgaccggtacccgttagttacgtaccgttgtaccggtacgggtaccgtaaactaccgaacggtacccttaaaccgtttacgtttaaggttaacggttttaacgggggacccgtaacggggtaccgtacccgttacggcccgttaaccggttcccg

SEQ ID NO: 414491 - DNA, 558 bp, Homo sapiens
  misc_feature: GZ8MTXP02FH099.13.25.C03.1.454.CMB.2.raw
  modified_base (311)..(311): a, c, t, g, unknown or other
  modified_base (322)..(322): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccgggctgaggtgaagaagcctgaggcctcagtgaaggtctcctgcaaggcttccggatacaccctcaatggaaactatgtccactatgtgcgacaggccccaggacaaggcttcngtggatggggngatcaacctatagtggtgacacaaactatgagaaagtattggacggggccgggttacaccagtcgaccgtaaggggacacgtccaagtcaaatacagtccttacataggaactgaaccagactgacctctagaccgacacggccgtgtatacgtgcgacgtacgaaactcaacgtacctaacttacttgtaaagtttcggggaccgtagggacgtccgtacggtccgaccgttccg

SEQ ID NO: 414492 - DNA, 645 bp, Homo sapiens
  misc_feature: GZ8MTXP02G38G6.13.25.C03.1.454.CMB.2.raw
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagaagcctgaggcctcagtgaaggtctcctgcaaggcttccggatacaccctcaatggaaactatgtccaactatgtgcgacaggccccaggacaaggcttcgtgtggagtggggtgatccaaaccctaagtacgtggtcgaacaacgtaaactagtagaagaaagtaacgtttggaacgggggcccgggttacaacccgtagtaccggaaacccgaaacggggaccaacccggtaccaacgttacaaacgtaccacggtaccctttacaaagttacggaaacttacgaacccgtaacgacgttacgaacccgttactacggaaccgaaccgaacggtccgtagttattaacgtgtcggcggtacgaaactcacgtacctaacgttacgttgtaacgtttcgggacgtacgggacgtccgtcggtcaccgttccg

SEQ ID NO: 414493 - DNA, 671 bp, Homo sapiens
  misc_feature: GZ8MTXP02F6RI2.13.25.C03.1.454.CMB.2.raw
  modified_base (258)..(258): a, c, t, g, unknown or other
  modified_base (276)..(276): a, c, t, g, unknown or other
  modified_base (303)..(303): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacaggtccgggctggaggtgaagaagcctgacggcctcagtgaagtctctgcaggctcgatacacctnatgaactatgccatatgngcgacacggccccaggacaaggcttcngtggagtggggtgactaccaacctaatacggtggtacgacaacaaactataggaaagtaaagtaagttgggacggggccgggttacacctagtacggaaccgaacggggacctaacggtccaaattaccaaaagttaccacgtaccttaccgaagtacggtaaacgtacggaaccgtaaggtaccgtacggaaccccttcgtaaccggaaaccccgaccgtaacgggtcccgttaagttagttaaccgtgtacggtaccggtaaccgtaaaacgtcgaaacggtaccttaaacctttacgttaggttaaacgttttcgggggaacccgtacgggtaccgtcccgttacggtacccgttaacccttccg

SEQ ID NO: 414494 - DNA, 682 bp, Homo sapiens
  misc_feature: GZ8MTXP02J04T5.13.25.C03.1.454.CMB.2.raw
  modified_base (194)..(194): a, c, t, g, unknown or other
  modified_base (263)..(263): a, c, t, g, unknown or other
  modified_base (273)..(273): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctagaaacnggtccgggctgaggtgaagaagcctgaggcctcgagtgaaggtctcctgcaggcttccggatacacctnaatgaaactntgtccactatgtgacgacgacggccccaggacaacgggtcttcgtggtggtagtgggggtagactacctaaacccgtaagtaggtggtacgaactactaaaacgtataggaaagtaaagttagttgggacgggggtcccggtacaccgtagtacgacccgaggaccgacgtaccgactacaagtacacgtccttacgagtacgtaactacgaacctagacctacgaccctacgtacgaccgaccgtaccggtaccgttacgttaacttacgtacggtacggtaccggtaaaccggtaaacctaccgtaaccgtaccgtttaaaccgttacgtttaacggttaacggttttaacggggacccggtaacggggtacccgtacccggttacggtacccgtaccgtttccccg

SEQ ID NO: 414495 - DNA, 657 bp, Homo sapiens
  misc_feature: GZ8MTXP02IGTZA.13.25.C03.1.454.CMB.2.raw
  modified_base (266)..(266): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctagaaacaggtccggggctggaggtgaagaagcctggaggcctcagtgaaggtctcctgcaggtctcggatacaccctanaatggaaactatcgtccactagtgtcgacgacgacggccccaggacgaaggggcttcgtggtacggagtggggtagactaccaaacccgtaagtacggtggtaccaacaacaaactagtagaagtaaagtagttgggacgggccggtacacgagtacgacgaggaccacgtacagtacaaatacgacgtacctacagtacgaactacgaaccgagtacgtacgacccgttacggacgaaaccggaccgtaccggtccgttacggtaacttacgtcgtacggtaccggtaaccgtaaacgtccaaacgtaccttaaaccgttacgtttaacggtacgggtttaacgggaccgtacggggtacccgtccggtacggtacccgtacccgtcccg

SEQ ID NO: 414496 - DNA, 243 bp, Homo sapiens
  misc_feature: GZ8MTXP02H8HIR.13.25.C03.1.454.CMB.2.raw
  modified_base (243)..(243): a, c, t, g, unknown or other
tcagtcacgtactacacgaccggtgctcgatttagtagtgtagatttgggtttgggggtgtggtggtctccactcccgccttgacgaggctgcctattactgctgctcatatgcaggttcttctgtggtcttcggcggagggtccaaagtgaccgtcctaggtcagcccaaggctgccccctggtcactctgttcccaccctcctctagtacgtgactgagcgggctgggcaaggcgcatagn

SEQ ID NO: 414497 - DNA, 634 bp, Homo sapiens
  misc_feature: GZ8MTXP02JZ9S7.13.25.C03.1.454.CMB.2.raw
  modified_base (268)..(268): a, c, t, g, unknown or other
  modified_base (339)..(339): a, c, t, g, unknown or other
  modified_base (379)..(379): a, c, t, g, unknown or other
  modified_base (410)..(410): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctagaaacaggtccggggctggaggtgaagaagcctgaggcctcagtgaaggtctcctgcaaggcttccggataccacccctnaatggaaactatcgtaccactatgtgcgacgacggccccaggacgaagggtctacgtggtgggagtggggnggactacaaaccttaagtaggtggtacgacaacaaactanagaagtaagtaagttgggacggggccggtanaccgagtcgacgagggacacgcgatacgaatacacgtcttacagtacgaacgtagaccgaagactacgaccctagtacgacgaccgaccggtccgtagtacttacgtgtacgtaccggtacgtaaacgtacgtaacgtaccttaaaccgttacgtttacgttaaggttttaacggggaccggtacgggtacccggtccgttacggtaccgtacccggttacccg

SEQ ID NO: 414498 - DNA, 630 bp, Homo sapiens
  misc_feature: GZ8MTXP02JTY79.13.25.C03.1.454.CMB.2.raw
  modified_base (385)..(385): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttgggtggcagcagccacagcagcccactcccaagtgctcctagaaacagtccggggctgaggtagaagaagcctgaggcctcagtgaaggtctccgtgcgaaggcttccggatacccaccctcaagtaggaaactatcgtaccactagtgtgcgacgacggaccccgaggacgaagggtcttcgtggtggagtggggagtataccgaaacctaagtaggtggtacgacaacaaactanagaagaagtagttgggacgggtccggtacacgagtacgacgagactaccgtacaatcaaatacacgtcctacgagtacgaactacgacctagactcgacctcgacgacgaccgtacggtccgtagttacttacgtggtcgtacggtaacgtaacctacgaccggtacctttaaacgttacgtttaacgtagggtttccggggacgtacggggtaccgtcccgttacggtacccgtaccgttcccg

SEQ ID NO: 414499 - DNA, 631 bp, Homo sapiens
  misc_feature: GZ8MTXP02FGZIW.13.25.C03.1.454.CMB.2.raw
  modified_base (194)..(194): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactccccaagtgctcctgaaacnggtccgggctgaggtgaagaagcctgacggcctcagtgaaggtctcctgcaaggcttccggatacaccctcaatggaaactatgtccactatgtgcgacacggccccaggacaagggcttcgtgtggagtggggtgagttccaaaccctaagtacggtggtacgacaacaaaactatagaagaaagtaagtttgggaacgggggtccgggtaccaacctatacgaaccgaaggggtacacccggttacccaatacaaatacagccttacagtaggaacctgaaccagacctgacccttacgagaaccgacgaccggtaccgtggtaacttacgtgtcggtacggtaccgaaaactccaacgtaccttaaaactttacgttaacggttaagtttcgggggaccctacgggggacgtcccgttgggaccctaccgtccg

SEQ ID NO: 414500 - DNA, 630 bp, Homo sapiens
  misc_feature: GZ8MTXP02JSIDE.13.25.C03.1.454.CMB.2.raw
  modified_base (271)..(271): a, c, t, g, unknown or other
  modified_base (312)..(312): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagagctgagcctcagtgaagtctctgcaaggtcttcggataccaccctacaagtgaaactntcgtaccactatgtgcgacacggccccaggacaggcttcgnggtggagtggggtgactaccgaaacctaagtaggtggtacgacaacaaactagtagaaagtaaagtagttcgggaaggggcccggtacacagtacgaccgagggaccacgtacaactcaaactacacgtccttacagtacgaactagaaccagtacgtacacccgtcgtacgaaccgaccgtaccgggtaccgttagttaacgttaccgtaggtcggtacgggtaccaaaacgtccgtacgtaaccttaacttacgtttacggtaaaggtttcggggaaccgtacgggtaccgtcccgtacggtacccgtacgtttcc

SEQ ID NO: 414501 - DNA, 616 bp, Homo sapiens
  misc_feature: GZ8MTXP02GWNWL.13.25.C03.1.454.CMB.2.raw
  modified_base (262)..(262): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagaagcctgaggcctcagtgaaggtctcctgcaggcttcggataccaccctnaatggaaactatgtccactatgtgcgacacggccccaggacgaagggcttcgtggtggagtggggtgataccaaacctaagtaggtggtacgacaactaaacgtagtagaaagaaagtagtttcgggacggggtccggtacaccgagtacgaaccgagggacacgtacaagtacaaatacgacgtccttacagtacgaactacgaccgaagacgtgaccctcgtacgaaccgacgaccggtccgttagttaacttacgtgtacggtacggtacgaaactccgacgtacctaacgttacgttaggttaacgtttcggggaccgtagggtaccgtccgtacggtccgtaccgttcc

SEQ ID NO: 414502 - DNA, 591 bp, Homo sapiens
  misc_feature: GZ8MTXP02HVXW4.13.25.C03.1.454.CMB.2.raw
  modified_base (143)..(143): a, c, t, g, unknown or other
  modified_base (192)..(192): a, c, t, g, unknown or other
  modified_base (200)..(200): a, c, t, g, unknown or other
  modified_base (211)..(211): a, c, t, g, unknown or other
  modified_base (221)..(221): a, c, t, g, unknown or other
  modified_base (253)..(253): a, c, t, g, unknown or other
  modified_base (258)..(258): a, c, t, g, unknown or other
  modified_base (269)..(269): a, c, t, g, unknown or other
  modified_base (287)..(287): a, c, t, g, unknown or other
  modified_base (310)..(310): a, c, t, g, unknown or other
  modified_base (349)..(349): a, c, t, g, unknown or other
  modified_base (353)..(353): a, c, t, g, unknown or other
  modified_base (372)..(373): a, c, t, g, unknown or other
  modified_base (394)..(394): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctnttcttggtggcagcagccacagcagcccatcccaagtgctcctgaaacngtccgggntgagtgaaganctgaggcctnagtgaaggtctcctgcaaggcttccggatacnccctnaatggaaactngtcccatatcgtgcgacnggcccccaggacctaagggcctntagtggatggggtgatcaaacctatagtggcatacaatngaanagattgacggcggtcaacnnaccgaggacaacgttccaaancaatacactctagacgtagaactacgaccagacttacgaccctcgtacgaccgaaccgaccggttacgtagtacgttcgtacggtacgtaccggtaacgtaaactaccgtaacgtaaccttaaacgtttacgtttaaggttaacggttcgggtaaccgtacgggtaccgtaccgtaccggtacccgtacccgttccg

SEQ ID NO: 414503 - DNA, 723 bp, Homo sapiens
  misc_feature: GZ8MTXP02H7QS8.13.25.C03.1.454.CMB.2.raw
  modified_base (194)..(194): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcagcccactcccaagtgctcctagaaacnggtccggggctggaggtgaagaagcctgacggcctcgagtgaaggtctctgcaggctccggataccaccctacaatggaaactatcgtaccactatgtgccgaaccgacggccccgagggacgacggggtccttcgtggtacgggtaggttgggggtacgaactaccgaaaaccgttaagtaggtacggtacgaaccaaacctaaaacgtagtaacggaaaggtaaaagttaagtttcggggaacggggcccgggtacaaccgtagtacgaaccgaacgggacaccgtaccaagtaacaactacgacgtcttacgagtacgaactcgaacctagactacgacctacgtaccgaccgaccgaccgggtaccgttagttaccgttacgtacgggtaccggtacggtaaaccgtaaaaccgttccgaaaccgttaaccctttaaacgtttacggtttttaacggacgggttttaaccgggggacccgtaacggggtacccgttcccgtacgggtaccttaccccggttcccg

SEQ ID NO: 414504 - DNA, 622 bp, Homo sapiens
  misc_feature: GZ8MTXP02F720K.13.25.C03.1.454.CMB.2.raw
  modified_base (194)..(194): a, c, t, g, unknown or other
  modified_base (204)..(204): a, c, t, g, unknown or other
  modified_base (245)..(245): a, c, t, g, unknown or other
  modified_base (261)..(261): a, c, t, g, unknown or other
  modified_base (269)..(269): a, c, t, g, unknown or other
  modified_base (285)..(285): a, c, t, g, unknown or other
  modified_base (307)..(307): a, c, t, g, unknown or other
  modified_base (356)..(356): a, c, t, g, unknown or other
  modified_base (421)..(421): a, c, t, g, unknown or other
tcagtcacgtactacacgaccggtgctcgatttagtagtgtagatttgggtttgggggagcatcacccagcaaccacatctgtcctctagagaatcccctgagagctccgttcctcaccatggactggacctggaggatcctcttcttggtggcagcagccacagcacgcccactcccaagtgctcctgaaacnggtcccgggntggaggtgaagaagcctgacggcctcgagtagagtctctgnaggctcgatacacctnatgaactngccatatgtgacgacncggccccaggacaggtcttcgngtggagtggggagactaccgaaaccgtagtaggtgtacgaacaactaanagtagaagtaagtagttgggacggtcggtcaacagtacgaccgaggacacgtacatacaagtacncgtcttagagtacgatacgaaccgagtaccgtacgaccttacgaacgaaccccggaacgaccggttaccgttagttaaccgttagtacggttacgtacggtaaaccgaacttaccgaacgtaacctttaacgttaccgtttagtacggtttaacggggccgtaacgggtaccgtcccgtacggtacccgtaccgtttcccg

SEQ ID NO: 414505 - DNA, 565 bp, Homo sapiens
  misc_feature: GZ8MTXP01EZ037.21.39.D06.1.454.CMB.2.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtatagcagctggtagctggtatcagcaagaaaccagggaaacgcccctaaactcctagatctatgctgcatccagttggaagtcgggtccatcaagtcaagcgcagtgatcgtgggacagtattcactctcaccatcagcagcctgcagcctagaaggtattttgactaacttattattgtacaacgtacggtcttaccgtaaccgggttttcccccggaacgttttccgggaccggggtaacggggacccgtaaaggggttacggaacggttacgttaccgaaaacggtaacgttggtacgggtcgttacggaaccttaaccgtaacg

SEQ ID NO: 414506 - DNA, 504 bp, Homo sapiens
  misc_feature: GZ8MTXP01ATL7A.21.39.D06.1.454.CMB.2.raw
  modified_base (251)..(251): a, c, t, g, unknown or other
  modified_base (279)..(279): a, c, t, g, unknown or other
  modified_base (353)..(353): a, c, t, g, unknown or other
  modified_base (476)..(476): a, c, t, g, unknown or other
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcagtcagggtattagcagctggtancctggtatcagcaagaaaccagggaaancccctaaatcctgatctatgctgcatccagtttggaaagtcggggtcccatcaagttcaagcgcagtggatcgngggacagtatttcactctcaccatcagcagcctgcagcctgaagtatttgactaattattatgtacaacaggtctcgtaccggtttccccggaagtttcggcggtaggaccgtaaggtggagnttacaaacgactgtgcttgcaaccgtaa

SEQ ID NO: 414507 - DNA, 538 bp, Homo sapiens
  misc_feature: GZ8MTXP01C3K2G.21.39.D06.1.454.CMB.2.raw
  modified_base (291)..(291): a, c, t, g, unknown or other
  modified_base (371)..(371): a, c, t, g, unknown or other
  modified_base (381)..(381): a, c, t, g, unknown or other
  modified_base (413)..(413): a, c, t, g, unknown or other
  modified_base (416)..(416): a, c, t, g, unknown or other
  modified_base (428)..(428): a, c, t, g, unknown or other
  modified_base (477)..(477): a, c, t, g, unknown or other
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtccaccatcacttggtcgggcgagtcgaggggtatagcagctggtagcctggtatcgagacaaggaaaccgaggggaaaaccncccctaaactcctagactctatgctgctattccgtaaggtttggaaaggtccgggtacccagtcgaaaggttcaagcggnagtggatcgngggactagtcttcactctacacatcagcagcngcngtctagaagttntttgacttaacttattatgacacgcgtcctccgtacccggtttccccgngttcgggacgggtaggaccgaaggtgagattacgaaagtacgtgtgcttcgtccaacgtaa

SEQ ID NO: 414508 - DNA, 536 bp, Homo sapiens
  misc_feature: GZ8MTXP01DMIBA.21.39.D06.1.454.CMB.2.raw
  modified_base (251)..(251): a, c, t, g, unknown or other
  modified_base (279)..(279): a, c, t, g, unknown or other
  modified_base (289)..(289): a, c, t, g, unknown or other
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcagtcagggtattagcagctggtancctggtatcagcagaaaccagggaaacncccctaaacncctgatctatgctgcatccagttggaaagtcggggtcccatcaaggttcaagcggcagtgggatcgtagggacagtattcactctcacatcagcagcctgcagcctagaacggtattttgactaacttattattgtacaaacaggtccttaccgtaccgggtttcccccggtaacgttttccgggacgggtacgggaccgaaagggtggagacttacgaaacgaactggtggcttgcgaaccgtaac

SEQ ID NO: 414509 - DNA, 551 bp, Homo sapiens
  misc_feature: GZ8MTXP01ELPSW.21.39.D06.1.454.CMB.2.raw
  modified_base (281)..(281): a, c, t, g, unknown or other
  modified_base (343)..(343): a, c, t, g, unknown or other
  modified_base (358)..(358): a, c, t, g, unknown or other
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttggtcgggcagtcagggtattagcagctggtagcctggtatcagcaagaaaccagggaaacncccctaaatcctagatctatgctgcatcgagttaggaagtcgggccagtcgaagtcaagcgnagtgatcgtgggacngtattcactctacacatcagcagcctgcagcctagaagtatttgacttaacttattatcgtacaacgtcggtccttaccgtacccgggtttcccccggaagtttccgggacgggtaacgggaccgtaaagggtggaacgttacgttaaccgtaaaacggtacgtggtacggcttacggaaccttaacgtaacg

SEQ ID NO: 414510 - DNA, 519 bp, Homo sapiens
  misc_feature: GZ8MTXP01BOYWQ.21.39.D06.1.454.CMB.2.raw
  modified_base (260)..(260): a, c, t, g, unknown or other
  modified_base (281)..(281): a, c, t, g, unknown or other
  modified_base (344)..(344): a, c, t, g, unknown or other
  modified_base (400)..(400): a, c, t, g, unknown or other
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttggtcgggcgagtcagggtattagcagctggtagctggtancagcaagaaaccagggaaacncccctaaactcctagatctatgctgcatccagttaggaagtcgggccagtcgaagtcaagcgngagtggatcgtgggacagtacttcactctcacatcagcagcctgcagctagaagtntttcgacttaacttattattcgactaacgtcgtccttaccgtacccggtttccccggaacgttcgggacggtacgggacgaagggtgagacacgaagacgtgtcgcttacgcaacgtaa

SEQ ID NO: 414511 - DNA, 1002 bp, Homo sapiens
  misc_feature: GZ8MTXP01B5P1A.21.39.D06.1.454.CMB.2.raw
  modified_base (257)..(257): a, c, t, g, unknown or other
  modified_base (290)..(290): a, c, t, g, unknown or other
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatccctccgtgtctgcgtctgtaggagacagagtcaccatcacgttggtcgggcgagtcgaggggtattagcagctggtanccgtggtatcgagacaagaaaccgagggaaacncccctaaatcctagactctatgctgactagttccgtaggtttacgggaaacggttccggggtacccctagttaccgtaaacgggtttccgaaacgggtccgggtaacgtaagggttacggggtaacgtttacccgggtaaggggggtaaacccttaagggtttaaacccttttttacccgaaacccgttttaccccgtttaaaccccgtaaaccccttaaaccgtttaacccgaaaccgggttaccccgtaaaccggggtccccccgttaacgggtaaccccgtaaacccgggttaaccccgttttaaaggggttaaaacgggggttttaaacgtttttttttaaccgggtaaaaccccgttttaaaaacctttttttaaacgttttaaaccgttttaacccgggtttaaaccccgttaaaaaacccgggttcccgggggttaacccccgttttaaacccccggggttttaaacccccccggggggtttttaaccccccccccggggttaaacggggtttttaaccccggggggaaacccggggggttaaacccgggggttaaaaccccgggttaaaacggggggtttaaccggggaaaacgggttaaaccggttaaaaccccgggtaaaaaacccggggttaaacccggttcggggttaaccggggtcccgtttaacccggggtaaccccgttaaaccccggttttaaccg

SEQ ID NO: 414512 - DNA, 839 bp, Homo sapiens
  misc_feature: GZ8MTXP01ERTUI.21.39.D06.1.454.CMB.2.raw
  modified_base (205)..(205): a, c, t, g, unknown or other
tcagtcgtcgctcgcacgaccggtgctcgatttagtgacatctcgcagttctttgggggcaggagtcagacccagtcaggacacagcatggacatgagggtccccgctcagctccgtgggctcctgctgctctggttcccaggctccagatgcgacatccagatcgacccagtctccactcctccgtgtctgcgtctaggtaganacagagtcaacctatctacgttcggtcgggacgtaggtacgtagggtattacgcgtaggtcgttaggtacgccgtaggtactacgaggaccaaacggaaaaccgaacggggaaaccctaccccccttaaaacgtcccgtaagtaactttacgtactacggacctacgtacctaacgtttaccggttaaaggggtttaaacggggaaaccgggtttcccgggggtaacccctaaggtaaccggtaacggttaccgaaaccgggtccgggtaagtaagggtacgggtaccgtacgggtaacggggtaactaggtttaaccctttacaacccgtttcgaaacccgtaactaatcccgaacgtaccgtaacgccccgtaggacctaaccggtactttaaaggtaaacgggttttactttaacgaacccttttaaaacgtttagtttaacgtacgtaaaccgtaaaccgggtccggttacccgttaccccgggtttaaacccccggggttccccggttaaaggttacccggggacggggtaaacggttaaccgggtaaagggtaacggttaacgttaccttaaaacccgggaaggttaccgtggggtacggtcccttaaggtccccttaaacgggttcc

SEQ ID NO: 414513 - DNA, 380 bp, Homo sapiens
  misc_feature: GZ8MTXP01EOBA1.21.39.D06.1.454.CMB.2.raw
  modified_base (375)..(380): a, c, t, g, unknown or other
tcagtcgtcgctcgcacgaccggtgctcgatttagtgacatctcgcagttctttgggattgtctccagagacaattccaagaacacgctctatctgcaaatgaacagcctgaaagccgacgacacggccgtatattactgtgcgaaaggaaagggtcgggatcttgtagtggtgttacctcctcctccgttctactttgaccagtgggccagggaaccctggtcaccgtctcctcagcttccaccaaggcccatccgtcttcccctggccgccctgctccaggacgcacctccgagagcacacgcccgccctgggctgcctggtcaaggactacttccgagcgacgactgagcgggctcggcaaggcgcataagnnnnnn

SEQ ID NO: 414514 - DNA, 784 bp, Homo sapiens
  misc_feature: GZ8MTXP01EKX4J.21.39.D06.1.454.CMB.2.raw
  modified_base (270)..(270): a, c, t, g, unknown or other
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatcgacccagtctccatcctccgtgtctgcgtctgtagagacagagtcaccatctacgttggtcgggcgtagtcgagggtattaggcagtctaggtagccgtggtaancaagaccaaacggaaaaccgagggaaacctaccccctaaaatccgtagattactaagttcgacctaggtactagttaccgtaaggtttacggaaacggtttccggaccctagttaccggtaaacggtttcaaacgggtcccgtaacggtaaggttagggaactttaccggggtaacggggtaaacctaggttttaaaccctttttccgaaccgtttaccctaacccgaacctacggttaaccaacgggtaccaacgggttcccgtacgtacgtaaccgtacgtttaacgggttaacgttttacgttttaacgaaacctttaaacgtttaagttacgttacgttaacgtaacggttaccggttcccggttaacccgggtttaccccgggttaccccggttaacgggttaccgggggaacggtaaaccgggttacgtaaagggggtagaaacgttaaccttaaacggtaaacggtacggtaacggtacggtccgttactaacccgttaacgtaacg

SEQ ID NO: 414515 - DNA, 669 bp, Homo sapiens
  misc_feature: GZ8MTXP01A8UND.21.39.D06.1.454.CMB.2.raw
  modified_base (281)..(281): a, c, t, g, unknown or other
  modified_base (351)..(351): a, c, t, g, unknown or other
tcagtcgtcgctcgcacgaccggtgctcgatttagtgacatctcgcagttctttgggggcaggagtcagacccagtcaggacacagcatggacatgagggtccccgctcagctcctgggctcctgctgctctggttcccaggctccagatgcgacatccagatgacccagtcctccatcctccgtgtctgcgtctgtaggagacagagtcaccatcacgttgtcgggcgagtcagggtattagcagctggtagcctggtatcagcaagaaccgaggaaacncccctaaatcctagatctatgctgcagttcaggtttacggaagtccggtaccatcgaaggtcaagccggnaggtggtactcgtaggggaacacgtactttacgacttctcaacccgtataccgacgaccgacgtcccgttacgacctacggtaccgttaggtaaacgggtttagttttacggaacctttaaacttttaagttaacttacgtaacgtaaacccgtaacggttcccgtttacccggtaacccgggttttccccccggggtaagttttacccgggggaccgggggtaaacggttaaccgggtaaagggttacgggaacgttacgttaacgaaaacggtcggttcgggtacggtcggttacctaacccgttaaccgttaacg

SEQ ID NO: 414516 - DNA, 738 bp, Homo sapiens
  misc_feature: GZ8MTXP01A6P4Y.21.39.D06.1.454.CMB.2.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtcctccatcctccgtgtctgcgttctggtaggagacagagtaccacctatcgtacgttggcgggcaggtcgaaggggtattagcagtcgttaggtacgccgtaggtactacgaggacaacggaaaaccgacgggaaaaccgtacccccgtaaaactccgtagtacttactagtcgcgtacgacgtacttaccgtaagggtttacggaaacggttccgggggtacccctaggtaccgtaaaggttcgaaacgggccggtaagagggtttggaacgttccggtaaggggtaacttagttactttacaccgttacctaccaactactaccgaggaccacggtccacgtaccgaacggtacgttaagtaaggggtttaacttttacgaacctttaaatttagttacttaccggttaacgaaacgtccgttacccggtaccggttaccccgggtttaccccggtaacgggtttcgggaaccgggggtaaccggttaccggtaaagggttaacggaggaacgttaacccgtaaacgggtactcgggtgtaaccgttcgaacccttaacgttcc

SEQ ID NO: 414517 - DNA, 547 bp, Homo sapiens
  misc_feature: GZ8MTXP02HMIZW.21.39.D06.1.454.CMB.2.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgcgggcgagtcagggtattagcagctggttagcctggtatcagcagaaaccagggaaacgcccctaaactcctagatctatgctgcatccagtttggaaagtcggggtcccatcaaggttcagcggcagtggatcgtagggacagatttcactctcaccatcagcagcctgcagcctagaacgtattttgactaacttattacttagtacaacacggctaccgtaaccgggtttcccccggtaactttccggggacggtacggggacccgtaaagggtcgggagaacgtacgaaaacgacgtaggtacggctacggacctacctacg

SEQ ID NO: 414518 - DNA, 517 bp, Homo sapiens
  misc_feature: GZ8MTXP02HMHUU.21.39.D06.1.454.CMB.2.raw
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgcgggcagtcagggtattagcagctggttagcctggtatcagcagaaaccagggaaacgcccctaaactcctgatctatgctgcatccagtttggaaagtcggggtcccatcaagttcagcgcagtggatctggggacagtattcactctcacatcagcagcctgcagcctagtaagtatttttgactaaactttattattgtacaacaggtctcgtaccggtttcccccggtacgtttcgggcggtacgggaccgaacggtgacgatacaaacgtaactcgtaggctacgcactac

SEQ ID NO: 414519 - DNA, 535 bp, Homo sapiens
  misc_feature: GZ8MTXP02I1TBA.21.39.D06.1.454.CMB.2.raw
  modified_base (280)..(280): a, c, t, g, unknown or other
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcagtcagggtatagcagctggttagcctggtatcagcaagaaaccagggaaacncccctaaaatcctagatctatgactgcatccagtttaggaaagtcggggtacccatcaaggttcagcggcagtggatcgtagggacagtatttcactctcacatcagcagctgcagacctagaagtattttgactaatttattattgactaacaggtcttcgtaccggtttcccccgtaagtttccggacggacggaaccgtaacggtacggaagacgtaacgaaaacgtacgtagtacggactagaccacctag

SEQ ID NO: 414520 - DNA, 542 bp, Homo sapiens
  misc_feature: GZ8MTXP02GXH68.21.39.D06.1.454.CMB.2.raw
  modified_base (281)..(281): a, c, t, g, unknown or other
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcagtcaggggtattagcagctggtagcctggtatcagcaagaaaccagggaaacncccctaaatccctagatctatgctgcatccagttggaaagtcggggtccatcaaggttcagcgggcagtggatcgtaggggactagatttcactctcaccatcagcagccctgcacgcctagaacgtattttcgacttaacttattacgttagtacaacgtaggtcctacgtaccggtttccccgacgtttcgggacggtacgggaaccgaagggtcgaacgtacgtacgaaacgaacgtgtacggctaggacctactacg

SEQ ID NO: 414521 - DNA, 586 bp, Homo sapiens
  misc_feature: GZ8MTXP02I8WHO.21.39.D06.1.454.CMB.2.raw
  modified_base (283)..(283): a, c, t, g, unknown or other
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcaggggtattagcagctggttagcctggtatcagcaagaaaccagggaaacncccctaaatcctagatctatgctgcatccagttggaaagtcggggtacccatcaaggttcaggcgcgagtggatcgtgggacagtatttcactctcacatcagcagctgacagcctagaagtattttgacttaactttattattcgtacaacgtacggtcttaccgtaccgggtttcccccggtaacgttttcccggggacgggtaacggggtaaacccgtaaaggggttacgggaaacgtacgttaaaccgaaaacggtaaaccgttgggtacgggtacttaccggaccgtaaccgttaacg

SEQ ID NO: 414522 - DNA, 591 bp, Homo sapiens
  misc_feature: GZ8MTXP02GW9IO.21.39.D06.1.454.CMB.2.raw
  modified_base (254)..(254): a, c, t, g, unknown or other
  modified_base (284)..(284): a, c, t, g, unknown or other
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttggtcgggcgagtcgagggtattagcagctggtancctggtatcagcaagaaaccgagggaaacncccctaaactcctagatctatgctgcatccgtaggtttaggaaagtccggggtaccagtacgaaggttcagcggcagtgatcgtgggacagtatttcactctacacatacagcacgtcctagcgagaccgtagtaaacgttattttacgacttaaactttaagttaacttacggtactaaacgtacggtcccttaccgggtaccccgggtttcccccggtaacgtttccggggaccgggacggtaaccgaagggtcgaaacgtacgtaacgaaaacgtagtcggttacggactacgaccgaactacg

SEQ ID NO: 414523 - DNA, 509 bp, Homo sapiens
  misc_feature: GZ8MTXP02HCHGH.21.39.D06.1.454.CMB.2.raw
  modified_base (281)..(281): a, c, t, g, unknown or other
  modified_base (347)..(347): a, c, t, g, unknown or other
  modified_base (351)..(351): a, c, t, g, unknown or other
  modified_base (355)..(355): a, c, t, g, unknown or other
  modified_base (413)..(413): a, c, t, g, unknown or other
  modified_base (420)..(420): a, c, t, g, unknown or other
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggtagcctggtatcagcagaaaccgagggaaacncccctaaactcctgatctatgctgcatcctagttggaagtcggggtccagtcagtcagcgcagtgntcgngganagtacttcactctcacatcagcagcctgcagcctagatatttgactacgttattagtntacaagngtcctacgtacccggttcccccggtctttccgggcggtacggaaccaggtggacactacgaaacgtactggtcgactcgacgaccctag

SEQ ID NO: 414524 - DNA, 633 bp, Homo sapiens
  misc_feature: GZ8MTXP02IET96.21.39.D06.1.454.CMB.2.raw
  modified_base (188)..(188): a, c, t, g, unknown or other
  modified_base (373)..(373): a, c, t, g, unknown or other
  modified_base (384)..(384): a, c, t, g, unknown or other
tcagtcgtcgctcgcacgaccggtgctcgatttagtgacatctcgcagttctttggggggcaggagtcagacccagtcaggacacagcatggacatgagggtccccgctcagctcctggggctcctgctgctctggttcccaggctccagatgcgacatccagatcgacccagtctccatcctccgtntctgcgtctgtaggagacagagtcaccatcacgttggcgggcgagtcgaggggttatagcagcgtaggttagccgtggtatcgagacaaggaaaaccgagggaaacctacccctaaactcctagactctatgctgactatccgtaggttaggaaggtccgggtacccatcgaaggttcacggcgngagtggatcgngggactagttacttcactctacactatccagccacgtcctcgacacgacctagtaacgtttattttacgactttaactttattatttacggtactaacgtacgttaccgttacccggttaccccgggtttacccccggtacggtttccgggggaccgggtaaacgggtaaaccgggaaagggttaccggaaaggtaacttaaaccggaaaacggtaacgtcgggtacggacttacggacctaacgtacg

SEQ ID NO: 414525 - DNA, 533 bp, Homo sapiens
  misc_feature: GZ8MTXP02JMOFA.21.39.D06.1.454.CMB.2.raw
  modified_base (204)..(204): a, c, t, g, unknown or other
  modified_base (254)..(254): a, c, t, g, unknown or other
  modified_base (262)..(262): a, c, t, g, unknown or other
  modified_base (283)..(283): a, c, t, g, unknown or other
  modified_base (292)..(292): a, c, t, g, unknown or other
  modified_base (303)..(303): a, c, t, g, unknown or other
  modified_base (395)..(395): a, c, t, g, unknown or other
tcagtcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatcgacccagtctccatcctccgtgtctgcgtctggtagganacagagtcaccatcaattgtcgcgcgagtcgaggtatagcagctggttancctggtancagcaagaaaccgaggaaacncccctaaancctagatctangctgactatccgaggtttaggaacgtcgggtaccatacgaggttcagcggcaggtggactcggtaggactagttacttcactcacacatcancacgctgcagctagattattgacttaatttatatagtacacgacgtctacgtacccggtttcccgtacgttcgggacggtacgggaccgtagggtacgacgaagtaacgaaacgtacgtcggtacgacgtcgacctac

SEQ ID NO: 414526 - DNA, 538 bp, Homo sapiens
  misc_feature: GZ8MTXP01DOTHV.8.49.E05.1.454.CMB.2.raw
  modified_base (380)..(380): a, c, t, g, unknown or other
  modified_base (455)..(455): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcactataaatggtatcagcagaaaccaggaaacgcccccaaatcctgatcaattatgcatccagtttgacaaagtcgggtcccccatacaagtatcgaagtggcggtgatcgtagggacagtattcactctacacatcaanagtctgacagtattgaagtattagtcgtacttaaactttattaacctgtcagacagtacgttccacgggcccctntccgttacggtttcgggacgggggtaaaccaagggttacggcgttaacgaaacgtaacgtggtacgggcttgccaaccgtaag

SEQ ID NO: 414527 - DNA, 521 bp, Homo sapiens
  misc_feature: GZ8MTXP01DIOJA.8.49.E05.1.454.CMB.2.raw
  modified_base (272)..(272): a, c, t, g, unknown or other
tcagctcgcgtgtccacgaccggtgctcgatttagagcgactagcaacacacaaaggggagtcagtctcagtcaggacacagcatggacatgagggtcccgctcagctcctggggctcctgctactctggctccgaggtggcagatgtgacatccagatgacccagtctccgcctccctgtctgcatctgtaggagacagagtcaccatcacttgccgggcaagtcagagcattggcactactaaatggtatcagcagaaaccagggaaacncccccaaactcctgatcaattatgcatccagtttgacaaagtcggggtcccccatacaagattcaagtggcggtggatctgggacagatttcactctcacatcaacagtctgcagattgagtattagtgctaacttattactgtcagacagtacgttccacggaccccgtctcgacgtttcgggacgggggtaaccaaaggttcgggacgttacgaaaacggaactggtacggcttacgccaaccgtaa

SEQ ID NO: 414528 - DNA, 558 bp, Homo sapiens
  misc_feature: GZ8MTXP01BMB6I.8.49.E05.1.454.CMB.2.raw
tcagctcgcgtgtccacgaccggtgctcgatttagagcgactagcaacacacaaagggggcaggagtcagtctcagtcaggacacagcatggacatgagggtcccgctcagctcctggggctcctgctactctggctccgaggtggcagatgtgacatccagatgacccagtctccgccctccctgtctgcatctgtaggagacagagtcaccatcacttgccgggcaagtcagagcattggcacctactaaattggtatcagcagaaaccagggaaagcccccaaatcctgatcaaattatgcatccagtttgacaaagtggggtccatcaagattcaagtggcggtggatcgtggggacagatttcactctcaccatacaacagtctgcagattgaggggatttatgactaaacttattaaccgtgttacgagacagtacgtttccgaacgggtaccccgcgtccgttacgtttccgggggaccggggggttaacccaaagggttcgggaaccgttacgaaaacggtaccgtagggttacgggcgttcggaacccg

SEQ ID NO: 414529 - DNA, 531 bp, Homo sapiens
  misc_feature: GZ8MTXP01DHSZJ.8.49.E05.1.454.CMB.2.raw
tcagctcgcgtgtccacgaccggtgctcgatttagagcgactagcaacacacaaagggggcaggagtcagtctcagtcaggacacagcatggacatgagggtcccgctcagctcctggggctcctgctactctggctccgaggtggcagatgtgacatccagatgacccagtctccgccctccctgtctgcatctgtaggagacagagtcaccatcacttgccgggcaagtcagagcattggcactactaaatggtatcagcagaaccaggaaacgcccccaaatcctagatcaattatgcatccagtttgactaaacgtggggtaccatacaagaattcaagtggcgggtggatcgtggggacagatttcactctcaccatacaacagtctgcagattgaggggtattatgactaacttattactgtacagtcagacgttccaaggaccccgctcgacgtttcgggacggggggttaaccgaaggttcggaacgttacgaaacggtacgtaggttcggcgttggaacccg

SEQ ID NO: 414530 - DNA, 505 bp, Homo sapiens
  misc_feature: GZ8MTXP01AUKD0.8.49.E05.1.454.CMB.2.raw
  modified_base (270)..(270): a, c, t, g, unknown or other
  modified_base (441)..(441): a, c, t, g, unknown or other
tcagctcgcgtgtccacgaccggtgctcgatttagagcgactagcaacacacaaaggggagtcagtctcagtcaggacacagcatggacatgagggtccccgctcagctcctggggctcctgctactctggctccgaggtggcagatgtgacatccagatgacccagtctccgcctccctgtctgcatctgtaggagacagagtcaccatcacttgccgggcaagtcagagcattggcactactaaatgtatcagcagaaaccaggaacncccccaaatcctgatcaattatgcatccagtttgacaaaggtcgggtacccccatcaagattcaagtgggcggtgatcgtggggacagtatttcactctcacatacaacagtctgcagacttgagtattagtgactaacttatactgtcagcagtcgttccacggaccccntcgacgtttcgggcgggggaaccaaggttcggacgttacaacgacgtgtcggcgttgcaacgtc

SEQ ID NO: 414531 - DNA, 634 bp, Homo sapiens
  misc_feature: GZ8MTXP01AQF3E.8.49.E05.1.454.CMB.2.raw
  modified_base (197)..(197): a, c, t, g, unknown or other
  modified_base (225)..(225): a, c, t, g, unknown or other
  modified_base (264)..(264): a, c, t, g, unknown or other
  modified_base (293)..(293): a, c, t, g, unknown or other
  modified_base (304)..(304): a, c, t, g, unknown or other
  modified_base (534)..(534): a, c, t, g, unknown or other
tcagctcgcgtgtccacgaccggtgctcgatttagagcgactagcaacacacaaaggggagtcagtctcagtcaggacacagcatggacatgagggtcccgctcagctcctggggctcctgctactctggctccgaggtggcagatgtgacatccagatgacccagtctccgcctccctgtcctgcatctgtagganacagacgtcaccatcacttcggccgganaagtcagagactagtcgacctacttaatagtgatacganagaacgaacgaaggaccccaaccactcanactactaattncgactactcgttagttacgaacgtaagggtccgacctactaacgaagtctagtaagggtcggtcggtagtacttcggggaggacgtagtttacttacctactcctaaccaactactaacctaagtacgtctacgagtaattagtagtaagttattagggtacaactttaacttaactttcgacgaacgtacgtaacgtacggttacccgtaaccggacccgaccccgttntacccgggtttacggggtccgggggaaaccgggaaaacttagggaccggttacttaaacgaaaccggtgttcgggacgtaccgactaacccgaacttccg

SEQ ID NO: 414532 - DNA, 758 bp, Homo sapiens
  misc_feature: GZ8MTXP01ACFJZ.8.49.E05.1.454.CMB.2.raw
  modified_base (279)..(279): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcactacttaattgtatcagcagaaaccagggaaacncccccaaactcctgatcaattatgcatccagtttgactaaacggtcggggtaccaagtacaaagtaactttcgaaggttggggaccgggttgggaactccgtagggggaaacctaggtactttttacaaccttacctccctaacctacttaaccaaacctaacggttccttacgggacctaaaggtaagttttagggaaagggggttaattttaagttacggtaaaccgtttaaaacccgtttttaaagtttaaacccttggtttaacccgtaaggtacccgtaaaggtaaccgggtttaccccggtaacccgggaaaccccccggttcgttaccccggttaaccgggtttttacccgggggtaacccgggggggggaaaccccgttaaaagggggttaccggggaaaaccggtttacccgggaaaaaccggttaaacccggttaggggttccgggtaaccggtttccgggtaaccccg

SEQ ID NO: 414533 - DNA, 573 bp, Homo sapiens
  misc_feature: GZ8MTXP01C3WGU.8.49.E05.1.454.CMB.2.raw
  modified_base (467)..(467): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgccctccctgtctgcatctgtaggagacagagtcaccatcacttgccgggcaagtcagagcattggcactactaaatggtatcagcagaaaccaggaaacgcccccaaatcctagatacaaattatgaccatcctagtttagacgaaagtcgggggtacccccatacaagtattcgaaagttgggcggtggagtcgtggggacagtattcactctacacatcaactagtctgacagattgaaggtattagtcgactaattataactgtcagcagtacgttccacggacccctntccgttcggtttaccggggaccgggggtaaccaaagggttcgggttaaccgttaccgtaaaaccggtaaacgttcggtcgggtcttcgggaaccaaccgttaaccg

SEQ ID NO: 414534 - DNA, 585 bp, Homo sapiens
  misc_feature: GZ8MTXP01CIF6G.8.49.E05.1.454.CMB.2.raw
  modified_base (425)..(425): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctcctgtctgcatctgtaggagacagagtcaccatcacttgccgggcaagtcagagcattggcactactaatgtatcagcaagaaaccagggaacacccccaaactcctagatacaattatgacatcctagtttagacgaaaggtcgggtaccccccatacaagtattcgaaggtgggcggtggatcgtagggactagtacttcactctacacctatacaacagtcctgaccagtattagagtattagngtactaacttatactgtacagactagtacgttaccgaaccggtcccctcgttaccgttaccgggtttcgggggaccgggggtaaacctaaagggttacgggaaccgttaaccggaaacgtaaccgtgggttacggacgttacggaaccttaaccgtaacg

SEQ ID NO: 414535 - DNA, 643 bp, Homo sapiens
  misc_feature: GZ8MTXP01A7YXO.8.49.E05.1.454.CMB.2.raw
  modified_base (199)..(199): a, c, t, g, unknown or other
  modified_base (224)..(224): a, c, t, g, unknown or other
  modified_base (259)..(259): a, c, t, g, unknown or other
  modified_base (262)..(262): a, c, t, g, unknown or other
  modified_base (358)..(358): a, c, t, g, unknown or other
  modified_base (395)..(395): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtagganacagatcacatcacttcggccgganaagtcagagactgtcgacctaacttaatagtgtanganacgaaacgaacggaaggaaccccaaccctactcgatactactaaatgcactactcgtagttcgaacgtaagggtccgacatagatctagaggcggngtagctgggagactagttcttactactctaccaactnaaccaagtcgttcacgataagttagtagggaaatttaacttagggtacctaaaacgtttaaatttacgttaacgtcggtaacacgtaacggttaacgttccccgtaaccggaccccggtacccgtctaaccgggttttaccgggggtaccggggggaaaccggtaaaaccgtaagggttaccgggaccgttaaaaaccaaacgggtttcgtcgggtacccggtacgttacctaacccgttaacgttcg

SEQ ID NO: 414536 - DNA, 574 bp, Homo sapiens
  misc_feature: GZ8MTXP01DSMPS.8.49.E05.1.454.CMB.2.raw
  modified_base (229)..(229): a, c, t, g, unknown or other
  modified_base (437)..(437): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtcctccgccctccctgtctgcatctgtaggagacagagtcaccatcacttgccgggnaagtcagagcatgcacctaattaatgatcagcaagaaaccaagggaaaccacccccaaactcctagaatactaaatttatcgactattcctagtttcgacgtaaacggtcggggtaccaagtctaaagtaattacgaaggtgggcgggtggatcgtgggatagtattcactctcacatacaacagtctagcagtataggaggtattangtactaattatactgtactagctagtacgttccgaacgcccttcgtcgttaccggtttaccggggacgggggttaaccgaaacggttcggaaccgtaccgaaacggtaacgtcggttacgggtccttcggtaacccg

SEQ ID NO: 414537 - DNA, 581 bp, Homo sapiens
  misc_feature: GZ8MTXP01ESF3Q.8.49.E05.1.454.CMB.2.raw
  modified_base (199)..(199): a, c, t, g, unknown or other
  modified_base (271)..(271): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgccctcctgtctgcatctgtagganacagagtcaccatcacttgccgggcaagtcagagcattggcactataatgatcagcaagaaaccaggaaacncccccaaactcctagactacaaattatgacatcctagtttcgacaaaggtcgggtacccccatacaaagtattcgaaaggtggcgggtagtactcgtaggggactaggtatttcacttctacaaccatacaactagtctgacaagtattagaggtattagtagtactaaacttattactgttcagtaccagtacgttaccgacggaccccgtctaccgttacggtttcggggaccgggggtaactaaacggttcgggaacgttaccgaaaacggtacgtggtacgggcttacggaaccgttaacgtaacg

SEQ ID NO: 414538 - DNA, 533 bp, Homo sapiens
  misc_feature: GZ8MTXP01DEOZ1.8.49.E05.1.454.CMB.2.raw
  modified_base (224)..(224): a, c, t, g, unknown or other
  modified_base (397)..(397): a, c, t, g, unknown or other
  modified_base (463)..(463): a, c, t, g, unknown or other
tcagctcgcgtgtccacgaccggtgctcgatttagagcgactagcaacacacaaaggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgcccgggnaagtcagagcattggcacctactaaatggtatcagcaagaaaccagggaaacgccccccaaactcctgaactactaaattatgcaatcctagtttgacaaagtcggggtacccccatcaaagattcgaaggtggcggtgatcgtagggacagtattcactctacaccatcaanagtctgacagattgagtattagtgtactaattattactgtcagacagtacgttccacggtccccgntcgacggtttcggggcgggggtaaaccaagttgggaccttacgaaacgaactggtgcttagcaaccgtaa

SEQ ID NO: 414539 - DNA, 597 bp, Homo sapiens
  misc_feature: GZ8MTXP01DRM4E.8.49.E05.1.454.CMB.2.raw
  modified_base (200)..(200): a, c, t, g, unknown or other
  modified_base (229)..(229): a, c, t, g, unknown or other
tcagctcgcgtgtccacgaccggtgctcgatttagagcgactagcaacacgacaaagggggagtcagtctcagtcaggacacagcatggacatgagggtccccgctcagctcctggggctcctgctactctggctccgaggtggcagatgtgacatccagatgacccagtcctccgccctcctgtctgcatctgtagganacagacgtcaccatcacttggcccggganaagtcaagacgcattggctaacttacttaaatggtatacaagcaacgaaaccgaggggaaacacccccaaatcctagactcaattactgactatcctagtttcgacgtaaaggtcgggtacccccattacaagtacttcgaacggtggcgggtgatcgtagggactagtattcactctcacatcaacagtctgcagatgagtacttagtcgtactaattattacgtgtacacggtactaaggtcgttacccgaccgggtaaccccgcttcggttaaccggtttccgggggaaccgggggtaactaacgggttacggttccgttaaccgtaaacgtaacgtcggttacgggcttcggcgttaacccgtg

SEQ ID NO: 414540 - DNA, 539 bp, Homo sapiens
  misc_feature: GZ8MTXP01D3LRS.8.49.E05.1.454.CMB.2.raw
  modified_base (229)..(229): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtcctccgccctccctgtctgcatctgtaggagacagagtcaccatcacttgccgggnaagtcagagcattggcacctataaattggtatcagcaagaaaccagggaaacgcccccaaactcctagatacaattatgacatcctagtttgacaaacggtcggggtaccatacaagtaattcaaggtggcggtggatcgtggggacagtattcactctcacatacaacagtctgcagattgaggggtattatgactaacttattactgtacagtcagtacgttccaacggccccgctccgttacgtttcggggacgggggaaccgaaaggttcggaacgtacaaacggtactgttcggtcgttcgaacc

SEQ ID NO: 414541 - DNA, 528 bp, Homo sapiens
  misc_feature: GZ8MTXP01AQ1OB.8.49.E05.1.454.CMB.2.raw
  modified_base (274)..(274): a, c, t, g, unknown or other
  modified_base (335)..(335): a, c, t, g, unknown or other
  modified_base (447)..(447): a, c, t, g, unknown or other
tcagctcgcgtgtccacgaccggtgctcgatttagagcgactagcaacacacaaaggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcactactaaattggtatcagcagaaaccagggaacncccccaaatcctgatcaattatgcatccagtttgacaaaggtcgggtcccccatcaaagtnttcaagtggcggtggatcgtgggactagatttcactctcaccatacaacagtctgcagattgagtattagtgactaacttattactgtcagtcagtattcccacggaccccntccttacgttcggggaccgggggtaacccaaaggttcggacgttaccgaaacgtacgtggtacggcttgccgaacccgtaa

SEQ ID NO: 414542 - DNA, 545 bp, Homo sapiens
  misc_feature: GZ8MTXP01AMYKA.8.49.E05.1.454.CMB.2.raw
  modified_base (228)..(228): a, c, t, g, unknown or other
  modified_base (278)..(278): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggnaagtcagagcattggcactactaattgtatcagcagaaaccagggaaacncccccaaatcctagatcaattatgcatccagtttgacaaacgtcggggtaccatcaagtaattcaagtggcggtggatcgtggggacagatttcactctcacatacaacagtctgcagattagaggggtattatgactaacttatactgtacagtcagtacgttccgaacggtaccccgctaccgacggtttacggggaccggggggaacccttaaagggttcgggaacgttacgaaacgtaccgtaggttcggccgttggaacccg

SEQ ID NO: 414543 - DNA, 522 bp, Homo sapiens
  misc_feature: GZ8MTXP01DULZG.8.49.E05.1.454.CMB.2.raw
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcactactaaatggtatcagcagaaaccagggaaacgcccccaaactcctgatcaattatgacatcctagtttgacaaagtcggggtcccccatcaagattcaagtggcggtgatcgtgggacaggtatttcactctacacatcaacagtctgcagattgagtattatgctaattataactgtcagtacagtacgttccgacgaccccggtctcgttaccgtttcgggacgggggtaacaaggttcggacgttacgaaacgtaactgtaggcttgcaacctaag

SEQ ID NO: 414544 - DNA, 601 bp, Homo sapiens
  misc_feature: GZ8MTXP01AX3G1.8.49.E05.1.454.CMB.2.raw
  modified_base (201)..(201): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctcccgccctccctgtctgcatctgtagganacagagtcaccatcacttgccgggcaagtcagagcattggcactactaatgtatcagcagaaaccgagggaaacacccccaaactcctagatacaattatgacatcctagtttcgacgtaaaggtcggggtaccccccatacaagtacttcgaaaggtgggcgggtagagtcgtagggacagtatttcacttcacaccatacaactacgtctgacagtattaggagttattagtagtacttaaactttagttactgtaccagtacgtaagtaccgttacccgaccggtacccccgtcttaccggttaccgggtttccgggggaccgggggtaaaccgtaagggttcgggacgttaccgaaacggtacgtggtacggcgttacggaaccttaaccgtaacg

SEQ ID NO: 414545 - DNA, 921 bp, Homo sapiens
  misc_feature: GZ8MTXP01DEMNL.8.49.E05.1.454.CMB.2.raw
tcagctcgcgtgtccacgaccggtgctcgatttagagcgactagcaacacacaaagggggcaggagtcagtctcagtcaggacacagcatggacatgagggtcccgctcatctcctggggctcctgctactctggctccgaggtggcagatgtgacatccagatgacccagtctccgcccctcctgtctgcatctgtaggagacagacgtcacatctacgttcggccggacaagtcagacgctagttcggacctaaccttaaactttaaagttggtaactacgaacgaccgaaacggaaaacccggaaacggggaaaccccgacccccctaaaacttccccgtaagtaaacttacctaaatttacgtacgacctacttacccgttaaggtttcgaaaccgttaaaacggggttccgggggtaaccctaagttaaccgtaaacgttaacgtttaccgtaaggggttcggggtacggggttacgggtaacgttacgggttacggggaactaaacggttacttttaccgaaccttaccgtaaccctaaaccctaacgttaacctaaaccgttacgttacccgtaggaaccgtaaggtttaaacgtttaaggggaaacggggttttaaactttaaggttaaccggttaaaccctttaaaacgtttttaaccgtttaaccgtttacggttaaacccgtaaggtaacccgttaaacgggttaacccggtttaaccccgggaaaccccgggttaccccccgttacggtttaacccggttaacccgggggtttttacccgggggggaaacccggggggttaaaacccgttaaacgggggttaacccggggtaaacccggttaaaaccggtaaacccgggttaaacggttcggggtttaccggtaacccgtttaaccgggtaaacccccg

SEQ ID NO: 414546 - DNA, 573 bp, Homo sapiens
  misc_feature: GZ8MTXP01BONFK.8.49.E05.1.454.CMB.2.raw
  modified_base (224)..(224): a, c, t, g, unknown or other
  modified_base (272)..(272): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggnaagtcagagcattggcactactaatgtatcagcagaaaccaggaaacncccccaaatcctagatcaattatgcatcagtttgactaaagtcgggtaccccatcaagtatcaagtgcggtgatcgtgggacagatttcactctcacatcaacagtctgcagattgagtattatgactaaactttattacgtgtctaagcgtaagtacgtttacccgacggtcccccgtcttaccgttacggtttaccgggggaccgggggtaaacccgtaaagggttccgggttaaacgttaacccggtaaaacggtaaccgttgggtacgggtaccgttggaacccttaacgttaaccg

SEQ ID NO: 414547 - DNA, 559 bp, Homo sapiens
  misc_feature: GZ8MTXP01EFCFG.8.49.E05.1.454.CMB.2.raw
  modified_base (199)..(199): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgccctcctgtctgcatctgtagganacagatcaccatcacttgccgggcaagtcagagcattggcactataaatggtatcagcagaaaccagggaacacccccaaatcctagatcaattatgacatccagtttcgacgtaaagtcggggtaccccccatacaagtattcgaaagttgggcggttaggactcgtagggacagtactttcactctacacatacaatagtctgacagattgagtattagtacgtactaactttatactgtctagactaggtacgttcccgacggtaaccccgcttaccgttaccggtttccggggacgggggaacctaaaggttcgggacgttacgaaacgtaagtcgtaggcttacgccaacgtaac

SEQ ID NO: 414548 - DNA, 681 bp, Homo sapiens
  misc_feature: GZ8MTXP01CS20C.8.49.E05.1.454.CMB.2.raw
  modified_base (203)..(203): a, c, t, g, unknown or other
  modified_base (349)..(349): a, c, t, g, unknown or other
tcagctcgcgtgtccacgaccggtgctcgatttagagcgactagcaacacacaaagggggcaggagtcagtctcagtcaggacacagcatggacatgacgggtccccgctcagctcctggggctcctgctactctggctccgaggtggcagatgtgacatccagatgaccagtctccgccctccctgtctgcatctgtagganacagatcacatcacgtcggccggacaagtcagagctattcggacaccttaattaaagtggtaatacgagacgaaacgaaaccgacgggaaacccgacccccaaactcctagtaactactaaatttatcgactactacctaggttanacgtaaacggtcgggacctagtacgaaagtaacgttcgaaggtgggtacgggtaggtacgtcgggacgggtaactagttactttacaccttacctacctaacctaactaacaaacctagtaccgtacgtacgtaagtagttaggtaagggttactttaagtacgtaacttaaactttacttacgttacggtactacgactaacggtaccgttacccggaaccggtaaccccgttcgtaccgttacgggttaccgggggaaccgggggttaaccgttaaggttaccgggtaacgtaaccgtaaacgtacgtaggacgtaacgttcggtaaccc

SEQ ID NO: 414549 - DNA, 602 bp, Homo sapiens
  misc_feature: GZ8MTXP01ADAQY.8.49.E05.1.454.CMB.2.raw
  modified_base (224)..(224): a, c, t, g, unknown or other
  modified_base (451)..(451): a, c, t, g, unknown or other
  modified_base (527)..(527): a, c, t, g, unknown or other
  modified_base (596)..(596): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctcccgccctcctgtctgcatctgtaggagacagatcaccatcacttgccgggnaaggtcagagcattggacacctactaaattggtatcagcaagaaaccagggaaacgacccccaaactccctagaatacaaatttatgacaacttccgtaggttttcgacgtaaaggttcgggggtaccccccaagttacaaaggtatttaccggaaaggttcggggcgggttaggtaacgtcgttagggggaacctaggtacttttaccactctaccaaccatcaanacgtctgcagattagagtaattagtagactaacttattactgtcagtacagtacgttacccgaccggtaccccgtntcccgttacggttcggggaccgggggtaaccaagggttcgacgttacgaaacgagttcgagcgttcgcncgtaac

SEQ ID NO: 414550 - DNA, 694 bp, Homo sapiens
  misc_feature: GZ8MTXP01BT41F.8.49.E05.1.454.CMB.2.raw
  modified_base (203)..(203): a, c, t, g, unknown or other
  modified_base (228)..(228): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtctccgccctccctgtctgcatctgtagganacagagtcacatcacttggccgganaagtcagagctagttcggacaccttaacttaaattggtaatcgagacgaaacgaaaccgaagggtaaaccgaccccctaaatccctagaactactaatttagcgactacttacctaaggtttgaaccgtaaacggttcggggtaccagtaccaaagtaactttcgaaggggtcgggacgggttaggtactcggtacggggaaactagtactttcacttcctacaacctatactaaaccgtgtacgtagacaagtaagttaggaaggttaatttacgtacgtaacttaaacctttagttaacgtgttaacgacgtacgtaagtaccgtttacccgaaccggtaccccgttcgttacccggttaaccgggtttccgggggaaccgggggttaacccgttaaagggttaccgggtaaaccggttaacgaaaccgggttaacgtcggttacgtccgttaacggtaacccg

SEQ ID NO: 414551 - DNA, 696 bp, Homo sapiens
  misc_feature: GZ8MTXP01BD52W.8.49.E05.1.454.CMB.2.raw
  modified_base (229)..(229): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtcctccgccctcctgtctgcatctgtaggagacagagtcaccatcacttggccgggnaagtcagagcagttggcaaccgtacttaaattggtatcagacaagaaaccgaagggaaaccacccccaaatccctagaatactaaatttagtagactataccgtagtttacgacgtaaacggtcggggtaccaagtaccaaagtaacttacgaagggtcgggtacgggtaggtacgttacggtaggggaactaggtactttacaccttacctactaaccctattaaccaaacgttacgttaccgtagtacgtaagtaacgttaggtaacggggttaatttacggtacgtaaccttaaacgttttaactttaccgttagtacgtacgtacgtaacggtaccgttacccgaaccggtaccccgttacgttaccgttaccgggtttaccggggaccgggggttaacccgttaagggttaccgggtaacgaccggtaaacgtaaccgtgggttaccgcgttcggtaacccg

SEQ ID NO: 414552 - DNA, 645 bp, Homo sapiens
  misc_feature: GZ8MTXP01ET67V.8.49.E05.1.454.CMB.2.raw
  modified_base (528)..(528): a, c, t, g, unknown or other
tcagctcgcgtgtccacgaccggtgctcgatttagagcgactagcaacacacaaaggggggcaggagtcagtctcagtcaggacacagcatggacatggacgggtccccgctcagctccgtggggctcctgctactctggctccgaggtggcagatgtgacatccagatgacccagtcctccgccctccctgtctgcatctgtaggagacagatcacatcacgttggccgggacaagtcagagcagttcggacaacctaattaaattggtaactcaagacaaacggaaaacccgaaaggggaaacccacccccctaaaacgtcctaagaactactaaatttatacgactaacttaccgtaaggtttacgaacgtaaaacgggtccggggtaaccaatacgaaagtaacttacgaagggtgggacgggtaggtactcggtagggactagttacttaccacttctacaacctagtacaaactgtctacgatagtagtagtaggtatatactactaacttattactagtanacgtactacgtacgtaccgtaaccgtacccgttaccgtacgttacggtaccgggtacggggaacggaacggttacggtaacgtaacgtaacgtacgtacgttacgtcgttcgtaacg

SEQ ID NO: 414553 - DNA, 854 bp, Homo sapiens
  misc_feature: GZ8MTXP01B2GZF.8.49.E05.1.454.CMB.2.raw
  modified_base (226)..(226): a, c, t, g, unknown or other
  modified_base (235)..(235): a, c, t, g, unknown or other
tcagctcgcgtgtccacgaccggtgctcgatttagagcgactagcaacacacaaagggggagtcagtctcagtcaggacacagcatggacatggacgggtccccgctcagctcctggggctcctgctactctggctccgaggtggcagatgtgacatccagatcgacccagtcctccgccctcctgtctgcatctgtaggagacagagtcacatcacttgccgganaagtcagancatgcacctataaatgtatcagacagaaaccaagggaacacccccaaactcctagaactactaaattatacgactaattaccgtaggtttacgaacgtaaaagggttccgggggtaacccccctaaacgttaacgtaaaggtacttttaccggaaaaggggttccggggtaacgggggttgggtaaacgttaccgggttacggggggaaacctaagggttaacttttttacccaacccgtttacctaacccgaaccctaactttacccaaaaccgtacggtttccgttagggacctaaggttaagtttacggggtaaagggttaaccttttaaacggggtaggttaaacccgttaaaaccttttaagtttaaccgttggtaaacgttacggggaaacctaacggtaacccggtttaccccggaaaccggggtaccccccgttaacggtttaaccccggttaccggggttttaaacccggggggggacccggggggttaaaacccccgtaaaagggggtttacccggggaaaacccgggttaaacccggtaaaaacggggttaaaccccggttggggttacccgggacgtttacgggaaccccttaaccggtttaacccg

SEQ ID NO: 414554 - DNA, 611 bp, Homo sapiens
  misc_feature: GZ8MTXP01EREHM.8.49.E05.1.454.CMB.2.raw
  modified_base (280)..(280): a, c, t, g, unknown or other
  modified_base (498)..(498): a, c, t, g, unknown or other
tcagctcgcgtgtccacgaccggtgctcgatttagagcgactagcaacacacaaaggggggagtcagtctcagtcaggacacagcatggacatgagggtccccgctcagctcctggggctcctgctactctggctccgaggtggcagatgtgacatccagatgacccagtcctcccgccctccctgtctgcatctggtaggagacagagtcaccatcacttgccgggcaagtcagagcattggcactactaaatggtatcagcaagaaaccagggaaacncccccaaactcctagatacaaattatgcatcctagtttgactaaaggtcggggtacccccatacaaagtattcgaaggttcgggcgggtaggatcgaggggactagtatttcacttctacaaccatcaaactagtctagactagagttgaaggtatttagacgtactaaactttattaactggtacagacgtagtacgttacccgaccgggtaccccncgttacccgttacggtttccgggggaccgggggtaaacctaaagggttccgggaccgttaaccgaaaacggtaccgttcggtacggacgttacggaacccgttaaccttaacg

SEQ ID NO: 414555 - DNA, 513 bp, Homo sapiens
  misc_feature: GZ8MTXP01EMMDJ.8.49.E05.1.454.CMB.2.raw
  modified_base (273)..(273): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctcctgtctgcatctgtaggagacagagtcaccatcacttgccgggcaagtcagagcattgcactactaaatgtatcagcaagaaaccagggaaacncccccaaactcctagatcaattatgcatcctagtttgacaaaggtcggggtacccccatacaagtattcgaaggtggcggtgagtcgtgggacagtatttcactctcacatacaacagtctgcagatgagtattatgtactaacttattactgtcagactagtacgttccacggcccgctcgttacgttcggggcggggaccaaaggttcggacgttacaacgatgtggcttgcaacgtc

SEQ ID NO: 414556 - DNA, 672 bp, Homo sapiens
  misc_feature: GZ8MTXP01CE0H8.8.49.E05.1.454.CMB.2.raw
  modified_base (275)..(275): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcactactaaatggtatcagcagaaaccagggaaacncccccaaactcctagatttaattatgcactcctaggttttgacgtaaaggtcggggtaccccagtaccaaagtatttaccgaggttcggggaccgggttgggtagttccggtaggggtaacctagggttaacttttccaaccttccttaccaaccctatacctaaacctagttccgtaggactaaggtaagtttaggaagggttaatttagtacggggtaacttaaactttacttaccgttagttaccgagtccgtaacggtacgttcccgaacgggtacccctcgttaaccgtcgggtttaccgggggaccgggggttaaacgtaaacggggtcgggttaaccgaccgaaacggtaaccgttggtcggtccgtaggcctaacccttgtttaacccg

SEQ ID NO: 414557 - DNA, 638 bp, Homo sapiens
  misc_feature: GZ8MTXP01CBIWK.8.49.E05.1.454.CMB.2.raw
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgccctccctgtctgcatctgtaggagacagagtcaccatcacttgccgggacaagtcagagcattggctacctataaatgtatcagacaagaaaccgaagggaaaccgacccccaaactcctagactactaaattatcgactatcctagtttagacgtaaaggtcggggtaccccccaagtacgaaagtacgttcgtaaagggtcgggtcgggtaggtaagtcccgttaggggaactacggtatttacctacttcctacaccctaatacctaatacgtctgtacagtatagtagtattagtagtacttaaacttagttactgtcagacctagtacgtacccgaccggtaccccgtcgtccgttaccgggtttaccggggaccgggggtaaccgtaaacgggttccggttaacggttaacgtaaacgggtaacgtgggtcggacgttacgaaccttaacgtaacg

SEQ ID NO: 414558 - DNA, 643 bp, Homo sapiens
  misc_feature: GZ8MTXP01BYKND.8.49.E05.1.454.CMB.2.raw
  modified_base (199)..(199): a, c, t, g, unknown or other
  modified_base (225)..(225): a, c, t, g, unknown or other
  modified_base (259)..(259): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgccctcctgtctgcatctgtagganacagagtcaccatcacttggccgggnaagtcagagcattggcacctactaattgtatcancaagaaaccgaggaacgcccccaaatcctgatacaattatgctatcctagtttcgacgtaaaggtcggggtacccccatacaagtattcgaaggtcgggcggtggacttcgaggggacaggtatttcaccttctacaacctataccaaacagttccagacagtagttaggaaggtatttaggtacgtaccttaaactttaacttacgtggttaccagtaccgtacggtaccggttacccgaccggggtacccccgtcgttaccgttacccggggttttcccgggggaaccggggggtaaacccgtaaaaggggttccgggttaaccgttaaccgaaaaccggtaacggtcggtaacggggcttacgggtaaccaacccgttaag

SEQ ID NO: 414559 - DNA, 648 bp, Homo sapiens
  misc_feature: GZ8MTXP01EMZ4Q.8.49.E05.1.454.CMB.2.raw
  modified_base (199)..(199): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgccctcctgtctgcatctgtagganacagagtcacatcacgttggccgggcaagtcagagctagttcggactaacccttaataaattggtactcgaagacaaacgaaaacccgaagggaaacccgaccccctaaactccgtagtactactaaatttatcgactatacctaggtttacgacgtaaacggtcgggtaccccctaatacgaagtactcgaaagggttgggcgggtagtagtccgtaggggactacgtacttaccacttcacaccatacaactacgtctagacagtataggaagtattagtacgtaacttaacttattacgtgtacagtacgacgtacgttaccgaccggtaccctcttaccggttacgggttccggggaccgggggtaaacgtaacggttacggttaaccgttaaacggtaaaccgtacgttaacgggtcgacgttacgtaaccgttaacgttaacg

SEQ ID NO: 414560 - DNA, 589 bp, Homo sapiens
  misc_feature: GZ8MTXP01B9P6U.8.49.E05.1.454.CMB.2.raw
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtcctccgccctccctgtctgcatctgtaggagacagagtcaccatcacttgccgggcaagtcagagcattgcacctattaattggtatcagacaagaaaccgagggaaaccacccccaaatccctagatcaattatgcatcctagtttgactaaacggtcgggtaccaagtacaaagtactttacgaagggttgggaccgggttaggacgtcgtagggggaactagtactttacaccttctacaccctataccgaaactgttccagacgagtagtagtaggtattatactactacttattatagtactacgtacgtacgtacgtccgtaaccgtacccgttccgtccgttacggtacgggtacggggacggttacggttacggtaacgtacgtaacgtacgtacgttcgtcgcgtcg

SEQ ID NO: 414561 - DNA, 569 bp, Homo sapiens
  misc_feature: GZ8MTXP01A0PPH.8.49.E05.1.454.CMB.2.raw
  modified_base (198)..(198): a, c, t, g, unknown or other
  modified_base (223)..(223): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctcctgtctgcatctgtagganacagagtcaccatcacttgccgggnaagtcagagcattggcacctactaaatggtatcagcagaaaccagggaaacacccccaaactcctagatacaattatgcactcctagtttcgacaaaggtcggggtacccccagtacaagattacgaaggtgggcggtggagtcgtaggggactaggtatttcacttctacacctataccaatagtctgacagtattaggagtattaggtgtactaaacttattacctgtcgagtacagtacgttaccaccggtaccccgtctaccgttaccggtttccggggacgggggtaaaccaagggttcggaccgttacgaaacggagtcggtcggcttcggcaacgtaac

SEQ ID NO: 414562 - DNA, 692 bp, Homo sapiens
  misc_feature: GZ8MTXP01A2EXY.8.49.E05.1.454.CMB.2.raw
  modified_base (226)..(226): a, c, t, g, unknown or other
  modified_base (257)..(257): a, c, t, g, unknown or other
  modified_base (301)..(301): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtctccgccctcctgtctgcatctgtaggagacagagtcaccatcacttgccggnaagtcagagcattggcactattaattgtatnagcaagaaccgaggaaaccgcccccaaatcctagatacaattancgactactccgtagtttacgacgtaaacggttcggggtaccaagtacgtaaacggtaatttaccggaaggttcggggtacgggtagggtacgttcgggttagggggaaactacggttacttttaccgaacctttccgtaccctaaaccctaacgttacccaaacgtacgttccgtaggaccgtaagtacgtttaggaacggggttaaatttacgtacgtaacctttaaactttaagttaccgttagttacgaacgtcgtaaggtaccgttacccgaaccgggtaaccccgttcgttaccgttaccggtttacgggggacggggttaaacccgttaagggttaccggtaaccgtacgaaacggtaaccgtggttacggtaacgttcgaaccg

SEQ ID NO: 414563 - DNA, 790 bp, Homo sapiens
  misc_feature: GZ8MTXP01CP4VK.8.49.E05.1.454.CMB.2.raw
  modified_base (247)..(247): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatcgacccagtcctcccgccctccctgtctgcatctgtaggagacagacgtcaaccatctacgttcggccgggacaagtcaganctagttcggacctaaccttaattaaagttggtatacagacaaacggaaaccgaacgggaaacccaccccctaaatccgtagtaactactaaatttacgtacgacctacgttaccgtaaggtttacgaacgtaaaaccgggggttccggggtaaccctaagttaaccgtaaacgttaagttaccggaagggtcgggtaccggggttagggtaacgtcgggtaacggggtactaaggtttactttaccgaacctttaccaaccctaaccgtaacttaaccgtaaacgtacgttctaacggtacgtaagttagttaaggtaggggttaaactttagtaccggtaacctttaaatttaccgttacggttacgtaacgtaacgtacgtaacgggttacccgttccccgggaacccgtacccccggttgtttacccgggttacgggtttacccggggggaaccgggggttaaacccgttacgggttaccggggtaaaccgttaacggaaaccggttacggtcgggttacggtaacgttaaccgaacccg

SEQ ID NO: 414564 - DNA, 562 bp, Homo sapiens
  misc_feature: GZ8MTXP01CX93Y.8.49.E05.1.454.CMB.2.raw
  modified_base (226)..(226): a, c, t, g, unknown or other
  modified_base (256)..(256): a, c, t, g, unknown or other
  modified_base (271)..(271): a, c, t, g, unknown or other
  modified_base (414)..(414): a, c, t, g, unknown or other
tcagctcgcgtgtccacgaccggtgctcgatttagagcgactagcaacacacaaagggggcaggagtcagtctcagtcaggacacagcatggacatgagggtcccgctcagctcctggggctcctgctactctggctccgaggtggcagatgtgacatccagatgacccagtctccgccctccctgtctgcatctgtaggagacagagtcacatcacttgccgggnaagtcagagcatgcactataaatgtatcancaagaacaggaaacnccccaaatcctagatacaattatgctatcctagtttgacgtaaacggtcgggaccatacaagtaattcgaagtggcggtgatcgtgggacagtatttcactctacacctatacaactagtctgacagtattagaggtatagtnactaacttatactgtacagtcagtacgttccgaaccggccccgttcgttaccgaccggttttacgggggacccgggggttaaacccgttaaagggttcggaaacgttaaccgaaacgtaccgtaggttacgggcttaacggtaacccg

SEQ ID NO: 414565 - DNA, 624 bp, Homo sapiens
  misc_feature: GZ8MTXP01BQK1M.8.49.E05.1.454.CMB.2.raw
  modified_base (263)..(263): a, c, t, g, unknown or other
  modified_base (280)..(280): a, c, t, g, unknown or other
  modified_base (302)..(302): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtcctccgccctccctgtctgcatctgtaggagacagagtcaccatcacttggccggcaagtcagagcattggcacctattaagtgtatcancaagaaccgaggaaacncccccaatccagatactattangctatcctagttgacgtaaaggtcgggtaccagtacaaagtacttacgaaggtgggtacgggtggtactcgtaggggactagtactttacacttctaccaccattaccaactagtcctgactagtagttagaggggtattatacgtacttaactttattacgtagtacgtagtacgtaagtaccgttcccgaaccgggtacccccgttcgttaacccgggttacggtttacccggggggaaccgggggttaacccgttaaacgggttacgggaaacccgttacgaaaaccgttacggtgggttaccggtcgttcgtaacccg

SEQ ID NO: 414566 - DNA, 656 bp, Homo sapiens
  misc_feature: GZ8MTXP01BQ9LY.8.49.E05.1.454.CMB.2.raw
  modified_base (227)..(227): a, c, t, g, unknown or other
  modified_base (283)..(283): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgccctcctgtctgcatctgtaggagacagagtcaccatcacttggcccggganaagtcagagcattggacacttacttaaatggtatcagcaagaaaccgaggaaaccncccccaaatcctagatacaaattatgacctatccgtagtttcgactaaacggtcgggtaccccccatacgaagtcttacgaaagggtcgggcgggtggtacgtcgtaggggactaggtatttcacttcaccacatacaacgtacgtctagacagtattagaagttacttagtcggtaacttaaactttatttacgtacgttacgacgtaacgtacggtaccgtttacccgaaccggtccccgtaacgttaaccggttaccgggtttaccgggggaccgggggtaaacctaaacggggttacggttaaccggttaacccggtaaaacggttaccggtaaggtccgggtacgttacggaaccgttaacctttccg

SEQ ID NO: 414567 - DNA, 661 bp, Homo sapiens
  misc_feature: GZ8MTXP01AS45N.8.49.E05.1.454.CMB.2.raw
  modified_base (200)..(200): a, c, t, g, unknown or other
  modified_base (225)..(225): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgccctccctgtctgcatctgtagganacagagtcaccatcacttgccgggnaagtcagagcattggcactataaattggtatcagcaagaaaccgaggaaacgcccccaaatcctagatcaaattatgactatccagtttacgactaaaggtcggggtacccccccaatacgaaagtactttcgaacgggttagggccgtaagtggggaacttccgttaggggaactaggttacttttaccacttacctacaacctaattacaaaccgtagtcctagactaagtagttacgtaaggtattaagtacggtacttaaaccgttttattaacgtcggttaccagtactaacgggtaactttacccgacgggtaaccccgtcgtttacggtaccggtttaccgggggaccgggggtaaaccttaaacgggttccgggttaaaccgtaacgaaaacggttcttacgggtcgacgttaacggttcctaacccg

SEQ ID NO: 414568 - DNA, 750 bp, Homo sapiens
  misc_feature: GZ8MTXP01BTEE3.8.49.E05.1.454.CMB.2.raw
  modified_base (353)..(353): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgcccctccctgtctgcatcgtagtaggagacagacgtccaacctatcctacgttcgggcccgggactaagtcagagactaggttcgaacccttaacttaaagttaagtcgtactacgacgaacgaaaccgaaaccgggaaacggaacccccaaacccctaactcgatacctaataattncactactcgttagtacgaacggtaacggggtccgacctatacgtaagtctacggtaaggggtcgggtcggggtagtacgttcggggtaacggtacttaggtttacttacccctaccttacctaaccctaaacctacgttaaaccaaacggttcgttaccgtacgtaacgtaaggttagttaagggtaaagttacgtttaaggtacgttaaacctttaaatttaccgtttataccgtaagtacgtacgtaacggttaccgtaccccgtaacccgggtccctaacggttaccggttacggggttacccgggggaacgggtaaaccggtaacgggttaccggttaacgttaaccggtaaaacggtcggttggaccggtcggactaacccgttaacttccg

SEQ ID NO: 414569 - DNA, 594 bp, Homo sapiens
  misc_feature: GZ8MTXP01D2029.8.49.E05.1.454.CMB.2.raw
  modified_base (198)..(198): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctcctgtctgcatctgtagganacagagtcaccatcacttgccgggcaagtcagagcattgcactactaatgtatcagcagaaaccagggaacgacccccaaactcctagactacaattatgactatcctagtttgactaaaggtcggggtaccccatacaagtattcgaagtggcgggtgatcgtagggacagtatttcactctcacatacaacagttctgacagtattagagtattagtagacttaacttacttactgtctagacgtagtacgttaccgacggtcccccgtcttaccgttaccggtttaccggggacgggggtaaaccccgtaaaggggttacggaaccgggttaaccgaaaaccgggtacgttaacgggttcgggaccgttagggaacccgttaaccgttaaccg

SEQ ID NO: 414570 - DNA, 710 bp, Homo sapiens
  misc_feature: GZ8MTXP01C7647.8.49.E05.1.454.CMB.2.raw
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgccctccctgtctgcatctgtaggagacagatcaccatcacttggccggacaagtcagagcagttcggactaaccttaataaagttggtaatcgaagacgaaacgaaaacccgaagggtaaacccacccccctaaaacttccctaagaaccttaactaaatttacgtcgtacctaacgtacccgttaaggtttacgaacggtaaacggtccggggtaacccccctaagtacgaaagtacttacggaaagggtcgggtcgggtaggaacgttacgggtagggtacctaagttactttacctaccttaccgttaccaaacctactaaccgaaacgtacggttacctagaccgtaagtagttagaaggttacttaaggtacgtaacttaaactttagttaccgtagacgtagtacgaacgttacgtacccgacccggtacccgtcgttacggttccggttaaccggggacgggggtaaaccgtaagggttaccggaacgttaacgaaaccgtacgtgtcggacgacgtaacgcttaacg

SEQ ID NO: 414571 - DNA, 676 bp, Homo sapiens
  misc_feature: GZ8MTXP01BXZ2X.8.49.E05.1.454.CMB.2.raw
  modified_base (201)..(201): a, c, t, g, unknown or other
  modified_base (235)..(235): a, c, t, g, unknown or other
  modified_base (315)..(315): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatcgacccagtcctcccgccctcctgtctgcatctgtagganacagagtcacatcacgtgccgggacaagtcaganctattcggactactataaagtgtatcagacaacgaaaccgagggaaaccaccccctaaactcctagactactaaattagngacctacttcctagtttacgaacgtaaacgggtccgggtaccccccagtacgaaagtacttacggtaaaggttcggggcgggtagtacgttcgggtacggggtaactacggttactttacccgaccttacctaccaacctacttaaccaaacgtacgttcgtacgacgtaagtagttaggaagttaattactagtaacctttaaattacgttacgtaggtacagtacgtacgtaccgttacccgaccggtacccgtaacgtaccgttacgggttccgggggaacggggtaaacctaagggttaccggaaccgttaacgaaacggtacgtggtacggacttacgtaacccttaacgtaaccg

SEQ ID NO: 414572 - DNA, 707 bp, Homo sapiens
  misc_feature: GZ8MTXP01ALT4K.8.49.E05.1.454.CMB.2.raw
  modified_base (204)..(204): a, c, t, g, unknown or other
  modified_base (338)..(338): a, c, t, g, unknown or other
tcagctcgcgtgtccacgaccggtgctcgatttagagcgactagcaacacacaaaggggggagtcagtctcagtcaggacacagcatggacatggagggtccccgctcagctccgtggggctcctgctactctggctccgaggtggcagatgtgacatccagatgacccagtcctcccgccctccctgtctgcatctgtagganacagactcaccatcacgttggcccgggacaagtcagagctagttcggacctaaccttaacttaaagttggtactacgagacaaacgaaacccgaacgggaaaccacccccctaaactcctagactacaatttangactactaccgtagtttagacgtaaaggtcgggtaccccatactaagtacttacgaagggttcgggcgggttagggtacgttacggtacggggtaactacggttactttccacttaccgtaaccaacctacttaaccaaacgtacgtactgacgaagttagttaggaaggttaattaacggttacgtaacctttaaactttaacgttactagttacaacggtacgtaacgtaccggttacccgaccgggtccccgtcgttaccggttacgggtttaccgggggaccgggggtaaaccgtaacgggacgggttacgttaaccggtaaacggtaccgtggttacgcggttacgtaaccgttaacgtaaccg

SEQ ID NO: 414573 - DNA, 582 bp, Homo sapiens
  misc_feature: GZ8MTXP01AR2V1.8.49.E05.1.454.CMB.2.raw
  modified_base (223)..(223): a, c, t, g, unknown or other
  modified_base (232)..(232): a, c, t, g, unknown or other
  modified_base (297)..(297): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccggnaagtcagancattggctactactaaatggtatcagcagaaaccagggaacgcccccaaatcctagatcaattangcatccagtttgactaaagtcggggtacccccatacaagtattcgaagtgggcggtggatcgtagggacagtatttcacttctaccactaactacaactagtcctgacagtattggaagtattagtgactaaactttattacctgtaccagtactaagtaccgttaccgaccggtaccccggcttaccgttacggtttccggggaccgggggtaaacctaacgggttacggaccgttacgtaaaacgtacgttcgggtcggcgttacggccttaacccgttaacg

SEQ ID NO: 414574 - DNA, 568 bp, Homo sapiens
  misc_feature: GZ8MTXP01C7Q18.8.49.E05.1.454.CMB.2.raw
  modified_base (234)..(234): a, c, t, g, unknown or other
  modified_base (300)..(301): a, c, t, g, unknown or other
tcagctcgcgtgtccacgaccggtgctcgatttagagcgactagcaacacacaaagggggagtcagtctcagtcaggacacagcatggacatggagggtcccccgctcagctcctggggctcctgctactctggctccgaggtgcagatgtgacatccagatgacccagtctccgccctccctgtctgcatctgtaggagacagagtcaccatcacttgccgggcaagtcagancattggcacctataaatggatcagacagaaaccgagggaaccaccccaaatccagactacaaattnncaatccagtttacgacgaaaggttcggtacccccatacgaagtacttcgaaagtgggcggtagtaactcggtagggaactagtattaccactctacaacatacctaacaagtctgacgagtaagtgaagtattagtactaattaaacttattactgtcgagacagtacgtaccaccggcccgtaactcgttaccggttacgggacggggtaaccgtaacggttcgacgttaacaacggtaacgtggtacggcttacggccaacgtcg

SEQ ID NO: 414575 - DNA, 567 bp, Homo sapiens
  misc_feature: GZ8MTXP01BSXN4.8.49.E05.1.454.CMB.2.raw
  modified_base (201)..(201): a, c, t, g, unknown or other
  modified_base (226)..(226): a, c, t, g, unknown or other
  modified_base (454)..(454): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctcccgccctccctgtctgcatctgtagganacagatcaccatcacttggccgggnaagtcagagcattggactacctactaaatggtatcagcaagaaaccagggaaaccacccccaaactcctagactcaaattatgacatcctagtttgactaaaggtcggggtacccccatacaaagtacttcgaaggtggcgggtagtatcgtagggactagtacttcactctcactatacaacagtctgcagtatagagtattagtagtactaaactttattaccgtnacgtagacagtaccgttaccgaccggccccgtctaccgttacggtttccggggacggggtaaccgaaggttcggacgttacgaaacgtcgtgtcgcgttacgccgttaactcg

SEQ ID NO: 414576 - DNA, 583 bp, Homo sapiens
  misc_feature: GZ8MTXP01EGB03.8.49.E05.1.454.CMB.2.raw
  modified_base (272)..(272): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcatggcactataatgtatcagcagaacaggaaacnccccaaatcctagatacaatttatgcaatcctaagtttcgacaaaacggtcggggtaccaagtaccaaagtaattacgaaggttgggacgggtggatcgtaggggacagtactttcacttctacaccatacaaactagtctagacagtattggagggtattagtcgactaaattattacgtgtacagtctaagtacgttaccgaacgggtaccccttcgtcgttaaccggtttccgggggaccgggggaacgttaaacgggttcggaaaccgtacgaaaacggtaaccgtggttacgggcttcggtaaccc

SEQ ID NO: 414577 - DNA, 684 bp, Homo sapiens
  misc_feature: GZ8MTXP01CBNGC.8.49.E05.1.454.CMB.2.raw
  modified_base (172)..(172): a, c, t, g, unknown or other
  modified_base (256)..(256): a, c, t, g, unknown or other
  modified_base (272)..(272): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtccnccgccctccctgtctgcatctgtaggagacagagtcaccatcacttggccgggacaagtcagagcattgcactataatgatcancaagaaaccaggaacncccccaaatcctagatacaattatgctaatcctagtttcgaacgtaaacggtcggggtacccccctagtactaaagtacttccgaaaagggttcgggtcgggtagggtaacttcgggtaggggaactaggtactttacgacttctaccaactactacaaactacgtctgactaagatttagaagtatttagtacgtacttaaactttagttaacgtcgtacgtaacgtaccgtaagtaaccggtttacccgaacccgggggtaccccctaaccgtttaccggttaccgggttttaaccccggggggacgggggttaaaaccccgtaaagggttccgggttaaccgttaaacgtaaaacccgggtaacgttcgggttacgggaccggttagttaaccccgaaccgtttaaccg

SEQ ID NO: 414578 - DNA, 700 bp, Homo sapiens
  misc_feature: GZ8MTXP01AHZ0D.8.49.E05.1.454.CMB.2.raw
  modified_base (531)..(531): a, c, t, g, unknown or other
  modified_base (541)..(541): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctcccgccctccctgtctgcatctaggtaggagacagacgtaccaccatctacgttcggacccgggacaagtcgaagacgtactaggttaccgaccttaaaccttaaattaagttaggtactacgagaacgaaaccggaaaccggaaacggtaacccccaaacccctaacctcgatactaactaattgcactctacgttagtacgaacgtacgggtccgtaacccagaactagtatacggagggtacgggtcggtagtacgttgggacgtacgtaattctaccgaccttacaccaacttacaaccgacgttacgtctagaacgtagttagagggtaacttatacggggtactaaaccgtttnttaacggttnacgtacgtacgaaccgtgggttaccccacccgtaaccccggtcttaacccgtacggttacccgggggttacgggggaaacccgggtaaataagggttcgggttaaccccttaaaggaaacccgttggtcgggtaaccgtcacccgtccaacgttttccg

SEQ ID NO: 414579 - DNA, 611 bp, Homo sapiens
  misc_feature: GZ8MTXP01ACYL7.8.49.E05.1.454.CMB.2.raw
  modified_base (228)..(228): a, c, t, g, unknown or other
  modified_base (236)..(236): a, c, t, g, unknown or other
  modified_base (271)..(271): a, c, t, g, unknown or other
  modified_base (280)..(280): a, c, t, g, unknown or other
  modified_base (288)..(288): a, c, t, g, unknown or other
  modified_base (330)..(330): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtcctccgccctccctgtctgcatctgtaggagacagagtcaccatcacttgccggnaagtcagngcatgcactataatgatcagcagaaccaggaaacnccccaatcngatcaatngcatctagttgacgtaacggtcgggaccatacaagtattcgnggtgggcggtgatcgtagggactagtactttcactctacacctataccaactcgtctagacgaagtagtttagaaggggttatttacgtacggtaaccttaaacgtttacttacgttacgttaccgagtaccgtaacggttaccgttacccgaacccgggtacccccgttacgttcccgttaaaccgggtttccgggggaaccgggggttaaacccgttaaaggttaccgggaaccgttaacggaaaacggtaccgtgggttacggtccttcggtaacccg

SEQ ID NO: 414580 - DNA, 846 bp, Homo sapiens
  misc_feature: GZ8MTXP01CIUY7.8.49.E05.1.454.CMB.2.raw
  modified_base (230)..(230): a, c, t, g, unknown or other
  modified_base (324)..(324): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctcccgccctccctgtctgcatctgtaggagacagacgtcaccatcacttcggccggganaagtcagagcattcggactaccttaacttaaagttggtatacagacaaacggaaaccgacggaaaccacccccaaatcctagactactaattancgactactcgttagtttacgaacgtaaacggttcgggtaccccctaagtacgtaaagtacgttacggtaaagggttcgggtcgggttaggtaacgttaccgggtacggggtaacctaacgggtttactttacccgtacccgttcccttaacccgaaaccgtaccttaacctaaaccgttacgttaccgttacggtaccgttaaaggttaacgtttaacgggtaaacggtttagtttaaaccgggttacgggtttaaaacccttttaaaccgtttaaacgtttaaccgttacgggtttaacccgaacggttaccgtaaacggttaccccggttaacccgggtaaaccccgggttacccccgttcccgggttaaccgggtttaacccgggggtttacccggggggaaaccccgggggttaaaacgtaaaccgggggttaccgggttaaaccgttaacccgggtaaaaccggtttacggttccgggtaacggttcccgaccgggtaacccttcccgtttaaccgg

SEQ ID NO: 414581 - DNA, 716 bp, Homo sapiens
  misc_feature: GZ8MTXP01AD0SM.8.49.E05.1.454.CMB.2.raw
  modified_base (202)..(202): a, c, t, g, unknown or other
  modified_base (226)..(226): a, c, t, g, unknown or other
  modified_base (287)..(287): a, c, t, g, unknown or other
  modified_base (311)..(311): a, c, t, g, unknown or other
tcagctcgcgtgtccacgaccggtgctcgatttagagcgactagcaacacacaaaggggggagtcagtctcagtcaggacacagcatggacatggagggtccccgctcagctcctggggctcctgctactctggctccgaggtggcagatgtgacatccagatgacccagtctccgccctccctgtctgcatctagtagganacagatcacatcacttgccggganaagtcagagcattggactactaattaatggtatcagacaaacgaaaccgaacgggaaaccncccccaaatccagactacaattancgactactacctaggtttacgacgtaaagggtcgggtaacccccatacgaaagtacgttcgaaagggttcgggtcgggttaggacgttcgggtaacggggactaggttactttacccacttcctaaccaaccgtaactaccgaaacctggtaccgtagaccgtaagttaagtttaggaagtttaagttaacggggttacgtaaacctttaaacgtttacttaaacccggttagtaacgacgtacgtaaccggttaccgtaacccggtacccggtaccccgtcgttacccgggttaccggggtaccgggggaaacccggggtaaacgtaacgggttaccgggttaaaccgttaaaccggtaacggtcgtaacgggtcggtacttaccggtaaccttaaccgtaacg

SEQ ID NO: 414582 - DNA, 676 bp, Homo sapiens
  misc_feature: GZ8MTXP01E17DV.8.49.E05.1.454.CMB.2.raw
  modified_base (201)..(201): a, c, t, g, unknown or other
  modified_base (227)..(227): a, c, t, g, unknown or other
  modified_base (235)..(235): a, c, t, g, unknown or other
  modified_base (254)..(254): a, c, t, g, unknown or other
  modified_base (275)..(275): a, c, t, g, unknown or other
tcagctcgcgtgtccacgaccggtgctcgatttagagcgactagcaacacacaaaggggggagtcagtctcagtcaggacacagcatggacatgagggtccccgctcagctcctggggctcctgctactctggctccgaggtggcagatgtgacatccagatgacccagtcctcccgccctcctgtctgcatctgtagganacagatcaccatcacttggccggganaagtcagngcattgcactataatgatnagacaacgaaacgagggaacncccccaaactctagatactaattatcgactacttcctagtttacgaacgtaaaggtcgggtacccccagtacgtaaagtatttcggaaagggttcgggcgggtagtagtcgtaggggtaactacggtactttacaccttcctaccaacctacttaaccaaacgtacgttccgtacgggactaaggttattacggtaaggtaactttaggtacgttaaccttaaattttaacgttactcggttacacggtacgttaacggtaccgttaccggaacccggtaccccgtctaccgggttaccggggtttccgggggaaccgggggtaaaccgtaaaggggttccgggttaaccgttaacgaaaccgggtattcgggtacgggcttacggaaccttaaccgttcg

SEQ ID NO: 414583 - DNA, 668 bp, Homo sapiens
  misc_feature: GZ8MTXP01B8RXG.8.49.E05.1.454.CMB.2.raw
  modified_base (237)..(237): a, c, t, g, unknown or other
  modified_base (352)..(352): a, c, t, g, unknown or other
  modified_base (411)..(411): a, c, t, g, unknown or other
tcagctcgcgtgtccacgaccggtgctcgatttagagcgactagcaacacacaaagggggcaggagtcagtctcagtcaggacacagcatggacatgacgggtccccgctcagctccgtggggctcctgctactctggctccgaggtggcagatgtgacatccagatcgacccagtcctcccgccctcctgtctgcatctgtagagacagagtccaccatcgacgttcggccggganaagtcagacgtcgtaattcggacctaaccttaacttaaagttggtatcgaaggacaaacggaaaacccgaaacgggaaacccgaacccccctaaatcctagtaactactaaattnacgtactacttacgtagtttacgacgtaaacggtccgggtaccagtacgagtaattcgngggtgggtacggtggatcggagggactagtacttcacttccactaccataaccgaactgtcgtagcgtagttagttagggtaaggggttacttacgtacttacttaacgtttcgtacgtcgacgcgtagtccgtaccggacccggtaaccccgcttaacccgggtcgggttccgggggtaaccgggggtaccggttaacgggttcggttaccggtaacgaacggtaacgtacgggtcgttacgtaacgcccgtaacc

SEQ ID NO: 414584 - DNA, 566 bp, Homo sapiens
  misc_feature: GZ8MTXP01AXMUP.8.49.E05.1.454.CMB.2.raw
  modified_base (200)..(200): a, c, t, g, unknown or other
  modified_base (231)..(231): a, c, t, g, unknown or other
  modified_base (233)..(233): a, c, t, g, unknown or other
  modified_base (250)..(251): a, c, t, g, unknown or other
  modified_base (253)..(253): a, c, t, g, unknown or other
  modified_base (281)..(281): a, c, t, g, unknown or other
  modified_base (292)..(292): a, c, t, g, unknown or other
tcagctcgcgtgtccacgaccggtgctcgatttagagcgactagcaacacacaaaggggggagtcagtctcagtcaggacacagcatggacatgagggtccccgctcagctcctggggctcctgctactctggctccgaggtggcagatgtgacatccagatgacccagtcctcccgcctcctgtctgcatctgtagganacagagtcaccatcactgccggcaagtcagncntggacactataatgtannanacaacgaacgacgaaccaccctactcanactataatganactactacgtagttagacgtaacggtcggtacccatacgagtacgtggaaggtcggtcggtagacgtcggtacgtatctacttccactacgtactactactacgtaactacgtctacgtacgtagtagtagtagtatacgtacgtatacttattactcgtacgtacgtacgtacgtcgtaccgtaccgtccgtccgtacgttacggtacgggacgggaacggtaacggttacggacgttacgtaacgtacgtcgtcgtcgttcgtcgcgtaacg

SEQ ID NO: 414585 - DNA, 841 bp, Homo sapiens
  misc_feature: GZ8MTXP01BBSDB.8.49.E05.1.454.CMB.2.raw
tcagctcgcgtgtccacgaccggtgctcgatttagagcgactagcaacacacaaaggggggcaggagtcagtctcagtcaggacacagcatggacatggacgggtccccgctcagctccgtggggctcctgctactctggctccgaggtggcagatgtgacatccagatcgacccagtcctcccgccctccctgtctgcatctgtagagacagacgtcaccatcacgttgccggacaagtcagagcagttcggacctaaccttaacttaaagttggtaactcgaagaccaaaggaaaaccccgaagggaaacccgacccccctaaatcccgtagtaacttactaaatttactacgacctaacttacccgttaaggtttacgaaccgttaaaacgggttccggggtaaccctaagtaccgtaaaaggttaacgtttacggaacggggttacggggtaccgggttagggtaaccgttacgggttaacgggggaaacttaaacgggtttaacctttacctaaccgttaccctaacctaaaccccttaaagtaacccgtaaaccgttacggtacccttagaaccgtaaaggtaagttttaacgggaaggggtttaaactttaagtaaccggtaccgtttaaaacgttactttaccgttagttaaccgaagtaccgttaaacggtacccggtttaacccgaacccggtaacccccggttcgttaccggttacccgggtttaaccggggggaacccgggggttaaacccgttaagggttacccgggtaaacgttaacccggtaaaaacggtcccggttaggttaccgggtccgttaacggtaacccg

SEQ ID NO: 414586 - DNA, 692 bp, Homo sapiens
  misc_feature: GZ8MTXP01B8UH4.8.49.E05.1.454.CMB.2.raw
  modified_base (208)..(208): a, c, t, g, unknown or other
tcagctcgcgtgtccacgaccggtgctcgatttagagcgactagcaacacacaaagggggagtcagtctcagtcaggacacagcatggacatggacgggtccccgctcagctcctggggcctcctgctactctggctccgaggtggcagatgtgacatccagatcgacccagtcctcccgccctccctgtcctgctatctggtagganacagactccaaccatcacgtcggccgggacaagtcagagactagttcggacctaaccttaagtaagttgtatacgaagaccgaaacgaaacccggaacggaaacccaccccctaaacgtctagactactaattacgtacactactaccgtaggttacgaagtaaacgggttccggtaccccaagtacgtaaagtacgttacgaaggggttagaacggtagggttaggacgtttacggacggtaacggtaaattcttaccctactaccttaacacctaacgtactaaacgtgtacctagaagtagtagtagtaacgtattagtacgtaattacttagtctgtacacgtacgtcgtacgtacccgaccggtaaccccttggttccgttaaccggggttacgggggaacccgggttaacgaaacgggttcccgaaacgggtaacaaaccggtaaggtgggtaccttacgtaaccgttctaaccccgg

SEQ ID NO: 414587 - DNA, 658 bp, Homo sapiens
  misc_feature: GZ8MTXP01EV1IQ.8.49.E05.1.454.CMB.2.raw
  modified_base (202)..(202): a, c, t, g, unknown or other
  modified_base (324)..(324): a, c, t, g, unknown or other
tcagctcgcgtgtccacgaccggtgctcgatttagagcgactagcaacacacaaaggggggagtcagtctcagtcaggacacagcatggacatggagggtccccgctcagctccgtggggctcctgctactctggctccgaggtggcagatgtgacatccagatgacccagtcctccgccctcctgtctgcatctgtagganacagagtcaccatcacgttggccgggacaagtcagagcattcggacaacttaactaaattggtactcagacgaaacgaaaccgaacgggaaaccacccccaaactcctagactactaattancgactacttccgtagtttacgaacgtaaaggtcggggtaccccctaatacaaaggtacttcgaaagggtcgggtcgggtgatcggtagggactagtacttcactctacaactatacaactagtctagactaagtataggtaagttattaagtcgtaaaccttaactttaacgttaactgtacgtacgtacgtacggttaccgttacccgacccgggtacccctcggttaccgttaccggggtttacgggggaaccgggggtaaacctaacgggttacgggacgttaaccgtaaacggtacgtcggtcgacgttacggaaccgttaacgttaacg

SEQ ID NO: 414588 - DNA, 584 bp, Homo sapiens
  misc_feature: GZ8MTXP01BLIIX.8.49.E05.1.454.CMB.2.raw
  modified_base (229)..(229): a, c, t, g, unknown or other
  modified_base (282)..(282): a, c, t, g, unknown or other
  modified_base (305)..(305): a, c, t, g, unknown or other
  modified_base (396)..(396): a, c, t, g, unknown or other
tcagctcgcgtgtccacgaccggtgctcgatttagagcgactagcaacgacacaaagggggcaggagtcagtctcagtcaggacacagcatggacatgagggtccccgctcagctcctggggctcctgctactctggttccgaggtggcagatgtgacatccagatgacccagtctccgccctccctgtctgcatctgtaggagacagagtcaccatcacttgccgggnaagtcagagcattggcactacttaaatggtatcgagcagaaaccagggaaacncccccaaatcctagatcaattangcatccagtttcgacaaaggtcgggtaccatcaagattacagttggacggtggatcgtagggacagtacttcacgtctacaccatcaaacngtactgacagtattagaggtattaacgtcgtactaactttagttacgtacggttacaagggtacctaaggtacgttacccgaacgggtaaccccccgtgttacccgtaccgttcgggggaccgggggtaacaaacgggttcggaacgtaaccaaacggcgttacggcggttacctcggttaacgaacc

SEQ ID NO: 414589 - DNA, 591 bp, Homo sapiens
  misc_feature: GZ8MTXP01B74DO.8.49.E05.1.454.CMB.2.raw
  modified_base (199)..(199): a, c, t, g, unknown or other
  modified_base (233)..(234): a, c, t, g, unknown or other
  modified_base (255)..(255): a, c, t, g, unknown or other
  modified_base (299)..(299): a, c, t, g, unknown or other
tcagctcgcgtgtccacgaccggtgctcgatttagagcgactagcaacacacaaaggggggagtcagtctcagtcaggacacagcatggacatgagggtccccgctcagctcctggggctcctgctactctggctccgaggtggcagatgtgacatccagatgacccagtctccgccctcctgtctgcatctgtagganacagagtcaccatcacttgccgggcaagtcagannattggcactataatgtatcanacagaaaccgagggaacacccccaaatccctagatactaaattntgactatcctagtttacgacaaaggtcgggtacccccatacaaagtatcgaaggtcggcggtggatcggtagggacagtattcactctacacatacaacgagtctgacagtattagagtattagagtaccttaaagtttatacgtgtcgaagtactaaggtaccgttacccgaaccggtacccccgtcttacgttaccggtttaccgggggaccgggggtaaactaacgggttaccgggttaacgttaccgaaaacggtccgtgttacggcttacgtaaccttaaccgtaag

SEQ ID NO: 414590 - DNA, 489 bp, Homo sapiens
  misc_feature: GZ8MTXP02JGSG9.8.49.E05.1.454.CMB.2.raw
  modified_base (273)..(273): a, c, t, g, unknown or other
  modified_base (392)..(392): a, c, t, g, unknown or other
tcagctcgcgtgtccacgaccggtgctcgatttagagcgactagcaacacacaaaggggagtcagtctcagtcaggacacagcatggacatgagggtcccgctcagctcctggggctcctgctactctggctccgaggtggcagatgtgacatccagatgacccagtctccgccctccctgtctgcatctgtaggagacagagtcaccatcacttgccggcaagtcagagcattggcacctacttaaattggtatcagcagaaaccaggaaancccccaaatcctgatcaaattatgcatccagtttgcaaagtgggtccccatcaagattcagtgcgtgatctgggacagatttcactctcaccatcaacagtctgcagattgaggattangcaacttattactgtcagtcagagttccaggaccccgctcacgtttccggacgggggaccaaagtcggacgtacaaacgaactgtcggctgcaccta

SEQ ID NO: 414591 - DNA, 492 bp, Homo sapiens
  misc_feature: GZ8MTXP02IXECY.8.49.E05.1.454.CMB.2.raw
  modified_base (271)..(271): a, c, t, g, unknown or other
  modified_base (401)..(401): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcatgcactataatgtatcagcagaaacaggaaancccccaaatcctagatacaattatgcatccagtttgacaaagtcggggtcccagtacaagtattcagtggcggtggatcgtagggacagatttcactctcaccatcaacagtctgacagattgagattangacaacttattactgtacagcagagttacacgacccgactctacttacggtcggggacgaacgtagaacgtacaacgaacgtagtgcgcgc

SEQ ID NO: 414592 - DNA, 509 bp, Homo sapiens
  misc_feature: GZ8MTXP02HR0HW.8.49.E05.1.454.CMB.2.raw
  modified_base (273)..(273): a, c, t, g, unknown or other
  modified_base (433)..(433): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctcctgtctgcatctgtaggagacagagtcaccatcacttgccgggcaagtcagagcattggcactacttaaatggtatcagcagaaaccaggaaancccccaaatcctgatcaattatgcatccagtttgacaaagtgggtccccatcaagattcagtgcggtgatctgggacagatttcactctcacatcaacagtctgcagattgagtattatgtacaactttatactgtacagcagtagttaccaggaccccnctcgtaacgtttcgggacgggggtaaccaaaggtcggaaccgtacgaaaacgacttaggacggactcgacacctag

SEQ ID NO: 414593 - DNA, 657 bp, Homo sapiens
  misc_feature: GZ8MTXP02JOJQP.8.49.E05.1.454.CMB.2.raw
  modified_base (228)..(228): a, c, t, g, unknown or other
  modified_base (262)..(262): a, c, t, g, unknown or other
  modified_base (267)..(267): a, c, t, g, unknown or other
  modified_base (313)..(313): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtccactatctacttcggccgganaagtcagagactgtcgacctacttaattagtgtnacganacaaacgaacggaaggaaccccaccctaactcagactaactaattncactactacgttagtacaacgtaaggggtccgaccatagaattactacgaggtcgggtcgggtagtacgttcgggaggaactagtttacttacaccttccaaccctaactactaaaccaaagttctcgacgaacgagttagtagggaaatttattagaccgtaaacttttaaacttaacgtttcgtaccagtacgtacgtaaaggttcccgtaaccggaccccggtaccctacgttacccggttacgggggtaccggggggaaaccggtaaaccttaaggggtaccgtaacccgtaaaacgaacggttacggtggtacccgtacgtacaaccccgtatttaccg

SEQ ID NO: 414594 - DNA, 650 bp, Homo sapiens
  misc_feature: GZ8MTXP02FW85Y.8.49.E05.1.454.CMB.2.raw
  modified_base (198)..(198): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctcctgtctgcatctgtagganacagagtccaccatctacttcggccgggacaagtcagagactgtcgacctaaccttaaattaagtgtacacgacgacgaaaccgaaaccggaaacggaacccccaacccctaactcgtatactaactaatagcactactacgttagtacgaacgtaacggggttccggaccctataacgaagttactacggtaggtcggggtcggtagtacgttgggtacggaatagtttactactaccttcacccaactactaaacaacgtctcgtagacgtaagttagtagggtaattattgactaaacctttaatttacgttatcgtagacgacgtaacgttaccgtaccgaccccggacccttctaccggtttacgggtaccgggggaaacccgggaaataacgggtaccgtactaaaaccggaaaacgtcggttggacgtacgacgacctacgttcg

SEQ ID NO: 414595 - DNA, 570 bp, Homo sapiens
  misc_feature: GZ8MTXP02I11UL.8.49.E05.1.454.CMB.2.raw
  modified_base (274)..(274): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccggcaagtcagagcattggcactattaaatggtatcagcagaaaccagggaaacncccccaaatcctagactacaaattatgactatcctagtttgactaaaggttcggggtacccccatcaaagattcaggtggcgggtgatcgtgggacagtatttcactctcacatcaacagtctgcagattgagtattatgtactaactttattacctgtacagtctaaggtacgttacccgacggtacccccgtctcgtaaccggtttcgggggaaccggggggtaaccctaaaagggtacgggaaccgttaacgaaaacggtaacgttggtacggcttacggacctaaccgtacg

SEQ ID NO: 414596 - DNA, 520 bp, Homo sapiens
  misc_feature: GZ8MTXP02HKPVE.8.49.E05.1.454.CMB.2.raw
  modified_base (277)..(277): a, c, t, g, unknown or other
  modified_base (337)..(337): a, c, t, g, unknown or other
  modified_base (392)..(392): a, c, t, g, unknown or other
  modified_base (410)..(410): a, c, t, g, unknown or other
  modified_base (450)..(450): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtcctccgccctcctgtctgcatctgtaggagacagagtcaccatcacttgccgggcaagtcagagcatggcactacttaatgtatcagcaagaaaccaggaaacncccccaaaatcctagatcaaattatgcatcctagttgacaaagtcgggtacccatcaagnttcaggtgcggtgatcgtgggacagtattcactctacacatacaacagtctcganagatttggaagtatttangtactaactttatactgtacagtcagtactcgacgcccgntacgtacgttacgggaccgggggaaccaaggtggtaacgtacgaaaacgtacgtaggtcggacctagacc

SEQ ID NO: 414597 - DNA, 505 bp, Homo sapiens
  misc_feature: GZ8MTXP02FVUUD.8.49.E05.1.454.CMB.2.raw
  modified_base (309)..(309): a, c, t, g, unknown or other
tcagctcgcgtgtccacgaccggtgctcgatttagagcgactagcaacacacaaaggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctactaaatggtatcagcagaaaccaggaaagccccaaatcctagatcaaattatgcatccagtttgnaaagtggggtcccccatcaagattcagttggcgtgatcgtgggacagatttcactctcaccatcgaaacagtctgcagattgaaggtattatgacaaactttatatgttcagtcagagtctacgacccgctcacttcggtcggggaccggaacgtacggacgtacgaaacgaacgtacgtaggcgtacgacacaac

SEQ ID NO: 414598 - DNA, 552 bp, Homo sapiens
  misc_feature: GZ8MTXP02HTB01.8.49.E05.1.454.CMB.2.raw
  modified_base (278)..(278): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaacncccccaaatcctagatcaattatgcatccagtttgacaaaggtcgggtccccatcaagattcagtggcggtgatcgtgggacagtatttcactctcacatcaactagtctgcagattgaggtattatgtataactttatactgtcagcagtacgttccgacgaccccgtctccgtaccgttccggggtacggggggaaacctaaacgggtacgggtaaccgtaacgaaaaccggtaacgttagggtacggtacgtacggacctaaccgtaaccg

SEQ ID NO: 414599 - DNA, 586 bp, Homo sapiens
  misc_feature: GZ8MTXP02IJRZQ.8.49.E05.1.454.CMB.2.raw
  modified_base (274)..(274): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcactacttaaatggtatcagcagaaaccagggaancccccaaatcctgatcaattatgcatccagtttgcaaagtgggtccccatcaagattcagtgcggtgatcgtgggacagatttcatctcaccatcaacagtctgcagattgaggtattatgtactaacttattaactgtctagctaagtacgtttaccgaacggtacccccgtccgttacgtaaaccgttttccgggggacccgggggggtaaaccctaaaacggggttaaccggggtaaccgttaccggaaaaaaccggtaaacccgttagggttacgggaccgtttacggacccgtaaacccgttaaccg

SEQ ID NO: 414600 - DNA, 554 bp, Homo sapiens
  misc_feature: GZ8MTXP02HVDD1.8.49.E05.1.454.CMB.2.raw
  modified_base (198)..(198): a, c, t, g, unknown or other
  modified_base (274)..(274): a, c, t, g, unknown or other
  modified_base (285)..(285): a, c, t, g, unknown or other
tcagctcgcgtgtccacgaccggtgctcgatttagagcgactagcaacacacaaaggggagtcagtctcagtcaggacacagcatggacatgagggtccccgctcagctcctggggctcctgctactctggctccgaggtggcagatgtgacatccagatgacccagtctccgccctccctgtctgcatctgtagganacagagtcaccatcacttgccgggcaagtcagagcattggcacctacttaaatggtatcagcagaaaccagggaanccccaaatccngatcaattatgcatccagtttgactaaaggtgggtcccccatcaagattcagtggcggtgatcgtgggacagatttcactctcaccatcaattagtctgcagtattgagtatttatgtactaatttatactagtctaagcacgtagttccgaacggtacccccgtctacgttacggtttaccgggaccggggggtaaacctaaacgggttcgggaaccgttacgaaaaccgtaaccggttgtacgggtcttacggcctaacccgttacg

SEQ ID NO: 414601 - DNA, 525 bp, Homo sapiens
  misc_feature: GZ8MTXP02IJP8B.8.49.E05.1.454.CMB.2.raw
  modified_base (203)..(203): a, c, t, g, unknown or other
  modified_base (228)..(228): a, c, t, g, unknown or other
  modified_base (254)..(255): a, c, t, g, unknown or other
  modified_base (257)..(257): a, c, t, g, unknown or other
  modified_base (271)..(271): a, c, t, g, unknown or other
  modified_base (279)..(279): a, c, t, g, unknown or other
  modified_base (294)..(294): a, c, t, g, unknown or other
  modified_base (406)..(406): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtctccgccctccctgtctgcatctgtagganacagagtcaccatcacttggccggnaagtcagagcatgcactataatgtannancagaacaggaaacnccccaaancctagatcaaattangctatcctagtttgacaaaggtggggtacccatacaagtattcaggtgggcgtggatcgtagggacagtattcactctcacatacaacagtctgacagattgaggtatttanagtactaattattacgtagtacagctaagacttccgacggacccgtcgtacaccgtttcgggaccgggggtacaaaggtaggaaccgtaacgaaacgtacgtaggtcggtctacgaccg

SEQ ID NO: 414602 - DNA, 533 bp, Homo sapiens
  misc_feature: GZ8MTXP02H6DYP.8.49.E05.1.454.CMB.2.raw
  modified_base (296)..(296): a, c, t, g, unknown or other
  modified_base (376)..(376): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccggcaagtcagagcattggcactacttaatggtatcagcagaaacaggaagacccccaaatcctagactacaattangcatccagtttgacaaaggtcgggtacccccataccaagattcgagtgggcgtgggtatcgtgggacagtatttcactcncacatacaacagtctgcagtattgagtattatgtactaattatactgtcagtacagtacgttccgacgacccctctacgtacggtttacggacgggggaacctaaagggtcggaaccgtacgaaacgtacgtaggtacggcgtacggactacgtacg

SEQ ID NO: 414603 - DNA, 780 bp, Homo sapiens
  misc_feature: GZ8MTXP02IME55.8.49.E05.1.454.CMB.2.raw
  modified_base (200)..(200): a, c, t, g, unknown or other
  modified_base (227)..(227): a, c, t, g, unknown or other
  modified_base (267)..(267): a, c, t, g, unknown or other
  modified_base (312)..(312): a, c, t, g, unknown or other
  modified_base (323)..(323): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtcctgcatctgtagganacagagtccaccatcacttggccgganaagtcagagactagtcgacctaaccttaattaagtgtacncgacgacaaacgaaacggaacggaaccccaacccctaactccganactaactatancgactactacgttagttacgaaacgtaaggggttccgtacccctagtacgaaagtttctacggtaggtcggggtggggtactacgttacgggggtaacgaacggttaatttaccgtttaaccctacctacctaaccctaaacttaactaaacccgtaaagtttcgtccgtaacggtaacgttaaaggttaggtaagggtaaagttttacttaagaacccgttaaacctttttaaagttttacgtaccggttacgtaacgtacggttaaccgtaaacggtttaccccgtaaccccggggaaccccggttccccctttacggtttaacccggggtttaccgggggttaaccccgggggggaaaacgtaaaaccgttacgggggttaacccgtaaccgtaaaaaccgggtaaaacgttcgggttcgggtacccggtacgtacccgtaaccctaacgttcg

SEQ ID NO: 414604 - DNA, 549 bp, Homo sapiens
  misc_feature: GZ8MTXP02HK7NV.8.49.E05.1.454.CMB.2.raw
  modified_base (223)..(223): a, c, t, g, unknown or other
  modified_base (278)..(278): a, c, t, g, unknown or other
  modified_base (304)..(304): a, c, t, g, unknown or other
  modified_base (396)..(396): a, c, t, g, unknown or other
  modified_base (417)..(417): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccggnaagtcagagcattggcacctacttaaattggtatcagcaagaaaccagggaaacncccccaaactcctagatacaaattangctatccagtttgactaaaggtcggggtacccccatacaagattcaggtggcggtggatcgtgggacagtatttcactctacaccatacaangtctgacagtatgagtattangtactattattactgtacagcagacgttccaacggaccccgtctacgtacggtttccggggacgggggtaaaccaaacgggtcggaaccgttacgaaaacgacgtacggtacggtaccgtcgacaccgtacg

SEQ ID NO: 414605 - DNA, 551 bp, Homo sapiens
  misc_feature: GZ8MTXP02I2MZB.8.49.E05.1.454.CMB.2.raw
  modified_base (277)..(277): a, c, t, g, unknown or other
  modified_base (334)..(334): a, c, t, g, unknown or other
  modified_base (421)..(421): a, c, t, g, unknown or other
tcagctcgcgtgtccacgaccggtgctcgatttagagcgactagcaacacgacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccggcaagtcagagcattggcacctacttaaattggtatcagcagaaaccagggaaancccccaaatcctgatcaattatgcatccagtttgacaaagtggggtccccatcaagnttcagttggcggtggatcgtgggacagatttcaactctcacctatcaacagtctgacagattgaggatttatggactagttattacngtcaggcaagagttaccacggaaccccgtcttacctaccggtttccgggacgggggaacccaaaggttacgggtaccgttaccgaaaaccgaaccgttaggttacggggcttacgggaccaccttaacgg

SEQ ID NO: 414606 - DNA, 541 bp, Homo sapiens
  misc_feature: GZ8MTXP02G0NM6.8.49.E05.1.454.CMB.2.raw
  modified_base (415)..(415): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcactacttaaatggtatcagcaagaaaccagggaaacgcccccaaactccctagatacaattatgacatcctagtttgactaaaggtcggggtacccccatacaagacttcagttgggcggtggatcgtgggactagtattcactctacacatcaacagtctgcagattgaaggtnttatgactaacttattactgtcagtcagtacgttaccaacggcccctactcgtacggtttcgggacgggggactaaacgggtcggaccgtaagaaacgtacttacggcggactcggaccacgtacg

SEQ ID NO: 414607 - DNA, 523 bp, Homo sapiens
  misc_feature: GZ8MTXP02IOBRI.8.49.E05.1.454.CMB.2.raw
  modified_base (223)..(223): a, c, t, g, unknown or other
  modified_base (299)..(299): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccggnaagtcagagcattggcactacttaaattggtatcagcagaaaccagggaaagcccccaaatcctagatacaattangcatccagtttgcaaagtcgggtccccatcaagattcagtgcggtgatcgtgggacagatttcactctcacatcaacagtctgcagattgagattatgtactaacttattaactgtacagcagacgttccacggcccctactcctaccggtttacgggacgggggtaaccaaacggttacggaaccgttacgaaaacgactaggtacggactcgacgacctacg

SEQ ID NO: 414608 - DNA, 543 bp, Homo sapiens
  misc_feature: GZ8MTXP02HXJ9O.8.49.E05.1.454.CMB.2.raw
  modified_base (224)..(224): a, c, t, g, unknown or other
  modified_base (277)..(277): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggnaagtcagagcattggcacctacttaaatggatcagcaagaaaccagggaaacncccccaaatcctagactacaattatgctatcctagtttgacaaaggtcggggtaccccatacagattcaggtggcggtgatcgtgggacagtatttcactctacacatacaaactagtcctgcagtatgaggtattatagtactaacttattactgtcagcgtagtacgttaccaacgggtcccctactccgttaacggttccgggacgggggtaaaccaacggttacggacgtacgaaaacgacgttgacggctacgccactacg

SEQ ID NO: 414609 - DNA, 552 bp, Homo sapiens
  misc_feature: GZ8MTXP02FYG6B.8.49.E05.1.454.CMB.2.raw
  modified_base (222)..(222): a, c, t, g, unknown or other
  modified_base (230)..(230): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctcctgtctgcatctgtaggagacagagtcaccatcacttgccggnaagtcagngcatgcactactaaatggatcagcagaaccaggaacgcccccaaatcctagatcaattatgcatcctagtttgacgtaaaggtggggtaccccccattacaaagtattacgaggtgggtcggtggatcgtaggggactagtatttccacttctacaccatcaaactagctgcagattgagtattatgactaactttattactgtacagctaagtacgttaccgacgggtacccctctacgtacgtttaccgggggaccgggggtaaccaaacggtcggaaccgtacgaaaacggtacgtaggtacggactcggactaccgta

SEQ ID NO: 414610 - DNA, 528 bp, Homo sapiens
  misc_feature: GZ8MTXP02GRC6A.8.49.E05.1.454.CMB.2.raw
  modified_base (224)..(224): a, c, t, g, unknown or other
  modified_base (299)..(299): a, c, t, g, unknown or other
  modified_base (405)..(405): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggnaagtcagagcattggcacctacttaaattggtatcagcagaaaccagggaaagcccccaaatcctgatcaattangcatccagtttgcaaagtgggcccccatcaagattcagtggcgtgatcgtgggacagtatttcactctacaccatacaacagtcctgcagattgaggattatgtanaactttattactgtaccagactagacttaccgacggtaccccgcttacgtaccgtttcggggacgggggacctaaacgggtcgtaacgtacaaaacggactacggtcggactggaccactacg

SEQ ID NO: 414611 - DNA, 601 bp, Homo sapiens
  misc_feature: GZ8MTXP02JLD6M.8.49.E05.1.454.CMB.2.raw
  modified_base (222)..(222): a, c, t, g, unknown or other
  modified_base (276)..(276): a, c, t, g, unknown or other
  modified_base (459)..(459): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgcctccctgtcctgcatctgtaggagacagagtcaccatcattgccggnaagtcagagcattggcacctacttaaatggtatcagcaagaaaccagggaaacncccccaaatcctagatactaaattatagctatcctagtttcgacgtaaaggttcggggtaccccccatacgaaagtactttacaagggttcggtcggggtaggtaactcggtagggggacctaggtatttcccaacttcacaccctataccgaactagtctacgcgtaagagtttaggaagtntttaacagtacctaatttactactgtacaggtatacgtacgtaccgacgtcccgtctacgtacggttaccgggggacgggtaacgtaacggtccggtaacgaacgtaaacgtacgtcggtacgacgtacgtaccgtactacg

SEQ ID NO: 414612 - DNA, 573 bp, Homo sapiens
  misc_feature: GZ8MTXP02HJ92E.8.49.E05.1.454.CMB.2.raw
  modified_base (235)..(235): a, c, t, g, unknown or other
  modified_base (257)..(257): a, c, t, g, unknown or other
  modified_base (272)..(272): a, c, t, g, unknown or other
  modified_base (334)..(334): a, c, t, g, unknown or other
  modified_base (340)..(340): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccggcaagtcagngcatgcactattaatgtatcancaagaacaggaaacnccccaaatccagactacaattatgctatcctagttgactaaggtcgggtacccatacaagtnttacgnggttgggcggtagacgttcggtagggactaggtactttccgaacttctaccaaccatacaaactcgtactagactaagtattaggaaggtatttagcgtacttaaactttataacgtgtaccaagtactagtacgttacccgaaccggtacccctctaccgttaccggttcgggggaccgggggtaaacaaggtcggtaacgtacgaaaacgtacgtggtacggactacgacc

SEQ ID NO: 414613 - DNA, 602 bp, Homo sapiens
  misc_feature: GZ8MTXP02HIU7L.8.49.E05.1.454.CMB.2.raw
  modified_base (198)..(198): a, c, t, g, unknown or other
  modified_base (225)..(225): a, c, t, g, unknown or other
  modified_base (416)..(416): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctcctgtctgcatctgtagganacagagtcaccatcacttggccggganaagtcagagcatggcactacttaatggtatcagacaagaaaccaggaaacacccccaaatcctagatacaaattatgactacttaccgtagtttagacgtaaaggtcgggtaccccctagtacaagtacttcgaggtgggtcgggtagatacggtaggacgtagtactttcacttctaccactatacaacngtctgactaagtagttaggaagttattatcgtaactaatttattaactggtacagtacaagtcgttaccgacggtaccccctgttaccgtacgggtttccggggaacgggggtaacctaaacgggtacggtaccggtaacgaaaaccggtacgtcgggtacggtaccgtacggaccgaacctttcg

SEQ ID NO: 414614 - DNA, 570 bp, Homo sapiens
  misc_feature: GZ8MTXP02HOV18.8.49.E05.1.454.CMB.2.raw
  modified_base (224)..(224): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggnaagtcagagcattggcactactaaattgtatcagcagaaaccaggaaacgcccccaaactcctagatcaattatgacatcctagtttgactaaaggtcggggtacccccagtaccaagtattcaggttggcggtgatcgtgggacagtatttcactctcacatacaactagtctgcagtattagaggtattagtagtactaactttattactgttacagactagtacgttaccgacggtaccccgtactaccgtaccggtttccggggaccgggggtaacctaaacgggtacggtaaccgtaaccgtaaaacggtaacgtcggtacggactacggacctacctacg

SEQ ID NO: 414615 - DNA, 558 bp, Homo sapiens
  misc_feature: GZ8MTXP02IUII2.8.49.E05.1.454.CMB.2.raw
  modified_base (199)..(199): a, c, t, g, unknown or other
  modified_base (277)..(277): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtagganacagagtcaccatcacttgccgggcaagtcagagcattggcacctacttaaattggtatcagcaagaaaccaggaacncccccaaatcctagatcaaattatgactatccagtttgactaaaggtcggggtacccccatcaagtattcaggtggcgggtgatcgtgggacagtatttcactctcacatcaacagtctgcagatgagattatagactaactttattaactcgtacagactagtacgttaccgacggtaccccgtctaccgtacggtttccgggggacgggggtaacctaaacgggttcggaaccggttaaccgaaacggtaacgtggtacggctacggacctaccgtacg

SEQ ID NO: 414616 - DNA, 584 bp, Homo sapiens
  misc_feature: GZ8MTXP02IJVW6.8.49.E05.1.454.CMB.2.raw
  modified_base (274)..(274): a, c, t, g, unknown or other
  modified_base (296)..(296): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcacatcacttgccggcaagtcagagcattggcaacttattaaagtgtatcagcaagaaccagggaacnccccaaatcctgatacaattangacatccagtttagactaaaggtcggtccccatcaagtcttcgaggttcggcgggtgatcggaggacagtatttcactctacacatacaactagtctagacaagtagttagaggttaattaagtaggtaccttaaacgtttagttaaccgtgttaccgagtacgtaacgtacgttacccgaacggtcccccgtacttacccggtaccggtttaccgggggaaccggggaaacctaacggtaccggtaaccgtaaccgaaacgtacgtggttcgactcgtacaccgtag

SEQ ID NO: 414617 - DNA, 686 bp, Homo sapiens
  misc_feature: GZ8MTXP02IT5JU.8.49.E05.1.454.CMB.2.raw
  modified_base (203)..(203): a, c, t, g, unknown or other
  modified_base (236)..(236): a, c, t, g, unknown or other
  modified_base (252)..(252): a, c, t, g, unknown or other
  modified_base (270)..(270): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtcctccgccctcctgtctgcatctgtagganacagagtcaccatcacttgccggcaagtcagancatgcactataatgancagcagaaccaggaaacnccccaaatcctagatcaaattatgacactcctagtttagacgtaaacgggttcgggtaccctatacgaaagtacgttacgaggggttcgggtcggggtaggtacgttccgggtaacgggggtaactaacggttaacttttacccgaacctttccctaaccccgtaaacctaacgttaaacccaaaccgttaaacggttccttacgggaacctaagggttaacgtttacgggaaaggtttaacttttaagtacgtaaacctttaaaactttaaccttacgttacgtacgtaacgtacgtaaggtaccgtttacccgaacccggggtacccctcgttaccgtaccgggtttaccgggggaccgggggtaaacctaaggtacggaacgtaccgaaaacgtaccgtggtcgacgtcgacc

SEQ ID NO: 414618 - DNA, 676 bp, Homo sapiens
  misc_feature: GZ8MTXP02JTIJI.8.49.E05.1.454.CMB.2.raw
  modified_base (202)..(202): a, c, t, g, unknown or other
  modified_base (277)..(277): a, c, t, g, unknown or other
  modified_base (300)..(300): a, c, t, g, unknown or other
  modified_base (562)..(562): a, c, t, g, unknown or other
tcagctcgcgtgtccacgaccggtgctcgatttagagcgactagcaacacgacaaagggggagtcagtctcagtcaggacacagcatggacatgagggtccccgctcagctcctggggctcctgctactctggctccggaggtggcagatgtgacatccagatgacccagtcctccgccctccctgtctgcatctgtagganacagagtcaccatcacttgccggcaagtcagagcattggctacctacttaaatggtatcagcagaaacagggaancccccaaatcctgatacaattangcatcctagtttgaccgtaaaggtcggggtacccccagtaccaaggtactttccgaggtcgggtcgggtagggaatccggtagggggacctaggtattttcaactctaccaacccattacccaaatacgttccgtagaccgaagtaaagtttggaaacgggttatttaaacggtcggtaaccgttaaaactttacggttaaactttcgtacccgaagttaccgaacggtaacggtttaccccgaaacgggggaccccccgtnttacccggtaaaccgggttttccgggggaacccgggggttaaacctaacgggtacgggtaaccgttaccgaaacgtaaaccgtagggtacggacgttcggaccaacccgttacg

SEQ ID NO: 414619 - DNA, 573 bp, Homo sapiens
  misc_feature: GZ8MTXP02HVJHY.8.49.E05.1.454.CMB.2.raw
  modified_base (223)..(223): a, c, t, g, unknown or other
  modified_base (276)..(276): a, c, t, g, unknown or other
  modified_base (448)..(448): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctcctgtctgcatctgtaggagacagagtcaccatcacttgccgggnaagtcagagcattggcacctattaaatggtatcagcaagaaaccagggaaacncccccaaactcctagactacaattatgactatcctagtttgactaaaggtcggggtaccccagtacaaagtattcaggtggtcgggtagatcgtgggacagtactttcactctacaccaatcaacagtctgcagtattgagtattatagtactaactttatactagtacagnagtacgtccgacggaccctacgtaccgtacgtttaccggggaccgggggtaaacctaaagggttacggaaccggtaacgaaaacccggtaacgtagttcgggacttcggacctaacccgttaacg

SEQ ID NO: 414620 - DNA, 762 bp, Homo sapiens
  misc_feature: GZ8MTXP02FPOKP.8.49.E05.1.454.CMB.2.raw
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctcctgtctgcatctgtaggagacagagtcaccatcacttgccgggcaagtcagagcattggcacctacttaaattggtatcagcaagaaaccagggaaacgcccccaaactcctagataccaaattatgacataccagtttacgactaaaaggttcggggtaccccccataccgaaaagactttacgaaggttcggggtccggggtagggtaacgttccggttagggggaaacctaagggttaactttttacccaaacctttaccttacccgaaaccctaacgttacccaaaaccgtacgtccttacggacctaaggtaaagtttagggaaaggggttaaatttaaacgttacggaaccctttaaaacgttttaactttaaacccgttaggttaccttaacggacgttaaacggtaaccgtttacccgaaaccggggtaaccccccgttccgttaccgtaacccgggtttttaccgggggaaccggggggtaaaccctaaaacggggttacggtaaaccggttaaaccgaaaaccggtaaaacccgttggggttacggccgttaccggaccgtaaccttaaaccg

SEQ ID NO: 414621 - DNA, 576 bp, Homo sapiens
  misc_feature: GZ8MTXP02HSAQD.8.49.E05.1.454.CMB.2.raw
  modified_base (200)..(200): a, c, t, g, unknown or other
  modified_base (224)..(224): a, c, t, g, unknown or other
  modified_base (277)..(277): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgaccccagtcctccgccctcctgtctgcatctgtagganacagatcaccatcacttgccgggnaagtcagagcattggcacctacttaaatggtatcagcagaaaccagggaaacncccccaaactcctagatacaattatgctatccagtttgactaaaggtcgggtcccccatcaagattcaggtggcgggtgatcgtgggacagtatttcactctcaccatacaactagtctgacagtattagaggtattatgtactaactttattactgtacagtctagacgttaccgacggtaccccgtcgtaccgttacggtttccgggggaccgggggtaaacctaaacgggtacgggtaaaccggtaccgtaaaaccggtacgtacggttacgggacttacggacctacccgttacg

SEQ ID NO: 414622 - DNA, 543 bp, Homo sapiens
  misc_feature: GZ8MTXP02IVQ2Q.8.49.E05.1.454.CMB.2.raw
  modified_base (202)..(202): a, c, t, g, unknown or other
  modified_base (252)..(252): a, c, t, g, unknown or other
  modified_base (269)..(269): a, c, t, g, unknown or other
  modified_base (385)..(385): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctgggctcctgctactctggctccgaggtggcagatgtgacatccagatgacccagtctccgccctccctgtctgcatctgtagganacagagtcaccatcacttgccgggcaagtcagagcatgcactataatgancagcagaacaggaaacnccccaaatccagatcaattatgactatcctagtttgactaaacggtcgggtacccagtacaagtattcgaggtggacggtgatcgtgggacagtattcactctacaccatacaacngtctgactagtattaggagtaattagtacgacttaaactttattactagtactaggacaagtcgtaccgaccggaccccgctaccgtaacggttccggggaccgggggaacctaaaggtacggaacgtaacgaacgtaacgtgtacggactacgaccg

SEQ ID NO: 414623 - DNA, 575 bp, Homo sapiens
  misc_feature: GZ8MTXP02G557Y.8.49.E05.1.454.CMB.2.raw
  modified_base (268)..(268): a, c, t, g, unknown or other
  modified_base (418)..(418): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgccctccctgtctgcatctgtaggagacagagtcaccatcacttgccggcaagtcagagcatggcactataatgatcagcagaaccaggaaacncccccaaatcctgatcaattatgactatcagtttagactaaaggtcgggtacccccatacaagtacttcgaggtgggcgggtggattcgtagggactagtactttcactctacacatacaactagtcctagacagtattgaagtatttangtactaaactttatacgtgtacagtacaaggtacgttaccgaaccggtaccccctacgtaccggttaccggtttaccgggggaccgggggtaaacctaaagggtacggaaccgttaacgaaaacgtaccgtggttacgacgtacgacctaacgttcg

SEQ ID NO: 414624 - DNA, 531 bp, Homo sapiens
  misc_feature: GZ8MTXP02I2WN5.8.49.E05.1.454.CMB.2.raw
  modified_base (229)..(229): a, c, t, g, unknown or other
  modified_base (330)..(330): a, c, t, g, unknown or other
  modified_base (378)..(378): a, c, t, g, unknown or other
  modified_base (398)..(398): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttggccgggnaagtcagagcatggcactactaatgtatcagcagaaccaggaaacgcccccaaactcctagatcaatttatgcatccagttgcaaagtgggtaccatcaanattcagtggcggtgatcgtagggacagactttcactctcaccatcaangtctgcagattgagtattanagtactaacttattactgtacagcagtacgttcgacggtaccccgctacgtaccgtttaccggggaccgggggtaaccaaaggggttcggaacggttacaaaacggtaccgtaggtacggacgtacgaacccg

SEQ ID NO: 414625 - DNA, 563 bp, Homo sapiens
  misc_feature: GZ8MTXP02GPEQL.8.49.E05.1.454.CMB.2.raw
  modified_base (199)..(199): a, c, t, g, unknown or other
  modified_base (223)..(223): a, c, t, g, unknown or other
  modified_base (274)..(274): a, c, t, g, unknown or other
  modified_base (285)..(285): a, c, t, g, unknown or other
  modified_base (295)..(295): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtagganacagagtcaccatcacttgccggnaagtcagagcattggcacctacttaaattggtatcagcagaaccaggaacnccccaaatccngatcaattangcatcctagtttgactaaaggtcgggaccccatcaagtattcgagtggcggtgatcgtggacagtacttcactctcacatcaactagtctgacagtattgaaggtattatgtactaactttagtactgtacagactaagtaccgttaccgaccggtaaccccctcgttacccgtaccggtttaccgggggaccgggggtaaacctaaacgggtccgggtaacgtaccgaaaacggtacgtacggtacggactacggaccaccgttacg

SEQ ID NO: 414626 - DNA, 538 bp, Homo sapiens
  misc_feature: GZ8MTXP02HG2KE.8.49.E05.1.454.CMB.2.raw
  modified_base (199)..(199): a, c, t, g, unknown or other
  modified_base (224)..(224): a, c, t, g, unknown or other
  modified_base (280)..(280): a, c, t, g, unknown or other
  modified_base (305)..(305): a, c, t, g, unknown or other
  modified_base (397)..(397): a, c, t, g, unknown or other
  modified_base (418)..(418): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtagganacagagtcaccatcacttgccgggnaagtcagagcattggcacctacttaaattggtatcagacagaaaccaggggaaacncccccaaatcctagatacaatttangcatccagtttgactaaaggtcgggtacccccatcgaagtattcgaggtgggcggtgatcgtgggactagtatttcactctacacatcaacngtctgcagtatgagtattagngataacttatactgtcagacgagtacgttacccgaacggaccccctctacgtaccggtttccgggggacgggggtaccaaaggtcggaacgtacgaaacgagtcggtagctcggacactg

SEQ ID NO: 414627 - DNA, 674 bp, Homo sapiens
  misc_feature: GZ8MTXP02GXXDA.8.49.E05.1.454.CMB.2.raw
  modified_base (225)..(225): a, c, t, g, unknown or other
  modified_base (274)..(274): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgccctccctgtctgcatctgtaggagacagagtcaccatcacttggccggnaagtcagagcattggcactacttaaatgtatcagcagaaccaggaaacncccccaaatccagatacaattatgactatcctagtttagaccgaaaaggttcggggtaccccccctaagtaccgaaagtactttaccgaaggttcgggccggggttgggtaacttccggtaggggaacctaggttactttttacccaaccttaccgttacccaaaccctattaacccgaaaccgtacggttaccctaggtactaagtagttacggaaagggtatttaagtcgtaacttaaactttagttacctaggttaccagtaccgtaagtaccgttacccgaacggtacccccgtacgtaccgtaccggtttccgggggaccgggggtaaacctaacggggtacgtaaccggttacgaaaacggtacgtacggtacggcgtacggacctaccgtacg

SEQ ID NO: 414628 - DNA, 645 bp, Homo sapiens
  misc_feature: GZ8MTXP02GRNJ1.8.49.E05.1.454.CMB.2.raw
  modified_base (223)..(223): a, c, t, g, unknown or other
  modified_base (252)..(252): a, c, t, g, unknown or other
  modified_base (254)..(254): a, c, t, g, unknown or other
  modified_base (270)..(270): a, c, t, g, unknown or other
  modified_base (283)..(283): a, c, t, g, unknown or other
  modified_base (294)..(294): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgccctccctgtctgcatctgtaggagacagagtcacatcacttgccggnaagtcagagcattgcacctattaatgatnanacagaaaccaggaacnccccaaatcctanactacaattangactatcctagtttacgacgtaaaggtcgggtacccccatacaaagtacgttacgaaggttgggtcggggtagtaattcgggtaggggaacctaaggttacttttcccgtaacttccttaccaacctacttaccaaactacgtacgtagacgtaagtagttaggtaaaggttattagtacgtacttaaacgtttaattaccgtagttacacgtacaaggtaccgttaccgaaccgggtacccctacgttacccgttaccgggtttaccggggaccgggggtaaacctaaacggttaccggaaccggtaacgaaaaccggtacgtacgggtacgtcgtacgaccgacttacg

SEQ ID NO: 414629 - DNA, 557 bp, Homo sapiens
  misc_feature: GZ8MTXP02G27HJ.8.49.E05.1.454.CMB.2.raw
  modified_base (200)..(200): a, c, t, g, unknown or other
  modified_base (224)..(224): a, c, t, g, unknown or other
  modified_base (278)..(278): a, c, t, g, unknown or other
  modified_base (448)..(448): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgccctccctgtctgcatctgtagganacagagtcaccatcacttgccggnaagtcagagcattggcacctacttaaattggtatcagcaagaaccagggaaacncccccaaatcctagatacaattatgcatcctagtttgacaaaggtcggggtacccccagtcaagtattcgaggtgggcggtggatcgtagggactagtatttcactctaccaccatacaaacacgtctagactagattgaaggtattatgtactaacttattactcgtanagtcagtacgttccgacggtacccctactaccgtacggtttacggggaccgggggactaaacgggtcgaacgtacaaacgtacgtacggtcggtactcggaccactacg

SEQ ID NO: 414630 - DNA, 553 bp, Homo sapiens
  misc_feature: GZ8MTXP02I1NXN.8.49.E05.1.454.CMB.2.raw
  modified_base (198)..(198): a, c, t, g, unknown or other
  modified_base (222)..(222): a, c, t, g, unknown or other
  modified_base (273)..(273): a, c, t, g, unknown or other
  modified_base (297)..(297): a, c, t, g, unknown or other
  modified_base (334)..(334): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctcctgtctgcatctgtagganacagagtcaccatcacttgccggnaagtcagagcattggcactacttaaatgtatcagcagaaaccagggaaacncccccaaatcctagatacaattangacatccagtttgacaaaggtcggtaccccatcaagnttcagtgcgtatggatcgtagggacagtactttcactctacaccatacaactgtctagacagtattagagtattagtgactaactttatacgtatacgaagactagtacgttacccgaacgggtaccccctgtaccgtacggtttaccggggaccgggggtaaacctaaacggtcggaacgttaaccgaaaacgtacgtggtacggactcgacctaacc

SEQ ID NO: 414631 - DNA, 542 bp, Homo sapiens
  misc_feature: GZ8MTXP02JZ4GU.8.49.E05.1.454.CMB.2.raw
  modified_base (198)..(198): a, c, t, g, unknown or other
  modified_base (272)..(272): a, c, t, g, unknown or other
  modified_base (376)..(376): a, c, t, g, unknown or other
  modified_base (380)..(380): a, c, t, g, unknown or other
  modified_base (400)..(400): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctcctgtctgcatctgtagganacagagtcaccatcacttgccggcaagtcagagcattggcactactaaattggtatcagcagaaaccaggaaancccccaaatcctgatcaaattatgcatccagtttgacaaagtgggcccccatcaagattcagtggcggtggatcgtgggacagatttcatctcaccatcaaacngtcngacagtattagagtattagngtactaactttattactgtacagcgaagtacgttaccgacggtaccccgtctacgtaccggttacggggaccggggtaacaaacgggtcggaaccgtaacgtaaaccggtaacgtcggtacggacctacgacctaccgtacg

SEQ ID NO: 414632 - DNA, 591 bp, Homo sapiens
  misc_feature: GZ8MTXP02J2JNK.8.49.E05.1.454.CMB.2.raw
  modified_base (400)..(400): a, c, t, g, unknown or other
  modified_base (422)..(422): a, c, t, g, unknown or other
  modified_base (434)..(434): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgcctcctgtctgcatctgtaggagacagagtcaccatcacttgccggcaagtcagagcattggcactacttaaattggatcagcagaaaccagggaaacgcccccaaactcctagatacaattatgacatccagtttgactaaaggtcggggtacccccatccaagtattcgaggtgggcggtggtatcgtggggactagtactttcacttctacaccatacaaacngtctgcagtattgaggtattangtactaaatttnttacgtgtacagtacagtacgttaccgacggtaccccgtcgtaccgtaccggtttacgggggaccgggggtaacctaaacggggtacgggtaaccggttaaaccgaaaccgggtaaacgtacgggtcggggtaaccttcggacccgaacccttacgg

SEQ ID NO: 414633 - DNA, 526 bp, Homo sapiens
  misc_feature: GZ8MTXP02F2FYX.8.49.E05.1.454.CMB.2.raw
  modified_base (445)..(445): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccggcaagtcagagcatggcactactaatgtatcagcagaaccaggaaacgcccccaaatcctagatcaattatgcatccagtttgcaaagtggggtccatcaagattcagtggcggtgatcgtaggacagtatttcactctacacatacaactagtctagcagattagaggtattatgactaacttattactagtcagcaagtacgttccaacggaccccgntaccgacgtttacggggacgggggtaacccaaaggtacggaacggttacgaaaacggtaaactggtacggcgtaggaaccc

SEQ ID NO: 414634 - DNA, 648 bp, Homo sapiens
  misc_feature: GZ8MTXP02HCU26.8.49.E05.1.454.CMB.2.raw
  modified_base (228)..(228): a, c, t, g, unknown or other
  modified_base (237)..(237): a, c, t, g, unknown or other
  modified_base (305)..(305): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtcctccgccctccctgtctgcatctgtaggagacagagtcaccatcacttgccggnaagtcaganctatgctacctaattaatgatcagcaagaaaccgaggaaaccacccccaaatccagactacaaatttngacacttccgtaagtttcgaacgaaacgggtcgggtaccccaataccaaagtattacgagggtgggacggttagacgttcggtagggaactagtactttaccacttcctacaaccataccaacgtacgtctagacgtaagtagttaggaagtatttaacgtacgttaacttaaactttacgtacgttacgtacgaacggtactaacgtaacgtacccgtaacccggtacccgtacccgttaccggttaccgggttaccgggggtaaccgggggtaaaccggtaaacggtaacggtaaccggtaaaccgtaaaccggtaacgtacggtacggtacgtacgtacg

SEQ ID NO: 414635 - DNA, 576 bp, Homo sapiens
  misc_feature: GZ8MTXP02FTP3U.8.49.E05.1.454.CMB.2.raw
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcactacttaaattggtatcagcaagaaaccagggaaacgcccccaaactcctagatcaatttatgactatccaagtttcgacctaaaaggtcggggtaccccagtaccaaagatttacgaggtgggcgggtgggactcgtaggggacagtaatttcaacttctcaaccatacaacagtctgacagtagtttagaaggtatttatcgtactaactttacttaacttgtactaagccaaggtacgttaccgacggtaccccgtctacctaccggtttacggggacgggggtaaccaaggtacgggaacgtacgaaacgacgtgtacggactcgac

SEQ ID NO: 414636 - DNA, 589 bp, Homo sapiens
  misc_feature: GZ8MTXP02HK854.8.49.E05.1.454.CMB.2.raw
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccggcaagtcagagcatgcactacttaaatgatcagcaagaaaccagggaaacacccccaaatcctagactactaattatgactactcctagtttgactaaaggtcgggtacccccatacgaaagtattcgaggttgggcgggttagactcggtagggactagtactttcactctaccaacatacaacgtagtctgacagtagttgaaggttatttatacgtaactaactttagttaactcgtacagactaaggtaccgttaccgacggtaacccctcgtaccgtaccggtttccggggacgggggtaaacctaaagggtaccggtaacgtaaccgaaaacgtacgtacggtacggctacggactaacctg

SEQ ID NO: 414637 - DNA, 712 bp, Homo sapiens
  misc_feature: GZ8MTXP02F4SP2.8.49.E05.1.454.CMB.2.raw
  modified_base (199)..(199): a, c, t, g, unknown or other
  modified_base (223)..(223): a, c, t, g, unknown or other
  modified_base (297)..(297): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtagganacagagtcaccatcacttgccggnaagtcagagcatgcactacttaaatgtatcagacagaaccaggaaacgacccccaaactcctagatacaattangacatcctagtttgaactaaaggtcggggtacccccagtacaaagtacttacgaaggttcgggcggggtggtaacgtcggtacgggggtactaaggttaacttttcctaaccttaccttaccctaacccgtaaacttacctaaaaccgtaagttcccgttaggaccgtaagtaagttaggtaaagggttaagtttaatacggtaacgttaaaccttttaaactttaaccgttacgtttacgacgtacgtaacgttaaccgtttaaccccgacccgggtaaacccccgtcccgtaccgtttaacccgggtttaccgggggaaaccggggggtaaaccctaaacggggtaacggtacccggtaaacgtaaaaccgtaacgttacggtacggtacgttacgaccgtaaccctttaacg

SEQ ID NO: 414638 - DNA, 552 bp, Homo sapiens
  misc_feature: GZ8MTXP02FWSAC.8.49.E05.1.454.CMB.2.raw
  modified_base (278)..(278): a, c, t, g, unknown or other
  modified_base (433)..(433): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccggcaagtcagagcattggcacctacttaaattggtatcagcaagaaaccagggaaacncccccaaactcctagatacaattatgacatcctagtttgacaaaggtcggggtcccccatcaagtacttcagttgggcggtgagtcgtagggactagtattcactctcacatcaagatctgacagatgagtatatagtactaattagtatcgtanagctagacgttaccacggaccccgtactcgtaccggttacggggaccgggggtaacaaacgggttcggaaccggttaacgaaaaccgtaacgtggtacggaccgtacgacctacgtacg

SEQ ID NO: 414639 - DNA, 566 bp, Homo sapiens
  misc_feature: GZ8MTXP02FPEXN.8.49.E05.1.454.CMB.2.raw
  modified_base (231)..(231): a, c, t, g, unknown or other
  modified_base (274)..(274): a, c, t, g, unknown or other
  modified_base (387)..(387): a, c, t, g, unknown or other
  modified_base (390)..(390): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccggcaagtcagngcattggcactactaaattggtatcagcagaaaccaggaaacncccccaaatcctagatacaattatgcatcctagttgacaaagtcggggtcccccatacaagtattcagtggcggtgatcgtagggacagtattcactctcacatcaacagctncanatgaggtatatgactaacttattactgtacagacgtaacgtacgttaccgacggtaacccccgtcgttaccgtaccggtttccgggggaccgggggtaaacctaaaacggggttacgggaaccgttaacggaaaacggtacgtacgggttacggacgttacggacctacgttaacg

SEQ ID NO: 414640 - DNA, 538 bp, Homo sapiens
  misc_feature: GZ8MTXP02H63IC.8.49.E05.1.454.CMB.2.raw
  modified_base (198)..(198): a, c, t, g, unknown or other
  modified_base (219)..(219): a, c, t, g, unknown or other
  modified_base (227)..(227): a, c, t, g, unknown or other
  modified_base (295)..(295): a, c, t, g, unknown or other
  modified_base (372)..(372): a, c, t, g, unknown or other
  modified_base (406)..(406): a, c, t, g, unknown or other
  modified_base (410)..(410): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctcctgtctgcatctgtagganacagagtcacatcactgcggnaagtcagngcatgcactacttaatgtatcagcaacgaaacgaggaaaccgacccccaaactcctagatacaattangacatacctagtttcgaacgtaaaggtcggtacccccatacgaagtattcgaggtcgggcgtaggatcggtaggaanagtatttcacttcacacatacaactgtctacganagtnttagaaggtattagtctactaattagttactgtacagtcgagtacgtaccgacgacccgtctacgtcggttacgggacggggaacaacggtcgaacgacaaacgtactaggtcgctacgaccaactcg

SEQ ID NO: 414641 - DNA, 657 bp, Homo sapiens
  misc_feature: GZ8MTXP02FZIMK.8.49.E05.1.454.CMB.2.raw
  modified_base (198)..(198): a, c, t, g, unknown or other
  modified_base (221)..(221): a, c, t, g, unknown or other
  modified_base (229)..(230): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctcctgtctgcatctgtagganacagagtcacatcacttgccggnaagtcagnnattgcacctacttaaatgtatcagcagaaaccgaggaaacgacccccaaactcctagatactaattatcgactactccgtagtttcgacgtaaaggtcggggtacccccagtacaaagtattcgaggttcgggcgggtaggacgtacgtaggggactaggttactttccacttctacccaaccataaccaaacgtacgtctagactagtagttggaaggtattagtacgtaccttaaactttacttacgtacggttacaggtacgtaacggtaccgttaacccgaccgggtacccccgttacgttaccggttaccgggtttaccgggggaaccgggggtaaaaccgtaacgggtaacgggaaccgttaaaccggaaaaccggttaacggtacggtaccgggtacgtacggaacctaccgtttaaccg

SEQ ID NO: 414642 - DNA, 571 bp, Homo sapiens
  misc_feature: GZ8MTXP02I7EWG.8.49.E05.1.454.CMB.2.raw
  modified_base (277)..(277): a, c, t, g, unknown or other
  modified_base (301)..(301): a, c, t, g, unknown or other
  modified_base (437)..(437): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctattaaatggtatcagcaagaaaccagggaaacncccccaaatcctagatacaattangcatcctagtttgacaaaggtcgggtaccccatcaagtattcaggtggcgggtagactcgtagggacagtactttcactctacacatacaactgtcctagctagattgaaggtattatcgtactaatttattacgngtcagtctaagtcgttacccgacgtacccccgtcttaccgtacggtttaccgggggaccgggggtaaaaccctaagggtaccggaccgttaacgaaaacggtacgttaggtacggcttacggaccaacgttacg

SEQ ID NO: 414643 - DNA, 575 bp, Homo sapiens
  misc_feature: GZ8MTXP02H0A3P.8.49.E05.1.454.CMB.2.raw
  modified_base (225)..(225): a, c, t, g, unknown or other
  modified_base (394)..(394): a, c, t, g, unknown or other
  modified_base (404)..(404): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgaccccagtctcccgccctccctgtctgcatctgtaggagacagagtcaccatcacttgccggnaagtcagagcattggcactacttaattggtatcagcaagaaaccgaggggaaacacccccaaactccctagactacaattatgactatccagtttgacgaaaggttcggggtacccccataccaagattcgaggttaggcgggtgatcgtaggggacagtatttcactntcacatacanagtctgcagtagttagagtatttatagtacttaaactttattactgtaccagtacgtagtacgttaccgacggacccccgtcgttaccgtacggtttaccggggacgggggaacctaaacgggtacggaaccgtaacgaaacgtaacgtaggtcgacgtacgacctactac

SEQ ID NO: 414644 - DNA, 606 bp, Homo sapiens
  misc_feature: GZ8MTXP02HJL28.8.49.E05.1.454.CMB.2.raw
  modified_base (469)..(469): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtcctccgccctccctgtctgcatctgtaggagacagagtcaccatcacttgccgggcaagtcagagcatggcactactaaatggtatcagacaagaaaccgaagggaaacgacccccaaactcctagatacaattatgactactccgtagtttcgacaaaacggtcggggtacccataccaagtacttcgagggtgggcgggttggaacttcgtaggggaacctaggtacttttcaaccttctaccgaccctaataccaaactacggtctacgacgaagtattaggaaggtatttancgacttaaacttattactgacgtagcgtaagtacgtaccgaccggacccgtcttaccgtaccggtttcgggggaccgggggtaacctaaaggtacggaaccgttaacgaaacgtacgttacggcggacgtcgaaccg

SEQ ID NO: 414645 - DNA, 549 bp, Homo sapiens
  misc_feature: GZ8MTXP02FGFAL.8.49.E05.1.454.CMB.2.raw
  modified_base (223)..(223): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccggnaagtcagagcattggcacctacttaaatggtatcagcagaaaccaggaaagcccccaaatcctagatcaaattatgcatcctagtttgcaaagtggggtcccccagtcaagattcagtggcgtggatcgtgggacagattcactctcaccatcaactgtctgcagattgaggtattatgacaacttattaactgtactagcagacgttaccacggaaccccgcttaccacgttttaccgggaccgggggtaaccgtaaaacgggttcgggaacgttaaccgaaaaacggtaaccgttaggttacggactacggaccaaccttaacg

SEQ ID NO: 414646 - DNA, 582 bp, Homo sapiens
  misc_feature: GZ8MTXP02JXG19.8.49.E05.1.454.CMB.2.raw
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgccctccctgtctgcatctgtaggagacagagtcaccatcacttgccggcaagtcagagcattggcacctacttaaattggtatcagcagaaaccaggaaacgcccccaaactcctgatcaaattatgcactccagtttgacaaaggtggggacccccatcaagattcagtggcggtggatcgtgggacagactttcactctacacatcaacagtctgcagattagaggattatgactaaatttacttactagttacaggtactaacggtaacgtttcccgaaacgggacccccgtacgttacccgtacggttttacccgggggaccggggggtaaacctaaaacgggttcgggaaaccggttaccgaaaaccggtaaccgtggtacgggtctcggaccaccgtaacg

SEQ ID NO: 414647 - DNA, 634 bp, Homo sapiens
  misc_feature: GZ8MTXP02IBV6D.8.49.E05.1.454.CMB.2.raw
  modified_base (228)..(228): a, c, t, g, unknown or other
  modified_base (237)..(237): a, c, t, g, unknown or other
  modified_base (297)..(297): a, c, t, g, unknown or other
  modified_base (351)..(351): a, c, t, g, unknown or other
  modified_base (389)..(389): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtcctccgccctccctgtctgcatctgtaggagacagagtcaccatcacttgccggnaagtcagancatgcactactaatgatcagcaagaaccaggaaacgacccccaatcctagatacaattancgacactaccgtagtttcgacgtaaacggtccgggtaccatacgaagtattcgngggtgggacggtaggtatcggtgggtacagtactttanaccttctaccaacgactacgaaacctgtctacgacaagttattaggaaggttaatttagtacgtacttaaactttacttaacgttggtacacggtacgtaacgttacgttaccccggaaccggtccccctaaccggttccgttaaaccggggttaccgggggtaacccgggggtaaccgtaaacggggttaccggaaaccgttaaaccggaaaacggtaccgtgggtacggtacgtcggtaaccc

SEQ ID NO: 414648 - DNA, 698 bp, Homo sapiens
  misc_feature: GZ8MTXP02JDTJL.8.49.E05.1.454.CMB.2.raw
  modified_base (203)..(203): a, c, t, g, unknown or other
  modified_base (226)..(226): a, c, t, g, unknown or other
  modified_base (261)..(261): a, c, t, g, unknown or other
  modified_base (282)..(282): a, c, t, g, unknown or other
  modified_base (312)..(312): a, c, t, g, unknown or other
tcagctcgcgtgtccacgaccggtgctcgatttagagcgactagcaacgacacaaagggggcaggagtcagtctcagtcaggacacagcatggacatgagggtccccgctcagctcctggggctcctgctactctggttccgaggtggcagatgtgacatccagatgacccagtctccgccctcctgtctgcatctgtagganacagagtcacatcacttgccggnaagtcagagcagttcggcacctattaaatggtatnagcagaaaccgagggaaaccncccccaaactcctagactacgtaaattacncgacctacttcccgtaagtttacgaaccgtaaaacgggttccggggtaccccctagttaccaaaacggttactttaccggaagggttcgggggtacgggttacggggtaaacttccgggtagggggtaaccctaagggttaaccttttacccgacttacccttaccgaacctaactaccgtaaactccgtacgtgactagtagtttaggaaggttatttacgtgtaaccttaactttagtacgtgttacgagtactaacggttactaccgtacggtacccgtcgttaccggtaccggtttaccgggggaccgggggtaacctaaacgggtcggtaacccgtaacgtaaaccggtacgttacggtacggtacttccggacttaaccg

SEQ ID NO: 414649 - DNA, 655 bp, Homo sapiens
  misc_feature: GZ8MTXP02JQ93M.8.49.E05.1.454.CMB.2.raw
  modified_base (223)..(223): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccggnaagtcagagcattggcacctacttaaattggtatcagacaagaaaccgagggaaacgacccccaaactcctagaactacaaattatgactatcctagtttgaccgtaaaggtcggggtaccccccagtacaaagtacttcgaggttgggcgggttaggatccgtaggggactaggtatttccacttctaccacctatacaaactagtctagactaagtagttaggaagtatttatgacttaaactttattaacctgtacctaggtacgtaagtaccggtttacccgaacggtacccccgtacgttacccggtaaccgggtttaccggggggaacccgggggttaaaccgtaaaacggggtaccgggtaacccgttaaacggaaaaccggtaaacgttcggtacgggtaccgttacgaacccgacctttaacg

SEQ ID NO: 414650 - DNA, 627 bp, Homo sapiens
  misc_feature: GZ8MTXP02H9VJK.8.49.E05.1.454.CMB.2.raw
  modified_base (104)..(104): a, c, t, g, unknown or other
  modified_base (198)..(198): a, c, t, g, unknown or other
  modified_base (222)..(222): a, c, t, g, unknown or other
  modified_base (231)..(231): a, c, t, g, unknown or other
  modified_base (271)..(271): a, c, t, g, unknown or other
  modified_base (293)..(293): a, c, t, g, unknown or other
tcagctcgcgtgtccacgaccggtgctcgatttagagcgactagcaacacacaaagggggagtcagtctcagtcaggacacagcatggacatgagggtccccgntcagctcctggggctcctgctactctggctccgaggtggcagatgtgacatccagatgacccagtctccgccctcctgtctgcatctgtagganacagagtcaccatcacttgccggnaagtcagancattggcacctattaaatggtatcagcagaaccaggaacnccccaaatcctgatacaattancgcatccagtttgactaaaggtcggggtcccccatcgaagtacttacgaggttgggcggtggtatccggtggggaactaggtattttaccgacttcacaaccattaccaaacgtagtcctagacctaaggtactttaggaaggtatttaacgcggtaccttaaaaccttttagttacgtcggtactaagtccgtaacggtcgtttacccgacgggttaaccccctcgttaccgtaccggttttcgggggaacccgggggtaacctaaacggggtacggtaacccgtaacgaaaaccggtaacgtcggtacggtaccgtcggactaacccgtacg

SEQ ID NO: 414651 - DNA, 591 bp, Homo sapiens
  misc_feature: GZ8MTXP02G4FYB.8.49.E05.1.454.CMB.2.raw
  modified_base (227)..(227): a, c, t, g, unknown or other
  modified_base (292)..(292): a, c, t, g, unknown or other
  modified_base (446)..(446): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtctccgccctcctgtctgcatctgtaggagacagagtcaccatcacttggccggnaagtcagagcatgcactataatgatcagcaagaacaggaacaccccaaatcctagatacaattancgactactcctagtttagacgaaacgggttcggggtacccagttaccgaaagtactttacgagggttcgggaccgggttaggtactccgggtagggtactagtactttcaacttcacacatacaaactgtactgactagtattgaagtacttancgtactaaacttattaactgtacagtacgaggtacgttaccgacgtacccacgttacgtacggttacggggaccgggggtaacctaagggttacggaaccgttaacgaaaaccggtagtacggttcggaccgttacggtaacccc

SEQ ID NO: 414652 - DNA, 560 bp, Homo sapiens
  misc_feature: GZ8MTXP02IGZX4.8.49.E05.1.454.CMB.2.raw
  modified_base (199)..(199): a, c, t, g, unknown or other
  modified_base (231)..(231): a, c, t, g, unknown or other
  modified_base (303)..(303): a, c, t, g, unknown or other
  modified_base (355)..(355): a, c, t, g, unknown or other
  modified_base (370)..(370): a, c, t, g, unknown or other
  modified_base (389)..(389): a, c, t, g, unknown or other
  modified_base (393)..(393): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtagganacagagtcaccatcacttgccggcaagtcagngcattggcactacttaaattggtatcagcaagaaaccgagggaaacacccccaaactcctgactacaattangcatcctagtttgactaaaggtcggggtaccccatacaagtatcgagtgggnggtgagtcgtggacngtacttcactctacactancaanagtctgacaagtattagagtattatacgacttaaacgtttattacgtgtacagtacgtagtacgttaccaccgtacccgtcgttaccgtaccggtttcgggggaaccgggggacctaaaacggtacggtacgtaaccgaaacgaactcggtacgcgtacgacaactc

SEQ ID NO: 414653 - DNA, 652 bp, Homo sapiens
  misc_feature: GZ8MTXP02JFZUV.8.49.E05.1.454.CMB.2.raw
  modified_base (277)..(277): a, c, t, g, unknown or other
  modified_base (300)..(300): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctcctgtctgcatctgtaggagacagagtcaccatcacttgccgggcaagtcagagcagttggcacctacttaaatggtatcagcaagaaaccagggaacncccccaaatcctagatcaattangcatcctagtttgacgtaaaggtcgggtaccccctataccgaaagtacttacgaggttagggtccgggtaggtacgttcggtaggggactacggtaactttcgaccttctaccctaaccacttaccaaacgtacgttctagacgtaagtagtttaggaaaggttaatttaagtcgtaactaaaccgttttaattacctaggttacaacggtaccgtaaggtacgttacccgaacgggtaccccgtacgtaccgttacgggtttacccgggggaacgggggtaaacctaaacgggttacggaaccgttaacgaaaacggtacgtacggtacggaactcggaccgtacgtaacg

SEQ ID NO: 414654 - DNA, 657 bp, Homo sapiens
  misc_feature: GZ8MTXP02HIC3J.8.49.E05.1.454.CMB.2.raw
  modified_base (198)..(198): a, c, t, g, unknown or other
  modified_base (222)..(222): a, c, t, g, unknown or other
  modified_base (250)..(250): a, c, t, g, unknown or other
  modified_base (288)..(288): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctcctgtctgcatctgtagganacagagtcaccatcacttgccggnaagtcagagcatgcactacttaatgatnagcagaacaggaacaccccaaactcctagatacattangacatcctagtttcgacgtaaaggtcgggtaccccctagtacgaagtacttacgaggtaggtaccgtagttaggtaacgttccggtaggggtaacgtagttacgtttaccgtaaccttacctaccctaaccctattaacccaaacgtaccgtactacgtaccgtagtacgtttagggaaggttaatttacgttacggtacttaaaacgttttacttaacgttacgttaccgaagtacgtagtaccgttaccgaacccggtaccccgtcgttaccgttaccggtttacgggggaaccgggggtaaccgtaaacgggttacggaaccggttaaccgaaacgtacgtacggtacgaccgtacgacctaaccg

SEQ ID NO: 414655 - DNA, 544 bp, Homo sapiens
  misc_feature: GZ8MTXP02JBU96.8.49.E05.1.454.CMB.2.raw
  modified_base (226)..(226): a, c, t, g, unknown or other
  modified_base (234)..(234): a, c, t, g, unknown or other
  modified_base (252)..(253): a, c, t, g, unknown or other
  modified_base (255)..(255): a, c, t, g, unknown or other
  modified_base (271)..(271): a, c, t, g, unknown or other
  modified_base (282)..(282): a, c, t, g, unknown or other
  modified_base (292)..(292): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctcccgccctccctgtctgcatctgtaggagacagagtcaccatcacttggccggnaagtcagncatgcactataaatgtannancaagaacgaggaaccnccccaaatccngatacaattngacactctagtttgacaaaggtcgggtaccccatacaagtacttcgagtggcgtagtggatcgtagggacagtattacactctacacatacaacagtctgactagacttaggagttatagtcgaaccttaatttactaactgtacgagactagtacgttaccgaacgggtccccacgttcgtacggttacggggacggggtaaccaaggtcgaaacgtaacggaaaactacggtggtcggactcgtacaacg

SEQ ID NO: 414656 - DNA, 608 bp, Homo sapiens
  misc_feature: GZ8MTXP02G6Y03.8.49.E05.1.454.CMB.2.raw
  modified_base (230)..(230): a, c, t, g, unknown or other
  modified_base (298)..(298): a, c, t, g, unknown or other
  modified_base (466)..(466): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtcctccgccctccctgtctgcatctgtaggagacagagtcaccatcacttggccgggnaagtcagagctagttggccaccttaacttaaattggtatacgagacaacggaaaaccaggggaaaccnccccctaaaatccctagaatacaatttatcgacactacctaaggtttcgaacgtaaacggtcggggtacccagtacaaagtattcgagggtcggcgggtagtagtcgtagggactagtacttcgactctacactatacaactcgtctgacagtagtagtaagatttancgtaacttaacttacttacgtatacgagtctaagtccgttaccgaccggaccccgtctaccgtacggttccgggggacggggtaaccgtaacgggtacggaaccgtaacgtaaacggtacgtcggtacgtacgtacgaaccg

SEQ ID NO: 414657 - DNA, 726 bp, Homo sapiens
  misc_feature: GZ8MTXP02HSAGU.8.49.E05.1.454.CMB.2.raw
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgccctcctgtctgctatctgtaggagacaggactcaccatctacgttggccggacaagtcagagctaagttcggacctaaccttaactttaaaagttgggtaactacaagaccgaaacggaaaacccgaaggggtaaaacccaccccccctaaaacgttcccgtagaactacgtaaattacgtcgtacctaccgttacgttagttacgaaaggttacgggtaccggtaccctagtaacgacgttactcggtacgggtcgggtacgggtagtacgtagggtaccgagttacgtttacttactaccttacacccgtaactaaactaacctaacgttacgtaccgtagtaacgttaagttagtaaggttaagttatttacggaaccgttaatttaacgtttaactacggttactaacgacggtacgtagttaccccgtacgaccccggtacccgtactacggggtttaccggaccgggggaaacggtaaacttacgggaacggtaccgtaaaacgtaacgtcgtaacggtcggacgtaccaaacgttcgttaccg

SEQ ID NO: 414658 - DNA, 776 bp, Homo sapiens
  misc_feature: GZ8MTXP02IFWXS.8.49.E05.1.454.CMB.2.raw
  modified_base (205)..(205): a, c, t, g, unknown or other
  modified_base (210)..(210): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtcctcccgcctccctgtcctgcatctgtagganacagntcacatcattggccggacaagtcagagctagttggctaactacttaaatggtatacgagacaaacgaaaccgagggaaaccacccccaaatccctagatacctaaatttcgcgactacttcccgtaaggtttcgacgtaaacgggtttccgggaccccctaatacggtaaaagttacgttaccagggggttcggggtcggttacggggtaactttccggggtagggggaaacctaggttaacctttaccaaccttttaccctaccaaaccctaacgttaaaccaaccgtacgttacgtaccgagtaagttatttacgggtaaaggtatttaagtacggtaaccctttaaagtttaccgttaaatttcggaacgttaaccgacgtaacggttacccgttaaccccgacccgggtaacccccgttccttaaccggtttaacccggggtttaccgggggaacccgggggtaaaaccccgttaaaagggtacccggggtaaaaccggtttaaaacccgaaaaacggggttaaccctaggggtttaccgggacccttaaacggtacccccg

SEQ ID NO: 414659 - DNA, 540 bp, Homo sapiens
  misc_feature: GZ8MTXP02GE8U1.8.49.E05.1.454.CMB.2.raw
  modified_base (223)..(223): a, c, t, g, unknown or other
  modified_base (232)..(232): a, c, t, g, unknown or other
  modified_base (274)..(274): a, c, t, g, unknown or other
  modified_base (296)..(296): a, c, t, g, unknown or other
  modified_base (391)..(391): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccggnaagtcagancattggcactacttaaatggtatcagcagaaaccagggaacnccccaaatccagatctaattangacatcctagtttcgactaaaggtcgggtaccccatcaagtattcgagtgggcggtagagtcgtagggactagtatttcactctacacatacaanagtcagactagtattgaacgtattatagacttaacttattactgtacagcgtagtacgtaccgacggacccctcgtaccgtacggttcggggacggggaactaacggtcggaacgtacgaaaacgacgtggcggtctacgacacgtacg

SEQ ID NO: 414660 - DNA, 654 bp, Homo sapiens
  misc_feature: GZ8MTXP02G2753.8.49.E05.1.454.CMB.2.raw
tcagctcgcgtgtccacgaccggtgctcgatttagagcgactagcaacacacaaagggggcaggagtcagtctcagtcaggacacagcatggacatgagggtccccgctcagctccgtggggctcctgctactctggctccgaggtggcagatgtgacatccagatgacccagtctcccgccctcctgtctgcatctgtaggagacagagtcaccatcacgttcggaccgggacaagtcaaggagctagttcggacctaaccttaacttaaagtttggtaatacgacgacaagaaaacccgaaggggaaaccacccccaaaactcctagactactaaattacgtacgactactaccgtagtttacgacgtaaacgggttccgggtacccatacgaaagtacttcgaggtcgggacggtaggtactcggtagggacagttattccacttacactacactacaacagtctagacagtacgttaggaagttattagacgtaacttaaactttacttacgtacgttacaacgtacgtaacgtacgttacccgaaccggtaccccgtacttaccggttaccggttaccgggggaccggggtaaaccgtaaggtacggaaccgtaacgaaaaccggtactcggttacgacgtaccgaacc

SEQ ID NO: 414661 - DNA, 515 bp, Homo sapiens
  misc_feature: GZ8MTXP02F2IK4.8.49.E05.1.454.CMB.2.raw
  modified_base (199)..(199): a, c, t, g, unknown or other
  modified_base (232)..(232): a, c, t, g, unknown or other
  modified_base (248)..(249): a, c, t, g, unknown or other
  modified_base (251)..(252): a, c, t, g, unknown or other
  modified_base (264)..(264): a, c, t, g, unknown or other
  modified_base (270)..(270): a, c, t, g, unknown or other
  modified_base (273)..(273): a, c, t, g, unknown or other
  modified_base (279)..(281): a, c, t, g, unknown or other
  modified_base (290)..(290): a, c, t, g, unknown or other
  modified_base (317)..(317): a, c, t, g, unknown or other
  modified_base (377)..(377): a, c, t, g, unknown or other
tcagctcgcgtgtccacgaccggtgctcgatttagagcgactagcaacacacaaaggggggagtcagtctcagtcaggacacagcatggacatgagggtccccgctcagctcctggggctcctgctactctggctccgaggtggcagatgtgacatccagatgacccagtctccgccctcctgtctgcatctgtagganacagagtcaccatcacttggccggcaagtcagngcatgcactataatgnnannagaacaggaacncccaancanatcatnnnatctagttnactaaaggtcggtaccccatcaaagtntcgaggttggcggtagactcgtagggactagtattcactctacacgtatacaactagctnatagtattgaagtatagtactactaattataactgacgagtcgaagtcgtaccgaccggtacctccgtagtccggttacgggacggggaactacggtacgacgtaacaaacgtacgcggtacggctacgaccactaac

SEQ ID NO: 414662 - DNA, 880 bp, Homo sapiens
  misc_feature: GZ8MTXP02FSS8R.8.49.E05.1.454.CMB.2.raw
  modified_base (222)..(222): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcacatcacttgccggnaagtcagagcattggcactacttaatggtatcagacaagaaaccgaagggaaaccacccccgaaactccctagaactacctaaatttagtcgacctaactacccgtaaggttttacgaacgtaaaaacgggttcgggggtacccccccaaagttaccgaaaaggtactttaccggaaaggggttcggggtccggggttaggggtaacgtttaccgggtaggggggtaaaccctaaaggggtttaaacctttttacccgtaaacccgtttacccttaacccctaaacccgtaaacgttaacccctaaaaaccgtaaccggttaccctttaacgggaacccgttaaagggttaaacgttttagggtaaaacgggggtttaaacgttttaaattaacgggttaaacctttaaaaacccgtttttaagttttaaacccttaggtttaacgaacggtacgttaaacggttaaccggtttaacccccggaaaccggggtacccccccgtaccgtttacccggttaaacccggggttttaccggggggaaaccccggggggttaaaccgtaaaacgggggttaccgggtaaacccggtaacccggtaaaaaccggtacggttacgggtaccgggtacgtttaccggaccctaacccggtttaacg

SEQ ID NO: 414663 - DNA, 588 bp, Homo sapiens
  misc_feature: GZ8MTXP02H2BDN.8.49.E05.1.454.CMB.2.raw
  modified_base (201)..(201): a, c, t, g, unknown or other
  modified_base (228)..(228): a, c, t, g, unknown or other
  modified_base (282)..(282): a, c, t, g, unknown or other
  modified_base (308)..(308): a, c, t, g, unknown or other
  modified_base (425)..(425): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtcctccgccctccctgtctgcatctggtagganacagagtcaccatcacgttggccgganaagtcagagcattggacactaacttaaattggatcagcaaggaaaccaggaacncccccaaatcctagactacaatttancgactataccgagtttgacgaaaggtcggtacccccataccaagtctgaggtgggcggtgtatcgagggtacagtactttcactctccaactatacaagtacgtcgtagactaagtnttagaggttattacgtacgtactaaactttagtacttgtacgaacgtcgaagtaccgttaccgaccgggtaccctcgttaacgtccggggtttacgggaccgggggaaacctagggtaccggaactacgtaaaacgcgtaggtcgacgtacgacctaacgtcg

SEQ ID NO: 414664 - DNA, 675 bp, Homo sapiens
  misc_feature: GZ8MTXP02G802I.8.49.E05.1.454.CMB.2.raw
  modified_base (471)..(471): a, c, t, g, unknown or other
  modified_base (481)..(481): a, c, t, g, unknown or other
tcagctcgcgtgtccacgaccggtgctcgatttagagcgactagcaacacacaaagggggagtcagtctcagtcaggacacagcatggacatggagggtccccgctcagctcctggggctcctgctactctggctccgaggtggcagatgtgacatccagatcgacccagtcctcccgccctccctgtcctgcatctgtaggagacaggatcacatcacgttcggcccgggacaagtcagagctagttggacctaaccttaacttaaaagttggtaactacaagacgaaacggaaaaccgaaacggggtaaaacccgacccccctaaaactcccgtaagtaactaactaaattatcgactacttaccgtagtttacgaacgtaaacgggtcggtacccctaagtacctaaagtacttcgaggtcgggtggtacgtgtacggtaggactagtactttcaactctaccactanaccaaacgtntcgtacgacgtaagtagttagaggttattaacgtacgtaacttaaactttacttaagtacgtactacgagtaaacgtccgttaaccgaacccgtcccgtaccgtacccggtaacgggttccgggggaccgggtaaacgacggttacggaacgtaaacgaaaacggtcgtaacggtcgtaccgcgtacaacgtcg

SEQ ID NO: 414665 - DNA, 632 bp, Homo sapiens
  misc_feature: GZ8MTXP02JRM4R.8.49.E05.1.454.CMB.2.raw
  modified_base (228)..(228): a, c, t, g, unknown or other
  modified_base (263)..(263): a, c, t, g, unknown or other
  modified_base (313)..(313): a, c, t, g, unknown or other
tcagctcgcgtgtccacgaccggtgctcgatttagagcgactagcaacacacaaagggggagtcagtctcagtcaggacacagcatggacatggagggtccccgctcagctccgtggggctcctgctactctggctccgaggtggcagatgtgacatccagatgacccagtcctccgccctccctgtcctgcatctgtaggagacagagtcaccatccattggcgganaagtcagagcattggctacctacttaaatggtatnagacaagaaaccagggaaaccaccccctaaatccctagaatactaattangctatacctagttacgacgtaaaggtcggggtacccccagtaccaagtacgtttcgaaggttcgggcggggttagtacgttcggaggggaactaggttactttacctacttcctacaaccataaccaactagtctagactaagtagttaggaggtacttagagtaccttaatttagttacctagttacagtacgtaagtaccgttacccggaacggtacccctccggtacgttaaccgggttccgggggaaccgggggtaaactaaacgggttcggtaaccgaaagaaccgtaacgtgacggtacacggaccaccgtag

SEQ ID NO: 414666 - DNA, 725 bp, Homo sapiens
  misc_feature: GZ8MTXP02GPF4M.8.49.E05.1.454.CMB.2.raw
  modified_base (233)..(233): a, c, t, g, unknown or other
  modified_base (238)..(238): a, c, t, g, unknown or other
  modified_base (242)..(242): a, c, t, g, unknown or other
  modified_base (573)..(573): a, c, t, g, unknown or other
tcagctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatcgacccagtcctcccgccctcctgtctgcatctgtaggagacagagtccaactatccacgttcggaccgganaagtnaggngactagttggacctaaccttacttaaaagttggtactacgaacgacaaacggaaaacccgaacggaaacccgaacccccaaaacgttcctagtaactactaaactttacacgacctactaccgttaaggtttacggaacggtaaacgggttaccggggtacccctaacgtaaccgtaaaggttaaccgtttacggaacggggttccggggtacggggtagggtacgttacccgggtaggggtaacctacggttacttttacccacttaccctaacgtaacccctaaataacccggtaatacgtctagtagagtaagtgaaaggtatttaanacgtaacttaacgtttatcgaacttgagtacgtaacgtccgttacccgaaccgggtcccctacgtcccggttacgggtaccggggacgggtaaaacgtacgacgtaacgtaacaaacggtacgttcggacgacgtaccggacctaacgttcc

SEQ ID NO: 414667 - DNA, 605 bp, Homo sapiens
  misc_feature: GZ8MTXP02GN4XL.8.49.E05.1.454.CMB.2.raw
  modified_base (208)..(208): a, c, t, g, unknown or other
  modified_base (237)..(237): a, c, t, g, unknown or other
  modified_base (245)..(245): a, c, t, g, unknown or other
  modified_base (306)..(306): a, c, t, g, unknown or other
  modified_base (318)..(318): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatcgacccagtcctcccgccctccctgtctgctatctggtagganacagacgtcacctatcacgttggccgganaagtcagnctagtcgactacttactaagtgtatcagacaacgaaccgaggaaaccacccctaaatctanactactaattancgactactacgtagttacgacgtaacggtccggtaccagtaacgaatacgttcgagggtcggacggtagacttcggagacctagtacttcacgtcacactatacactagtcgtaagagtagttagagttaattagtacgtaacttaacgtttatacgtgtacgagtacgtaacggtcgtaccgaccgtacccctcgtaccgttaccgggtacggggaaccggtaacgtaacggtacggtaaaccgtaacgtaaacggtacgttcggacgtacgtacggacctaaccg

SEQ ID NO: 414668 - DNA, 572 bp, Homo sapiens
  misc_feature: GZ8MTXP02GID9M.8.49.E05.1.454.CMB.2.raw
  modified_base (365)..(365): a, c, t, g, unknown or other
  modified_base (488)..(488): a, c, t, g, unknown or other
  modified_base (566)..(566): a, c, t, g, unknown or other
tcagctcgcgtgtccacgaccggtgctcgatttagagcgactagcaacacacaaagggggcaggagtcagtctcagtcaggacacagcatggacatgagggtccccgctcagctcctggggctcctgctactctggctccgaggtggcagatgtgacatccagatgacccagtcctccgccctccctgtctgcatctgtaggagacagagtcaccatcattcgccggcaagtcagagcattggctactattaaattgtatcagcaagaaaccaaggaaacgcccccaaactccctagatacaatttatgctatccagtttagacaaacggtcggggaccctataccaagtacttacgaggtcggnggtggtaagtcgtaggggacacgttagtttaccattctacactaactacacagtctgactagattggaaggtacttagactactaacttaattacttgcagatacgtactcaccgggtacccnttaccgtaccgtttacggggccgggggtaactaaaggtccggtaaacgtaccggaaacgtacgtcggttacggacgtnaacccg

SEQ ID NO: 414669 - DNA, 496 bp, Homo sapiens
  misc_feature: GZ8MTXP01CPLP0.11.3.A03.1.454.CMB.2.raw
  modified_base (327)..(327): a, c, t, g, unknown or other
  modified_base (350)..(350): a, c, t, g, unknown or other
  modified_base (481)..(481): a, c, t, g, unknown or other
  modified_base (486)..(496): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgcccccaaactcctcatatatggtaacagcattcggccctcaggggtccctggccgattctctggctcgaagtctggcacctcagccctcctggcctgcagtggctccagtctgaggatgaggctgactattatgngcaggcgtgggatgacggtctgngtgctgtcggtcttggggcggagggaccaagctgaccgtccgtggggtcacggcccaaggcctcgcccctcggtcacgtctcgttccccacctcctcgtctctctcgctgacgcgggctggcaacggcgcnttagnnnnnnnnnnn

SEQ ID NO: 414670 - DNA, 473 bp, Homo sapiens
  misc_feature: GZ8MTXP01ARX6U.11.3.A03.1.454.CMB.2.raw
  modified_base (357)..(357): a, c, t, g, unknown or other
  modified_base (463)..(463): a, c, t, g, unknown or other
  modified_base (468)..(473): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattatactgtcagtcctttgacattaaactggatgtggtnttcggcggagggaccccagtaaccgtctaggtcagcccaaggctcgcccctcggtcactctcgttcccacctcctcgtatctctcgctgagcggctggcaagggcncatgnnnnnn

SEQ ID NO: 414671 - DNA, 464 bp, Homo sapiens
  misc_feature: GZ8MTXP01BOKQU.11.3.A03.1.454.CMB.2.raw
  modified_base (350)..(350): a, c, t, g, unknown or other
  modified_base (456)..(456): a, c, t, g, unknown or other
  modified_base (459)..(464): a, c, t, g, unknown or other
tcagcgagagataccacgaccggtgctcgatttagagagcgtcacagggtcctgggcccagtctgtgctgacgcagccgccctcagtgtctgggcccagggcagacggtcaccatctcctgcactggaaacagctccaacgtcggggcaggttatgatgttcactggtaccagcaccttccacaaacagccccaaactcctcatatatggtaacagcattcggccctcaggggtccctgaccgattctctggttccttgtctgacactcagcctccctgccatcactggctccagcctgaggatgaggctgattatactgtcagtcctttgacattaaactggatgtgtnttcgggcgagggacccagtaaccgtctaggtcagcccaaggccttcccctcggtcactctcgtcccgccctcctcgtactctctcgctgagcggctggcaggcgcntgnnnnnn

SEQ ID NO: 414672 - DNA, 479 bp, Homo sapiens
  misc_feature: GZ8MTXP01AOJT3.11.3.A03.1.454.CMB.2.raw
  modified_base (349)..(349): a, c, t, g, unknown or other
  modified_base (359)..(359): a, c, t, g, unknown or other
  modified_base (409)..(409): a, c, t, g, unknown or other
  modified_base (470)..(479): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagccctccctggccatcactggctccagcctgaggatgaggctgattatactgtcagttcctttgacatttaaacnggatgtggtnttcgggcggaggaccccagtaaccgtctagtcagcccaaggccttccccngtcactctcgttcccgccctctcgtactcgtctcgctgacgtcgggctggcaggcgcatgnnnnnnnnnn

SEQ ID NO: 414673 - DNA, 475 bp, Homo sapiens
  misc_feature: GZ8MTXP01EHEPN.11.3.A03.1.454.CMB.2.raw
  modified_base (355)..(355): a, c, t, g, unknown or other
  modified_base (462)..(462): a, c, t, g, unknown or other
  modified_base (469)..(475): a, c, t, g, unknown or other
tcagcgagagataccacgaccggtgctcgatttagagagcgtcacagggtcctgggcccagtctgtgctgacgcagccgccctcagtgtctgggccccagggcagacggtcaccatctcctgcactggaaacagctccaacgtcggggcaggttatgatgttcactggtaccagcaccttccacaaacagcccccaaatcctcatatatggtaacagcattcggcctcaggggtccctgaccgattctctggttccttgtctgacacctcagcctccctggccatcactggctccagcctgaggatgaggctgattattactgtcagtcctttgactattaaactggatgtggtnttcgggcggagggaccccagtaaccgtctaggtcagcccaaggctcgcccctcggtcactctcgttcccaccctctcgtactctctcgctgagcggctggcaaggcncataagnnnnnnn

SEQ ID NO: 414674 - DNA, 484 bp, Homo sapiens
  misc_feature: GZ8MTXP01DYWNF.11.3.A03.1.454.CMB.2.raw
  modified_base (464)..(464): a, c, t, g, unknown or other
  modified_base (475)..(484): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgcccccaaactcctcatatatggtaacagcattcggccctcaggggtccctgaccgattctctggttccttgtctgacactcagcctccctggccatcactgggctccagcctgaggatgaggctgaattattactgtcagtccttttgactaattaaacgtggtatgtggttgtcgggcgggaacgggaccccacggtaaccgtctaggtcagcccaaggctcgcccctcgtcactctcgttcccgccctctcgtatctctcgctgagcggntggcaagcgannnnnnnnnn

SEQ ID NO: 414675 - DNA, 476 bp, Homo sapiens
  misc_feature: GZ8MTXP01BGPF6.11.3.A03.1.454.CMB.2.raw
  modified_base (458)..(458): a, c, t, g, unknown or other
  modified_base (468)..(468): a, c, t, g, unknown or other
  modified_base (473)..(476): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacggtcggggcaggttatgatgttcactggtaccagcaccttccaacaaacacgcccccaaactcctcatatatggtaacagcattcggccctcgacggggtccctgaccgtattctctggttccttgtctgacacctcagcctccctggccatcactggctccagcctgagatgagctgattattactgtcagttccttgactattaaactggatgtggtgttcggcgggacgggacccacgtaaccgtcgtagtcacgccaaggctcgcccctcggtcactctcgtcccgcctcctcgtctctctcgctgcgcggntcggcaggcncatgnnnn

SEQ ID NO: 414676 - DNA, 483 bp, Homo sapiens
  misc_feature: GZ8MTXP01C16O6.11.3.A03.1.454.CMB.2.raw
  modified_base (310)..(310): a, c, t, g, unknown or other
  modified_base (423)..(423): a, c, t, g, unknown or other
  modified_base (443)..(443): a, c, t, g, unknown or other
  modified_base (460)..(460): a, c, t, g, unknown or other
  modified_base (467)..(483): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgccccccaaactcctcatatatggtaacagcattccggccctcgaggggtccctgaccgtattctctggttccttgtctgacactcagcctccctgccatcactggctccagcctgagntgaggctgtattattactgtcagttcctttgactattaactggatggtgtgttcgggcgggaggaccccagtaccgtctagtcagccagctcgcccctgtcactctcgtcccncctctcgtctctctcgctgngcggctcggctaaggcnctatcgnnnnnnnnnnnnnnnnn

SEQ ID NO: 414677 - DNA, 483 bp, Homo sapiens
  misc_feature: GZ8MTXP01D7N5L.11.3.A03.1.454.CMB.2.raw
  modified_base (357)..(357): a, c, t, g, unknown or other
  modified_base (466)..(466): a, c, t, g, unknown or other
  modified_base (471)..(483): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccaacaaacacgcccccaaactcctcatatatggtaacagcattccggccctcgaggggtccctgaccgtattctctggttccttgtctgacacctcacgccctccctggccatcactggctccagcctgaggatgaggctgatttattactgtcagttcctttgactattaaacnggatgtgtgtcgggcggaggacccacgtacgtctaggtcagccagctcgcccctcggtcactctcgttccccgcctcctcgtactctctcgctgcgcggctggcaggcncatgnnnnnnnnnnnnn

SEQ ID NO: 414678 - DNA, 479 bp, Homo sapiens
  misc_feature: GZ8MTXP01EH118.11.3.A03.1.454.CMB.2.raw
  modified_base (360)..(360): a, c, t, g, unknown or other
  modified_base (450)..(450): a, c, t, g, unknown or other
  modified_base (466)..(466): a, c, t, g, unknown or other
  modified_base (468)..(468): a, c, t, g, unknown or other
  modified_base (473)..(479): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgcccccaaactcctcatatatggtaacagcattccggcctcaggggtccctgaccgattctctggttccttgtctgacacctcacgcctccctggccatcactgggctccagcctgaggatgaggctgatttattactgtcagtcctttgactattaaactgatgtgtnttcgggcgaggacccacgtaacgtctaggtcagcccaagctcgcccctcggtcactctcgttccccacccttctcgtactctctcgctgngcggctggcaagggcncntaagnnnnnnn

SEQ ID NO: 414679 - DNA, 503 bp, Homo sapiens
  misc_feature: GZ8MTXP01DD3FH.11.3.A03.1.454.CMB.2.raw
  modified_base (333)..(333): a, c, t, g, unknown or other
  modified_base (364)..(364): a, c, t, g, unknown or other
  modified_base (492)..(503): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacggtcggggcaggttatgatgttcactggtaccagccaccttccacaaacacgcccccaaactcctcatatatggtaacagcattccggccctcgacggggtccctgacccgtattctctggttccttgtctgacactcagcctcctgccatcactggctcagcctgacgatgaggctgattattactgtcngttcctttgactattaaactggatgttggtnttcgggcggagggaccccacgtaaccgtcgaggtcacgcccaagggcctcgcccctcggtccactcctcgttccccgcccttcctcgtactcctctcgctgacggcgggctcggcgaaggcgcaatgnnnnnnnnnnnn

SEQ ID NO: 414680 - DNA, 651 bp, Homo sapiens
  misc_feature: GZ8MTXP01CG51I.11.3.A03.1.454.CMB.2.raw
  modified_base (639)..(651): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcgggcaggttatgatgttcactggtaccagcaccttaccaacaaacacgacccccaaactcctacatatataggtaacagcattccggccctcgacggggtccctgaccgtattctcgttcggtttccttgtctcgaccacctcacgtccctcccgtcggccactccaccgtcgggcctccgacgcccgtaggacggtagtggacggtcttagttaatttacgttactcgtctacgtttcctttagtaactaagtttaaacgtggtagttagggttagggttaacggttccggggaccgggtaaccgggtaaccccgtaaccgggttaacccggttccgtaacgggtaccgaaccgtacccgtaacggtcccgtacccggtcccccgttcggttaccctccgttccccgttcccggttccccgtccccgttccgtccgttcttcccgttccgtccgtcgtcggacggtccggtcgacggacgtacgggcacaagnnnnnnnnnnnnn

SEQ ID NO: 414681 - DNA, 523 bp, Homo sapiens
  misc_feature: GZ8MTXP01EJWE4.11.3.A03.1.454.CMB.2.raw
  modified_base (517)..(523): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccaacaaacacgcccccaaactcctcatatatggtaacagcattcggccctcgacggggtccctgaccgtattctctggttccttgtctgacacctcacgcctccctggccatcacgtggctccagcctgagatgaggctgatttatactgtcagttcctttagactaattaaacgtggtattggttaggtaacgttcgggacgggacgggacccctacggttaacccgtcgtaaggtcacgtacccgaaggcctaccgcccccgttacggtcctactcctcgttccccaccttcctcgtactctcgtcgtctgacgcggctggcaaggcgcatgnnnnnnn

SEQ ID NO: 414682 - DNA, 659 bp, Homo sapiens
  misc_feature: GZ8MTXP01D7O1R.11.3.A03.1.454.CMB.2.raw
  modified_base (640)..(643): a, c, t, g, unknown or other
  modified_base (645)..(647): a, c, t, g, unknown or other
  modified_base (649)..(659): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatcctcctgcactggaaacagctccaacgtcggggcaggttatgatgttcactggtaccagccaccttccaacaaacacgcccccaaactcctcatatatggtaacagctattccggccctcgacggggtccctgacccgtattctcttcggtttcccttgtctgaccacctcacgccctccctggccatccaccggtcgggcctccgacgtcctaggaggtatggaggtcttagtaatttacttacgtgtacctacgtttccttttacgaactaagtttaaacgtggtagttacgggttagggtttaacggttccgggacggggtaacccgggtaaccccgtaaccggttaacccggtccgttacggtaccgaccggaccccgaacggtccctcccggtacccccgttcgggtccctaccgttcccgtacccgttccccctaccccttcccgttaccttacgttcccttccgtccgtcgtcggcggtccggggtcgtacgggacgtaacggccgacgaataagnnnngnnngnnnnnnnnnnn

SEQ ID NO: 414683 - DNA, 441 bp, Homo sapiens
  misc_feature: GZ8MTXP01D7K2O.11.3.A03.1.454.CMB.2.raw
  modified_base (302)..(302): a, c, t, g, unknown or other
  modified_base (432)..(441): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgcccccaaactcctcatatatgtctgccttcctccctgcgtcccaggcctgaggaagacctctgctatccctgctctcgacccttccttgcctcatcagtcatgacaaccncttcactctgaccgcgaggggcaggggctagattgagtgacctgtcaacgcccaaggctcgccccctggtcactctcgttcccgccctctcgtatctctcgctgcggcggctggacgaggcgacagtagnnnnnnnnnn

SEQ ID NO: 414684 - DNA, 486 bp, Homo sapiens
  misc_feature: GZ8MTXP01AMLQ0.11.3.A03.1.454.CMB.2.raw
  modified_base (371)..(371): a, c, t, g, unknown or other
  modified_base (418)..(418): a, c, t, g, unknown or other
  modified_base (476)..(486): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccaacaaacacgccccccaaactcctcatatatggtaacagcattcggccctcgaggggtccctgaccgtattctctggttccttgtctgacacctcagcctcctggccatcacgtgggcctccagcctggaggatggaggctagatttatactgtctagttcctttgactattaaacgtggtatgtgtntcgggcggacggacccacgtacgtctagcagccagctcgccctcgcnctctcgtcccacctcctctactctctcgctgcgcggctcggcgtacggcgcagtaagnnnnnnnnnnn

SEQ ID NO: 414685 - DNA, 488 bp, Homo sapiens
  misc_feature: GZ8MTXP01EHF2K.11.3.A03.1.454.CMB.2.raw
  modified_base (484)..(488): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccaacaaacacgcccccaaactcctcatatatggtaacagcattcggccctcgaggggtccctgaccgtattctctggttccttgtctgacacctcagccctccctggccatcacgtggctccagcctgaggatgaggctgtattattactgtcagtcctttgactattaaacgtggattggtggtaagttcgggacgggacgggacccacgtaaccgtctaggtcacgcccaaggctcgcccctcgtcactctcgttccccgcctctcgtactctctcgctgcgcggctggcgagcgcatgnnnnn

SEQ ID NO: 414686 - DNA, 579 bp, Homo sapiens
  misc_feature: GZ8MTXP01DS1AM.11.3.A03.1.454.CMB.2.raw
  modified_base (339)..(339): a, c, t, g, unknown or other
  modified_base (563)..(566): a, c, t, g, unknown or other
  modified_base (568)..(579): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagccaccttccaacaaaccacgaccccccaaactcctcatatatggtaaacagcattccggcccctcgacggggtccctgacccgtattctctggttccttgtctgacacctcacgcctccctggccatcacgtggctccagcctgagatgagctgtattatactntctcttccttacgacttaaattaacgtgtagttggttaggttcgtcgggacgggaccggtacccaacgtaccgtcgtacgtcgacgaccgagtcctcccgtccccgtcggtcctaccgttccttcccgttaccccctaccccttccgttacccgttacttccccgttcgttccgtcgtacggccgggtccgggttcgacgggaccgtaacgggccacgtgtaannnngnnnnnnnnnnnn

SEQ ID NO: 414687 - DNA, 512 bp, Homo sapiens
  misc_feature: GZ8MTXP01B6SX1.11.3.A03.1.454.CMB.2.raw
  modified_base (323)..(323): a, c, t, g, unknown or other
  modified_base (496)..(496): a, c, t, g, unknown or other
  modified_base (501)..(512): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccaacaaacacgcccccaaactcctcatatatggtaacagcattcggccctcgaggggtccctgaccgattctctggttccttgtctgacacctcagcctccctggccatcactggctccagcctgagatgaggctgtattnttactgtcagttccttagactattaaacgtgatgtagtgttcgggcggacgggacccacggtaaccgtccgtaggtccacgacccaaggcctcgccccctcgggtccacttccgtcgttccccgcccgtccttccgtactccttccgtccgctagcgcgggctgggctaggcncatgnnnnnnnnnnnn

SEQ ID NO: 414688 - DNA, 487 bp, Homo sapiens
  misc_feature: GZ8MTXP01DKXVR.11.3.A03.1.454.CMB.2.raw
  modified_base (356)..(356): a, c, t, g, unknown or other
  modified_base (365)..(365): a, c, t, g, unknown or other
  modified_base (457)..(457): a, c, t, g, unknown or other
  modified_base (472)..(472): a, c, t, g, unknown or other
  modified_base (474)..(474): a, c, t, g, unknown or other
  modified_base (479)..(487): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccaacaaacagcccccaaactcctcatatatggtaacagcattccggccctcgaggggtccctgaccgtattctctggttccttgtctgacacctcagccctccctggccatcactggcctccagcctgaggatgaggctgtattattactgtcagttcctttgactattaaacnggatgtgtnttcgggcggacggacccacgtaccgtctagtcagcccaaggcctcgcccctggtcactctcgttccccgccctcctcgtactctctcgctgngcggctggcaaggcncntaagnnnnnnnnn

SEQ ID NO: 414689 - DNA, 598 bp, Homo sapiens
  misc_feature: GZ8MTXP01AJJVV.11.3.A03.1.454.CMB.2.raw
  modified_base (509)..(509): a, c, t, g, unknown or other
  modified_base (584)..(587): a, c, t, g, unknown or other
  modified_base (589)..(598): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgccccccaaactcctcatatatggtaacagcattccggccctcgaggggtccctgaccgtattctcttggttccttgtctgacacctcacgcctccctggccatccactgggcctccagcctgaggatgaggctgtatttattactgtactagttcctttagaactattaaacgtggtaattggttagggttcgttccggggacgggtaacgggtaccccgtaacggttaacccggtccgttaagggtaccaacggtaccccgaagggtcctcccggccccccgttcgggtacctacccttccgttccggttcccccnccccttcccgttccgttacttccttccgttccgccgttggacggccgggcgtcgggccgtaaggccgacagaagnnnngnnnnnnnnnn

SEQ ID NO: 414690 - DNA, 728 bp, Homo sapiens
  misc_feature: GZ8MTXP01AXCX2.11.3.A03.1.454.CMB.2.raw
  modified_base (205)..(205): a, c, t, g, unknown or other
  modified_base (710)..(713): a, c, t, g, unknown or other
  modified_base (715)..(728): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaacctccncatatatagtaacagctagttccgccctcggacgggtccctcgaccgtattctcgttcggttccttgtctgaccacctcactccctcccgtcggccatccacgtcgggtcccttcccgacgtcccgttaggaggtacgtacgggacggtcgttaaggttaactttttaacttaccgttcggttacctacggttttccccgttttaacggtaaaccttaaagttttaaaaccgtagggtagtttaggggtttacgggtttaacggttcccgggggaaccgggggtaacccggggaaccccgttaacccgggttaaacccggttccggttaacgggtacccgaaccggtaccccgaaacgggttccctaccccggtcccccggttaccggacccttaccgttcccgttccccgttccccccgttccccttacccgtttacgttccttccttccgtccgcgttacggcgggccgggtcgtacgggaccgtaacggggcccacaagtgnnnngnnnnnnnnnnnnnn

SEQ ID NO: 414691 - DNA, 577 bp, Homo sapiens
  misc_feature: GZ8MTXP01D8BD2.11.3.A03.1.454.CMB.2.raw
  modified_base (561)..(577): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagccaccttccacaaaccacgcccccaaactcctcatatatggtaacagcattccggccctcgaggggtccctgaccgtattctctggtttccttgtctcgacacctcacgcctccctggccatcactggctccagcctgagatgaggctgtattatactgtcagttcctttagactaatttaaacgtggtattaggttgggttaacgttcggggaccgggtaaaccgggtaccccctacggttaaacccggtccgtaggtaccgacgacccgaacggcctccgtcccccgtacggtcctactccgtccgttccccgccccttcctccgttacttccttccgtcgtcgtggaccggcggtcgttcggcgtaacgggccgtacataagnnnnnnnnnnnnnnnnn

SEQ ID NO: 414692 - DNA, 516 bp, Homo sapiens
  misc_feature: GZ8MTXP01BGKYI.11.3.A03.1.454.CMB.2.raw
  modified_base (502)..(502): a, c, t, g, unknown or other
  modified_base (506)..(516): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgcccccaaactcctcatatatggtaacagcattcggccctcgaggggtccctgaccgtattctctggttccttgtctgacacctcacgcctccctggccatcactggctccagcctgagatgaggctgatttattactgtcagttcctttagactattaaacgtggtattggtggttaattcggggcgggtaacgggacccctaacggttaacccgtccgtaggtccacgacccgaaggcctcgcccccgttcggtcctactccgtccgttccccgccctctcgtactctctcgctgcgcggctgcaggcncagnnnnnnnnnnn

SEQ ID NO: 414693 - DNA, 507 bp, Homo sapiens
  misc_feature: GZ8MTXP01A6Z7E.11.3.A03.1.454.CMB.2.raw
  modified_base (494)..(507): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgcccccaaactcctcatatatggtaacagcattcggccctcaggggtccctgaccgattctctggttccttgtctgacacctcacgccctccctggccatcactgggctccagcctgaggatggaggctgtatttattactgtctagttcctttagactattaaacgtggattggtggtgttcgggcggacgggacccctagtacccgtctagtcacgccaggctccgcccctacggtctactctccgtcccgtccctctcgtctcctcgtccgctgcgcgggcgtggcgaacggcgcagtgnnnnnnnnnnnnnn

SEQ ID NO: 414694 - DNA, 521 bp, Homo sapiens
  misc_feature: GZ8MTXP01B5U29.11.3.A03.1.454.CMB.2.raw
  modified_base (511)..(521): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgcccccaaactcctcatatatggtaacagcattccggccctcgacggggtccctgaccgattctctggttccttgtctgacacctcacgccctccctggccatcacgtcgggcctcccagccctggaggtactgaggcttgtatttattactgtctagttccttgactattaaactggatgtggtgtcgggacgggacgggaccctacgtaaccgtcgtagtcacgccgaaggcctccggtcccctacggtccacgttccctcgttccccacccttcctcgtactctctcgcgtgacggcggcgtggacaggcactgcgnnnnnnnnnnn

SEQ ID NO: 414695 - DNA, 518 bp, Homo sapiens
  misc_feature: GZ8MTXP01A45M0.11.3.A03.1.454.CMB.2.raw
  modified_base (382)..(382): a, c, t, g, unknown or other
  modified_base (463)..(463): a, c, t, g, unknown or other
  modified_base (491)..(491): a, c, t, g, unknown or other
  modified_base (510)..(518): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccaacaaacacgcccccaaactcctacatatatggtaacagcattccggccctcgacggggtccctgaccgtattctctggttccttgtctgacacctcacgccctccctggccatccacgtgggctccgagcctgaggatgaggctagtattattactgtctagttcctttgactaattaaacgtggtattgttagggtnttcgggacggacgggacccctagtaacccgtcgtagtccacgcccaaggctccgccccgtcgtctacgtcctcgttccccnccctctcgtactctctcgcgtgcgcggntcgggctaaggcgacatgnnnnnnnnn

SEQ ID NO: 414696 - DNA, 496 bp, Homo sapiens
  misc_feature: GZ8MTXP01DZR1J.11.3.A03.1.454.CMB.2.raw
  modified_base (355)..(355): a, c, t, g, unknown or other
  modified_base (365)..(365): a, c, t, g, unknown or other
  modified_base (487)..(496): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccaacaaacacgcccccaaatcctcatatatggtaacagcattccggccctcgaggggtccctgaccgtattctctggttccttgtctgacacctcagccctccctggccatcactggctccagcctgaggatgagctgtattattactgtcagttcctttagactattaaacnggatggtgtntcgggcggagggaccccagtacccgtctaggtcagccaagctcgcccctggtcactcgtcgttccccgccctcctcgtactctctcgcgtgacggcggtcgtgggcaagggcgacagtaagnnnnnnnnnn

SEQ ID NO: 414697 - DNA, 500 bp, Homo sapiens
  misc_feature: GZ8MTXP01CFZ7Y.11.3.A03.1.454.CMB.2.raw
  modified_base (488)..(488): a, c, t, g, unknown or other
  modified_base (493)..(500): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagccaccttccacaaacacgcccccaaactcctcatatatggtaacagcattcggccctcgaggggtccctgaccgtattctctggttccttgtctgacacctcagcctccctgccatcactggctccagcctgagatgagctgtattattactgtcagttcctttagactattaaactggtattgtaggttgttcgggacgggacggggaccccacggtaacccgtcctaggtccacgcccaaggctccgccccctcgtccactctcgttccccacctcctcgtactctctcgctgacgcggctggctaaggcncatgnnnnnnnn

SEQ ID NO: 414698 - DNA, 733 bp, Homo sapiens
  misc_feature: GZ8MTXP01DYTCM.11.3.A03.1.454.CMB.2.raw
  modified_base (713)..(713): a, c, t, g, unknown or other
  modified_base (715)..(717): a, c, t, g, unknown or other
  modified_base (719)..(721): a, c, t, g, unknown or other
  modified_base (723)..(733): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacggtcggggcaggttatgatgttcactggtaccagcaccttccaacaaacacgcccccaaactcctcatatatggtaacagcattccggccctcgacggggtccctgaccgtattctctggtttccttgtctgacacctcagccctccctggccatcacgtcgggctccagcctagacgatgaggtctgtaatttattactgttcagttccttttagaaccttaagttaaacgtggtaacttagggttagggtttaacgtttccggggaccggggtaaaccggggtaccccctaaaccgggttaaacccccgggttccgttaacggggttacccgaaccgggtacccccgtaaacggggtccccgttacccgggtccccccccgtttaccggggttaccccttaacccgtttccccggtttccccggtttacccccccgtccccccgttttaccccgtttaccccgggtttaacctttccccgtttcccgtttcccggtcccggtttacggaaccggggtcccggggtaccggttacggggaccgaaacggggtcccgacgtaaagtaaggngnnngnnngnnnnnnnnnnn

SEQ ID NO: 414699 - DNA, 471 bp, Homo sapiens
  misc_feature: GZ8MTXP01A9V6G.11.3.A03.1.454.CMB.2.raw
  modified_base (307)..(307): a, c, t, g, unknown or other
  modified_base (438)..(438): a, c, t, g, unknown or other
  modified_base (457)..(471): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgcccccaaactcctcatatatgtctgccttcctccctgccgtcccaggcctgagagacctctgctactccctgcctctcgtacccttccttgccctcatcaggtcatcgacaaccncttcacctctgacccgcagggggcagggggactaggattcggagtgaccgtggtcaacgcccaaggcctccgccccctggtaccacctcttcccgttccccgcccttcctcgtactctctcgctgcgcggntcggcacggcgacagtagnnnnnnnnnnnnnnn

SEQ ID NO: 414700 - DNA, 595 bp, Homo sapiens
  misc_feature: GZ8MTXP01DXCE2.11.3.A03.1.454.CMB.2.raw
  modified_base (220)..(220): a, c, t, g, unknown or other
  modified_base (245)..(245): a, c, t, g, unknown or other
  modified_base (266)..(266): a, c, t, g, unknown or other
  modified_base (268)..(268): a, c, t, g, unknown or other
  modified_base (295)..(295): a, c, t, g, unknown or other
  modified_base (343)..(343): a, c, t, g, unknown or other
  modified_base (534)..(534): a, c, t, g, unknown or other
  modified_base (581)..(581): a, c, t, g, unknown or other
  modified_base (583)..(595): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaaccacgcccccaaactcctcatatatggtaacngcattccggccctcaggggtccccncgactcttctcgttcgttctntncacctactcgaccgtccctcgtcgacnctacgtcggtcggcctaaccgcgtccgtaggacgtagtaggaccggtnttagttaattttaacgttacttcggttactcgtttaccttaacgaccttaaaattacggtagtagttacgggtaggtttcggtcgggacgggtaacccggtaaaccccgtaacgtaccgtcggtactacgaccgacgtacgccgtccccgtacccgtacgtcctcgttcctcccttacccctaccccgttntaccttcgtcctcgttccgcgtggccggtcgtgtacggataccgggnannnnnnnnnnnnn

SEQ ID NO: 414701 - DNA, 595 bp, Homo sapiens
  misc_feature: GZ8MTXP01BSD9F.11.3.A03.1.454.CMB.2.raw
  modified_base (582)..(595): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacggtcggggcaggttatgatgttcactggtaccagcaccttccaacaaacacgccccccaaactcctcatatatggtaaacagctattccggccctcgacgggggttccctgacccgtatttctcgttcggtttccttgtctgaccacctcacgccctccctcggccatccacgtcggctccagcctgaggtatggagtctagtaactttattacgtgtcagttcctttagacctaagttaaacgtggtaattcggttaggttcgttacggggcgggtaaccgggacccctaacgggttaacccgtcgttacggcacgtacccgaacggcctccgcccccgttcggtacctccttccgttccgttcccctaccccttcgttcccgttacgttccctccgtccgcgtcggacggcggtcgtcggacgtacgggcactgaagnnnnnnnnnnnnnn

SEQ ID NO: 414702 - DNA, 600 bp, Homo sapiens
  misc_feature: GZ8MTXP01DR42F.11.3.A03.1.454.CMB.2.raw
  modified_base (584)..(584): a, c, t, g, unknown or other
  modified_base (588)..(600): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacggtcggggcaggttatgatgttcactggtaccagcaccttaccaacaaacacgacccccaaactcctacatatatggtaacagcattccgcctcgacggggtccctgaccgtattctctggttccttgtctgactacctcacgccctccctggaccatcacgtgggcctccagcctaggaggtatggaggtctagtaatttattacttgtacgtacgttccttttagaacttaaagtttaaacgtggtagttaggttagggttcggttcgggaccggggaaacgggtaaccccctaaccggttaacccgtcgtaacggtccaacggacccaaggtccctcccggccccgttacggtccacttcctcccgttacccctccttacctccgttactccttccgtcgtaccgtggaccggtcgggcgtaggccgaagggccacganaagnnnnnnnnnnnnn

SEQ ID NO: 414703 - DNA, 507 bp, Homo sapiens
  misc_feature: GZ8MTXP01BUDPM.11.3.A03.1.454.CMB.2.raw
  modified_base (493)..(493): a, c, t, g, unknown or other
  modified_base (500)..(507): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccaacaaacacgacccccaaactcctcatatatggtaacagcattcggccctcgacggggtccctgaccgtattctctggttccttgtctgacacctcacgccctcccgtggccatccactgggcctccagcctgacggatggaggctagatttacttactgtctagtcctttagactattaaacgtggtatggtgtaattcgggcgggacgggacccacggtaaccgcgtaggtcacgcccaaggcctcgcccctggtcactctcgttcccgccctctcgtactctctcgctggcgcgggctggcgacggngcatgcnnnnnnnn

SEQ ID NO: 414704 - DNA, 580 bp, Homo sapiens
  misc_feature: GZ8MTXP01BCDF7.11.3.A03.1.454.CMB.2.raw
  modified_base (327)..(327): a, c, t, g, unknown or other
  modified_base (533)..(533): a, c, t, g, unknown or other
  modified_base (563)..(563): a, c, t, g, unknown or other
  modified_base (569)..(580): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatcctcctgcactggaaacagctccaacgtcggggcaggttatgatgttcactggtaccagccaccttccaacaaacagccctaccaaactcctacatatataggtaacagctattccggcccctcgacggggtccctagaccgtattctcttggttccttgtctgacacctcacgccctcctggccatcacgtgggcctccagcctgaggntgaggctgtatttattacgtgtactacgttcccctttagaactaagtttaaacgtggtaaattggtggttacgttccggggacgggtaaccgggacccctaacggttaacccgtccgtaaggtccacggacccgaaggtccgtcccgtcccccgtcgtcctacctctcccgttaccccaccttccctcggttactcctcgtaccgngtcggacggcggtctcgggactaagggccnaagtgnnnnnnnnnnnn

SEQ ID NO: 414705 - DNA, 648 bp, Homo sapiens
  misc_feature: GZ8MTXP01CW8WG.11.3.A03.1.454.CMB.2.raw
  modified_base (219)..(219): a, c, t, g, unknown or other
  modified_base (632)..(648): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgcccccaaactcctcatatatggtaacngcattccggccctcgaggggtccctgaccgtattctcttggttccttgtctgaccacctcacgccctccctggccatcacgtgggcctccgagcctgacggatggaggtctagtattattactgtctacgttcctttacgaactaatttaaacgtggtacttagggttagggttaacgttccggggaccggggtaaccggggtaacccccgtaaccggttaaaccccgttccgtaacgggtcccaaccggtacccccgtaaacgggtcccctttcccccccggttcgggtaccttacccgttccgttcccgggttccccccgtccccttacccgttccgttaccttccgttcccgtccggtccgttcgggacggcccggggtcgtacgggaccgaacgggtccgacgtagtgnnnnnnnnnnnnnnnnn

SEQ ID NO: 414706 - DNA, 470 bp, Homo sapiens
  misc_feature: GZ8MTXP02GR7YJ.11.3.A03.1.454.CMB.2.raw
  modified_base (346)..(346): a, c, t, g, unknown or other
  modified_base (355)..(355): a, c, t, g, unknown or other
  modified_base (462)..(470): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactggctccagcctgaggatgaggctgattattactgtcagtccttgacattaaacnggatgtgtnttcggcggagggacccagtaaccgtctaggtcagcccaagctcgccccctggtcactctcgttcccacctctcgtatctctcgctgagcggctggcaggcgcatagnnnnnnnnn

SEQ ID NO: 414707 - DNA, 494 bp, Homo sapiens
  misc_feature: GZ8MTXP02GRQZK.11.3.A03.1.454.CMB.2.raw
  modified_base (348)..(348): a, c, t, g, unknown or other
  modified_base (483)..(494): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactggctccagcctgagatgaggctgtattattactgtcagttccttgactattaaacnggtatgtgtagttcgggacggtacggacccacgtaaccgtctaggtcacgacccaaggctcgccccctcggtcactctcgttccccgcccttcctcgtactctctcgctgacgcggctggcgaaggcgcagtagnnnnnnnnnnnn

SEQ ID NO: 414708 - DNA, 480 bp, Homo sapiens
  misc_feature: GZ8MTXP02G0SW4.11.3.A03.1.454.CMB.2.raw
  modified_base (473)..(480): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactggctccagcctgagatgaggctgattattactgtcagttccttgactattaaactggatgtgtagttcggcggagggacccacgtaaccgtctaggtcagcccaaggctcgccccctcggtccactctcgttccccaccctcctcgtactctctcgctgagcggctggcaaggcgcatagnnnnnnnn

SEQ ID NO: 414709 - DNA, 487 bp, Homo sapiens
  misc_feature: GZ8MTXP02G20X1.11.3.A03.1.454.CMB.2.raw
  modified_base (349)..(349): a, c, t, g, unknown or other
  modified_base (479)..(487): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactggctccagcctgaggatgaggctgatttattactgtcagttcctttgacattaaacnggatggtgtattcgggcggagggacccacgtaaccgtcctaggtcacgcccaaggctcgccccctcggtcactctcgttccccgccctcctcgtactcctctcgctgagtcggctggcaggcgcatacgnnnnnnnnn

SEQ ID NO: 414710 - DNA, 489 bp, Homo sapiens
  misc_feature: GZ8MTXP02H3LES.11.3.A03.1.454.CMB.2.raw
  modified_base (361)..(361): a, c, t, g, unknown or other
  modified_base (472)..(472): a, c, t, g, unknown or other
  modified_base (479)..(489): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttcacaaacacgccccaaactcctcatatatggtaacagcattcggccctcgaggggtccctgaccgattctctggttccttgtctgacacctcacgccctccctggccatcactgggctccagcctgaggatgaggctgatttatactgtcagtcctttgactattaaactggattgtgtnttcgggcgacggacccacgtaccgtctaggtcagcccaagctcgccccctcggtccactcctcgtccccgccctcctcgtactcttctcgctgagccgggctggcagggcncgatagnnnnnnnnnnn

SEQ ID NO: 414711 - DNA, 475 bp, Homo sapiens
  misc_feature: GZ8MTXP02HZDC0.11.3.A03.1.454.CMB.2.raw
  modified_base (344)..(344): a, c, t, g, unknown or other
  modified_base (359)..(359): a, c, t, g, unknown or other
  modified_base (391)..(391): a, c, t, g, unknown or other
  modified_base (459)..(475): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttcacaaacagcccccaaactcctcatatatggtaacagcattcggccctcaggggtccctgaccgattctctggttcccttgtctgacacctcagcctccctggccatcactggctccagcctgaggatgaggctgattatactgtcagtcttgactattaacnggatgtgtattcggngaggacccagtaccgtctagtcagcccaagcncgcccctgtcactctcgtcccacctctcgtatctctcgctgagcggctcggcaacggcgacagtacgnnnnnnnnnnnnnnnnn

SEQ ID NO: 414712 - DNA, 494 bp, Homo sapiens
  misc_feature: GZ8MTXP02FGBTU.11.3.A03.1.454.CMB.2.raw
  modified_base (335)..(335): a, c, t, g, unknown or other
  modified_base (357)..(357): a, c, t, g, unknown or other
  modified_base (370)..(370): a, c, t, g, unknown or other
  modified_base (414)..(414): a, c, t, g, unknown or other
  modified_base (486)..(494): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcagggcaggttatgatgttcactggtaccagcaccttccaacaaacacgacccccaaactcctcatatatggtaacagcattccggccctgacggggtccctgaccgattctcttggttccttgtctgacacctcagccctccctggccatcacgtgggcctccagcctgaggatggagctgatttatacngtcagtcccttgacattaaacngatgtgtatcggnggacgaccacgtaaccgtctagtcacgcccaaggctcgcccccncggtcactctcgttcccacccgtcctcgtactctcctcgctcgaggccggcgtcggacaaggcgacagtagnnnnnnnnn

SEQ ID NO: 414713 - DNA, 473 bp, Homo sapiens
  misc_feature: GZ8MTXP02GEHR7.11.3.A03.1.454.CMB.2.raw
  modified_base (356)..(356): a, c, t, g, unknown or other
  modified_base (462)..(473): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactggctccagcctgaggatgaggctgattattactgtcagtccttgactattaaactggatgtgtnttcgggcggaggacccacgtaaccgtctaggtcagcccagctcgcccctcgcactctcgtcccacctcctcgtatctctcgctgacgcggctggcaggcgcatagnnnnnnnnnnnn

SEQ ID NO: 414714 - DNA, 475 bp, Homo sapiens
  misc_feature: GZ8MTXP02FTPJG.11.3.A03.1.454.CMB.2.raw
  modified_base (356)..(356): a, c, t, g, unknown or other
  modified_base (464)..(475): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttcacaaacagcccccaaactcctcatatatggtaacagcattcggccctcaggggtccctgaccgattctctggttcctgtctgacacctcagcctccctggccatcactggctccagcctgaggatggaggctgattattactgtcagttcctttgactattaaactgatgtgtnttcgggcggaggacccagtaacgtctagtcagcccaagctcgcccctcgtcactctcgtccccacctcctctactctctcgctgacgcggctggcaaggcgcatacgnnnnnnnnnnnn

SEQ ID NO: 414715 - DNA, 442 bp, Homo sapiens
  misc_feature: GZ8MTXP02G4CKZ.11.3.A03.1.454.CMB.2.raw
  modified_base (428)..(428): a, c, t, g, unknown or other
  modified_base (431)..(442): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatgtctgccttcctcctgcgtcccaggcctgaggagacctctgctatccctgctctcgacccttcttgcctcatcagtcatgacaaccacttcacctctgaccgcaggggcaggggactaggattgagtgacctggtcagcccagggcctgccccctgtcacgtctcgttccccgccctcctcgcactctctcgcctgagcgggctggccaaggccganagnnnnnnnnnnnn

SEQ ID NO: 414716 - DNA, 492 bp, Homo sapiens
  misc_feature: GZ8MTXP02IUV3F.11.3.A03.1.454.CMB.2.raw
  modified_base (475)..(475): a, c, t, g, unknown or other
  modified_base (481)..(492): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgcccccaaatcctcatatatggtaacagcattcggcctcgaggggtccctgaccgattctctggttccttgtctgacacctcagcatccctggccatcactggctcagcctgaggatgaggctgattattactgtcagttcccctttagactattaaacgtggattggtggtattcgggacggaggaccccagtaacctctaggtcacgcccaaggctcgcccctcgtcactctcgttccccgcccttcctcgtactctctcgctgacgtcgggctggcaggcncgatgnnnnnnnnnnnn

SEQ ID NO: 414717 - DNA, 488 bp, Homo sapiens
  misc_feature: GZ8MTXP02HMBIW.11.3.A03.1.454.CMB.2.raw
  modified_base (348)..(348): a, c, t, g, unknown or other
  modified_base (481)..(488): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagtcattcggccctcaggggtccctgaccgattctctggttccttgtctgacacctcagcctccctggccatcactggctccagcctgaggatgaggctgattattactgtcagtccttgactattaaacnggtatgtgtagttcggcggagggacccacgtaaccgtccgtaggtcagcccgaaaggcctcgccccctacggtccacgtctcgttccccaccctcctcgtatcttctcgctgacgcggctggcaagcgcatgnnnnnnnn

SEQ ID NO: 414718 - DNA, 477 bp, Homo sapiens
  misc_feature: GZ8MTXP02G3K17.11.3.A03.1.454.CMB.2.raw
  modified_base (462)..(462): a, c, t, g, unknown or other
  modified_base (465)..(477): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggcctcaggggtccctgaccgattctctggttccttgtctgacacctcagcctcctgccatcactggctccagcctgagatgagctgattatactgtcagttcttgacattaaactggatgtgtatcgggcggtacggaccacgtaacgtctaggtcacgcccaaggctcgccccctggtcactctcgttccccgccctcctcgtatcctctcgctgacgcggctggcaaggcgacanagnnnnnnnnnnnnn

SEQ ID NO: 414719 - DNA, 494 bp, Homo sapiens
  misc_feature: GZ8MTXP02IM7PD.11.3.A03.1.454.CMB.2.raw
  modified_base (484)..(494): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttcccttgtctgacacctcagcctccctggccatcactggctccagcctgagatgaggctgattatactgtgcagccagtgggatgacaccctgatgtccttgtgttggtttcgggcggtagggaccaagctgaccgtctagtcacgccaaggctcgcccctggtccactctcgttccccacctcctcgtactctctcgctgacgcgggctggcaacggcgcactacgnnnnnnnnnnn

SEQ ID NO: 414720 - DNA, 482 bp, Homo sapiens
  misc_feature: GZ8MTXP02F32PA.11.3.A03.1.454.CMB.2.raw
  modified_base (358)..(358): a, c, t, g, unknown or other
  modified_base (473)..(482): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagccccccaaactcctcatatatggtaacagcattcggccctcaggggtccctgaccgattctctggttccttgtctgacacctcagcctccctggccatcactggctccagcctgaggatgaggctgattattactgtcagtcctttgactattaaactggatgtgtnttcggcggaggacccacgtaaccgtcctaggtcagcccaaggctcgccccctcggtccactctcgttccccgcctcctcgtatcctctcgctgacgcggctggcaggcgcatagnnnnnnnnnn

SEQ ID NO: 414721 - DNA, 479 bp, Homo sapiens
  misc_feature: GZ8MTXP02FONP2.11.3.A03.1.454.CMB.2.raw
  modified_base (358)..(358): a, c, t, g, unknown or other
  modified_base (465)..(465): a, c, t, g, unknown or other
  modified_base (470)..(479): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgcccccaaactcctcatatatggtaacagcattcggccctcaggggtccctgaccgattctctggttcctgtctgacacctcagcctccctggcccatcactggctccagcctgaggatgaggctgattattactgtcagttccttgacattaaactggatgtggtntcgggcggagggacccagtaaccgtcctaggtcagcccaaggctcgccccctcggctactctcgttccccacctcctcgtatcctctcgctgcgcggctggcaggcncatgnnnnnnnnnn

SEQ ID NO: 414722 - DNA, 479 bp, Homo sapiens
  misc_feature: GZ8MTXP02IR317.11.3.A03.1.454.CMB.2.raw
  modified_base (355)..(355): a, c, t, g, unknown or other
  modified_base (446)..(446): a, c, t, g, unknown or other
  modified_base (460)..(460): a, c, t, g, unknown or other
  modified_base (467)..(479): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcacggggtccctgacccgattctctggttcccttgtctgacacctcagcctccctggccatcactggctccagcctgagatgagctgattattactgtcagtccttgactattaactgatgtgtnttcggcggagggaccccacggtaaccgtccgtaggtcagcccaaggctcgcccctgtccactctcgtcccacctctcgtatctctcgctgngcggctggcaggcncatacgnnnnnnnnnnnnn

SEQ ID NO: 414723 - DNA, 478 bp, Homo sapiens
  misc_feature: GZ8MTXP02HKARF.11.3.A03.1.454.CMB.2.raw
  modified_base (355)..(355): a, c, t, g, unknown or other
  modified_base (361)..(361): a, c, t, g, unknown or other
  modified_base (469)..(478): a, c, t, g, unknown or other
tcagcgagagataccacgaccggtgctcgatttagagagcgtcacagggtcctgggcccagtctgtgctgacgcagccgccctcagtgtctggggcccccagggcagacggtcaccatctcctgcactggaaacagctccaacgtcggggcaggttatgatgttcactggtaccagcaccttccacaaacacgcccccaaactcctcatatatggtaacagcattcggccctcaggggtccctgaccgattctctggttccttgtctgacacctcagcctccctggccatcactggctccagcctgagatgaggctgattatactgtcagtcctttgacattaactggatgtgtntcgggnggagggacccagtaaccgtctaggtcacgcccaaggctcgccccctcggtcactctcgtccccacctcctcgtactctctcgctgacgcgggctggcaggcgcatagnnnnnnnnnn

SEQ ID NO: 414724 - DNA, 470 bp, Homo sapiens
  misc_feature: GZ8MTXP02FPDA8.11.3.A03.1.454.CMB.2.raw
  modified_base (232)..(232): a, c, t, g, unknown or other
  modified_base (354)..(354): a, c, t, g, unknown or other
  modified_base (456)..(470): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgcccccaaactcctcatatatggtaacagcattcggccctnaggggtccctgaccgattctctggttcctgtctgacacctcagcctccctggccatcactggctccagcctgaggatgaggctgattattactgtcagtccttgactataaactgatgtgtntcggcggaggacccacgtaacgtctaggtcagcccaagctgcccctgcactctgtcccacctcctcgtactctctcgctgacgcggctggcaggcgcatagnnnnnnnnnnnnnnn

SEQ ID NO: 414725 - DNA, 508 bp, Homo sapiens
  misc_feature: GZ8MTXP02HZQLQ.11.3.A03.1.454.CMB.2.raw
  modified_base (498)..(508): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagccaccttccacaaacacgcccccaaactcctcatatatggtaacagcattcgcctcaggggtccctgaccgattctctggttccttgtctgacacctcagcctccctgccatcactggctccagcctgagatgaggctagatttattactgtctagttcctttgactaatttaaactggtatggttggtgttcgggacggtacggaccccacgttaaccgcctaggtcacgcccaagcctcgccccctcggtccactcctcgttccccgccctcctcgtatcctctccgcgtcgacgcgggctggacgaacggcgacaagtgnnnnnnnnnnn

SEQ ID NO: 414726 - DNA, 463 bp, Homo sapiens
  misc_feature: GZ8MTXP02IRTX4.11.3.A03.1.454.CMB.2.raw
  modified_base (358)..(358): a, c, t, g, unknown or other
  modified_base (455)..(463): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagccaccttccaacaaacagcccccaaactcctcatatatggtaacagcattcggccctcgaggggtccctgaccgattctctggttccttgtctgacacctcagcctcctggccatcactggctccagcctgaggatgaggctgattatactgtcagtcctttgactattaaactgatgttgtnttcggcggaggacccagtacgctagcagccagctcgcccctgtcactctcgtcccacctcctctatctctcgctgcgcggctggcaaggcgcatagnnnnnnnnn

SEQ ID NO: 414727 - DNA, 484 bp, Homo sapiens
  misc_feature: GZ8MTXP02GOC7W.11.3.A03.1.454.CMB.2.raw
  modified_base (471)..(484): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactggctccagcctgagatgaggctgattattactgtcagtcctttgacattaaactggatgtggtattcggcggaggacccagtaaccgtcctaggtcagcccaagctcgccccctcggtccactctcgttccccacctcctctactctctcgctgacgcgggctggcaaggcgcagtagnnnnnnnnnnnnnn

SEQ ID NO: 414728 - DNA, 477 bp, Homo sapiens
  misc_feature: GZ8MTXP02JP315.11.3.A03.1.454.CMB.2.raw
  modified_base (308)..(308): a, c, t, g, unknown or other
  modified_base (356)..(356): a, c, t, g, unknown or other
  modified_base (465)..(477): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactggctccagcctgaggntgaggctgattatactgtcagttccttgactattaaactggatgtgtnttcgggcggaggacccagtaaccgtctaggtcagcccaagctcgcccctgtccactctcgttccccacctcctcgtactctctcgctgagcggctggcaggcgcatagnnnnnnnnnnnnn

SEQ ID NO: 414729 - DNA, 497 bp, Homo sapiens
  misc_feature: GZ8MTXP02JZS66.11.3.A03.1.454.CMB.2.raw
  modified_base (485)..(497): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctgccatcactggctccagcctgagatgaggctgattatactgtcagtcctttgactattaaactggatgttgtgttcgggcggacgggacccagtaaccgtctaggtcacgtcccaaggctcgccccctcggtccacttctcgttccccgccctcctcgtactctctcgcgtgacgccgggctcggccgaacggcgcaatacgnnnnnnnnnnnnn

SEQ ID NO: 414730 - DNA, 484 bp, Homo sapiens
  misc_feature: GZ8MTXP02G4DA3.11.3.A03.1.454.CMB.2.raw
  modified_base (472)..(484): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaatcctcatatatggtaacagcattcggccctcaggggtccctgaccgattctctggttccttgtctgacacctcagcctccctgccatcactggctccagcctgagatgaggctgattattactgtcagtcctttagaacctattaaaactggatgtggtattcgggcgagggacccacgtaacgtctaggtcagcccaagctcgcccctcgtcactctcgttcccacctcctcgtatcctctcgcctgacgtcggctggacaaggcgcatagnnnnnnnnnnnnn

SEQ ID NO: 414731 - DNA, 487 bp, Homo sapiens
  misc_feature: GZ8MTXP02GVGXT.11.3.A03.1.454.CMB.2.raw
  modified_base (480)..(487): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgcccccaaactcctcatatatggtaacagcattcggccctcacggggtccctgaccgattctctggttccttgtctgacacctcagcctccctgccatcactgggctccagcctgaggatgaggctgattattactgtcagttccttgactattaaactggattgtggtattcgggacggtacgggaccctacgtaaccgtccgtaggtcagcccaagctcgccccctcgtccactctcgttcccgccctcctcgtctctctcgctgacgcggctggcaggcgcatagnnnnnnnn

SEQ ID NO: 414732 - DNA, 523 bp, Homo sapiens
  misc_feature: GZ8MTXP02GX1QW.11.3.A03.1.454.CMB.2.raw
  modified_base (512)..(523): a, c, t, g, unknown or other
tcagcgagagataccacgaccggtgctcgatttagagagcgtcacagggtcctgggcccagtctgtgctgacgcagcccgccctcagtgtctggggcccccagggcagacggtcaccatctcctgcactggaaacagctccaacggtcggggcaggttatgatgttcactggtaccagcaccttccaacaaacacgcccccaaactcctcatatatggtaacagcattccggccctcaggggtccctgaccgtattctctggttcctgtctgaccacctcacgccctccctggcccatccacgtgggcctccagcctggaggatggaggctagtatttattactgtactagtttccttagactaattaaactggatgtggttacgttcgggacggacggaccctaacgtaaccgtcctaggtcacgtacccgaagcctcgccccctcggcctactctccgttacccctaccctcctcgtactctctcgctgacgcggctggcgagcgcaagnnnnnnnnnnnn

SEQ ID NO: 414733 - DNA, 479 bp, Homo sapiens
  misc_feature: GZ8MTXP02JQBR3.11.3.A03.1.454.CMB.2.raw
  modified_base (354)..(354): a, c, t, g, unknown or other
  modified_base (361)..(361): a, c, t, g, unknown or other
  modified_base (466)..(479): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagccctcctggccatcactggctccagcctgaggatgaggctgattattactgtcagtccttgactataaactgatgtgtnttcgggnggacggacccagtacgtctaggtcacgccaagctcgccccctcggtccactctcgttccccaccctcctcgtactctctcgctgagcggctggcaggcgcatagnnnnnnnnnnnnnn

SEQ ID NO: 414734 - DNA, 484 bp, Homo sapiens
  misc_feature: GZ8MTXP02F48NO.11.3.A03.1.454.CMB.2.raw
  modified_base (362)..(362): a, c, t, g, unknown or other
  modified_base (479)..(484): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggcctccagcctgaggatgaggctgatttattactgtcagttcctttgactattaaactggatgtggtnttcgggcggagggacccacgtaaccgtcctaggtcagcccaaggctcgccccctcggtctactctcgtttcccaccctcctcgtatctctcgctgagcggctggcaaggcgcatagnnnnnn

SEQ ID NO: 414735 - DNA, 484 bp, Homo sapiens
  misc_feature: GZ8MTXP02FZS03.11.3.A03.1.454.CMB.2.raw
  modified_base (358)..(358): a, c, t, g, unknown or other
  modified_base (473)..(484): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttcctgtctgacacctcagcctccctggccatcactgggctccagcctgaggatgaggctgattattactgtcagttccttgactattaaactggatgtggtntcgggcggagggacccagtaaccgtctaggtcagcccaaggctgccccctcggcactctcgttccccgcccttcctcttatctctcgctgacgcggggctggcaaggcgcatagnnnnnnnnnnnn

SEQ ID NO: 414736 - DNA, 497 bp, Homo sapiens
  misc_feature: GZ8MTXP02GGU3W.11.3.A03.1.454.CMB.2.raw
  modified_base (484)..(497): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgcccccaaactcctcatatatggtaacagcattcggccctcaggggtccctgaccgattctctggttccttgtctgacacctcagcctcctggccatcactgggctccagcctgaggatggaggctgatttattactgtacagttcctttgactattaaactggtatgttggtagttcgggcggaggggacccaacgtaaccgtcctaggtcacgcccaagctcgccccctggccactctcgtccccaccctcctcgtactctctcgctgacgcggctggcaggcgcactagnnnnnnnnnnnnnn

SEQ ID NO: 414737 - DNA, 479 bp, Homo sapiens
  misc_feature: GZ8MTXP02FJ0ID.11.3.A03.1.454.CMB.2.raw
  modified_base (471)..(479): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttcctgtctgacacctcagcctccctggccatcactggctccagcctgagatgaggctgattattactgtcagttcctttgactattaaactggatgtggtatcggcggaggacccacgtaacgtcctaggtcagcccaaggctcgccccctcggtcactctcgtccccaccctcctcgtatcctctcgctgacgcgggctggcaaggcgcatagnnnnnnnnn

SEQ ID NO: 414738 - DNA, 496 bp, Homo sapiens
  misc_feature: GZ8MTXP02FVU6W.11.3.A03.1.454.CMB.2.raw
  modified_base (488)..(496): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccaacaaacacgcccccaaactcctcatatatggtaaacagcattcggccctcgacggggtccctggaccggttctctggctccaagtctggctcttccgcctccttggccatcactggctcgaggctgacgatgaggctgattactactgtctgtcctatcgacgacgacctacagacctccggttttcggcggagggactaagctgaccgtcctaagtcagcccaaaggctgccccctcggtcactcctcgttccccaccctcctcgtactctcctcgctcgagcgggctggcaaggcgcatagnnnnnnnnn

SEQ ID NO: 414739 - DNA, 486 bp, Homo sapiens
  misc_feature: GZ8MTXP02JS6U0.11.3.A03.1.454.CMB.2.raw
  modified_base (328)..(328): a, c, t, g, unknown or other
  modified_base (349)..(349): a, c, t, g, unknown or other
  modified_base (472)..(486): a, c, t, g, unknown or other
tcagcgagagataccacgaccggtgctcgatttagagagcgtcacagggtcctgggcccagtctgtgctgacgcagccgccctcagtgtctggggcccccagggcagacggtcaccatctcctgcactggaaacagctccaacgtcggggcaggttatgatgttcactggtaccagcaccttccacaaacagcccccaaactcctcatatatggtaaacagcattcggccctcaggggtccctgaccgattctctggttccttgtctgacacctcacgcctccctggccatcactggctccagcctgaggatgaggctgattattacngtcagtccttgacattaaacnggatgtgtatcgggcggaggacccagtaccgtctagggtcagcccaaggcctcgccccctggtccactctcgttcccgccctctcgtatctctcgctgacgcgggtctggcaaggcgcagtgnnnnnnnnnnnnnnn

SEQ ID NO: 414740 - DNA, 587 bp, Homo sapiens
  misc_feature: GZ8MTXP02JYLYT.11.3.A03.1.454.CMB.2.raw
  modified_base (404)..(404): a, c, t, g, unknown or other
  modified_base (543)..(543): a, c, t, g, unknown or other
  modified_base (575)..(587): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactccacatatagtacgtaacagctacgttccggccctacggaccgggttccctacgaccgtacttcctcgttcggttccttgtctgaccacctcacgccctccgtcggcctatccgacgtcgggcctacccgacgtcctaggaggtagtcggaggtctagtaatttactacgtgtactacgtttccttacgactaatttaaacgnggtatggttagttacgtccggggacgggaaccgggaccctaacgtaaccccggttcgtacggtaccacggacccgacggtcctcccgcccccgtacggtcctactccgttccgtcccccgcccttccgtacgtctctcncgcgtagcggcggtcgcggacgaggcacagcnnnnnnnnnnnnn

SEQ ID NO: 414741 - DNA, 501 bp, Homo sapiens
  misc_feature: GZ8MTXP02G5ZI3.11.3.A03.1.454.CMB.2.raw
  modified_base (327)..(327): a, c, t, g, unknown or other
  modified_base (351)..(351): a, c, t, g, unknown or other
  modified_base (488)..(501): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacacgccccaaactcctcatatatggtaacagcattcggccctcgaggggtccctgaccgtattctctggttccttgtctgacacctcacgcctcctgccatcactggctccagcctgagatggaggctagattattacngtcagttccttagactattaaacngtatgtgtgtcgggcggacggaccacggtaccgtctaggtcacgcccgaagcctccgtcccccgtcgtccacctctcgttccccaccctcctcgtactcctctcgcgtgacgcggcgtggacgtacggcgcatagcnnnnnnnnnnnnnn

SEQ ID NO: 414742 - DNA, 552 bp, Homo sapiens
  misc_feature: GZ8MTXP02HHIJW.11.3.A03.1.454.CMB.2.raw
  modified_base (234)..(234): a, c, t, g, unknown or other
  modified_base (328)..(328): a, c, t, g, unknown or other
  modified_base (332)..(332): a, c, t, g, unknown or other
  modified_base (487)..(487): a, c, t, g, unknown or other
  modified_base (535)..(540): a, c, t, g, unknown or other
  modified_base (542)..(552): a, c, t, g, unknown or other
tcagcgagagataccacgaccggtgctcgatttagagagcgtcacagggtcctgggcccagtctgtgctgacgcagccgccctcagtgtctggggcccccagggcagacggtcaccatctcctgcactggaaacagctccaacgtcggggcaggttatgatgttcactggtaccagccaccttccacaaacacgcccccaaactcctcatatatggtaacagcattcggccctnacggggtccctgaccgattctctggttccttgtctgacacctcagcctccctggccatcactgggcctccagcctgagatgaggctgtattatntgtntcgttctagactaataacgtgtatgtgtcgtcgggacggacggaccctacgtaccgtacgtacgtacacgaccgacgccgtacccgtcccccgtccggtccaccttccgttcccgttaccccctaccccttcccgtaccgtttacctccgttccnccgtcgtacggtccggccggtcggtcggacgaacggcgtacgagtcgnnnnnncnnnnnnnnnnn

SEQ ID NO: 414743 - DNA, 574 bp, Homo sapiens
  misc_feature: GZ8MTXP02GYNFJ.11.3.A03.1.454.CMB.2.raw
  modified_base (561)..(574): a, c, t, g, unknown or other
tcagcgagagataccacgaccggtgctcgatttagagagcgtcacagggtcctgggcccagtctgtgctgacgcagccgccctcagtgtctggggcccccagggcagacggtcaccatctcctgcactggaaacagctccaacgtcggggcaggttatgatgttcactggtaccagcaccttccacaaacacgcccccaaactcctcatatatggtaacagcattcggccctcgaggggtccctgaccgattctctggttccttgtctgacacctcacgccctccctggccatcactggctccagcctgaggatgaggctgtattattactgtcagttcctttagaactaatttaaacgtggtaattggttaggtacgtttcggggacgggtaacggacccctaacgtaacccggttacctacgggtaccacgacccgtaaacgggcctcccggtaccccccgttcgggtaccctacctccgttcccgttccccctaccccttcccttcgtacttcctccgtcgcgtgacggtccgggcgtcggacgaggccgcacgtagnnnnnnnnnnnnnn

SEQ ID NO: 414744 - DNA, 499 bp, Homo sapiens
  misc_feature: GZ8MTXP02I8JKC.11.3.A03.1.454.CMB.2.raw
  modified_base (362)..(362): a, c, t, g, unknown or other
  modified_base (485)..(499): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgacccgattctctggttccttgtctgacacctcagccctccctggcccatcactgggctccagcctgaggatgaggctgattattactgtcagttcctttgactattaaactggatgtgtnttcgggcggagggaccccacgtaaccgtcctaggtcagcccaaggctcgccccctcggtccactcctcgttccccacccttcccgtactcctctcgctgacgcggctggcaacggcgcatagnnnnnnnnnnnnnnn

SEQ ID NO: 414745 - DNA, 678 bp, Homo sapiens
  misc_feature: GZ8MTXP02IFPD6.11.3.A03.1.454.CMB.2.raw
  modified_base (137)..(137): a, c, t, g, unknown or other
  modified_base (661)..(678): a, c, t, g, unknown or other
tcagcgagagataccacgaccggtgctcgatttagagagcgtcacagggtcctgggcccagtctgtgctgacgcagcccgccctcagtgtctggggcccccagggcagacggtcaccatcctcctgcactggaaacngctccaacggtcggggcaggttatgatgttcactggtaccagccaccttccaacaaaccacgaccccccaaactccctcaatatataggtaaacagcattccggccctcgacggggtccctgaccgtatttcctcttcggttcccttgtctacgaccaccctcacgtcccctcccgtggccctatcctacgtcgggcctcccgagtcccgtaggaggtatggaggtcttaggtaattttaattactgtacctacgtttccttttagaaccttaaagtttaaacgtggtatttggttagggttacgttccggggacggtaaccggggaaccccctaacgggttaacccggtccttaacgggtaccctaacgaccccgtaaacgggtcccttacccggtccccccgttacggtaccctacccgttcccgttccccgttcccccgtccccttcccgttaccgttacttcccgttccgtccgtccgtcggacggccgggtactcgggacgaacggccgactagtacgnnnnnnnnnnnnnnnnnn

SEQ ID NO: 414746 - DNA, 471 bp, Homo sapiens
  misc_feature: GZ8MTXP02GGHF1.11.3.A03.1.454.CMB.2.raw
  modified_base (454)..(454): a, c, t, g, unknown or other
  modified_base (465)..(465): a, c, t, g, unknown or other
  modified_base (470)..(471): a, c, t, g, unknown or other
tcagcgagagataccacgaccggtgctcgattagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagccccaaactcctcatatatggtaacagcattcggccctcaggggtccctgaccgattctctggttccttgtctgacacctcagcctccctggccatcactgggctccagcctgaggatgaggctgattattactgtcagtcctttgactattaaactggatgtggtattcgggcggtaggggacccagtaaccgtcctagggtcagcccaaggctgccccctggcactctgtcccacctcctcgtatctctcgctgacgcgggntggcaagggcncatgnn

SEQ ID NO: 414747 - DNA, 519 bp, Homo sapiens
  misc_feature: GZ8MTXP02GBBYH.11.3.A03.1.454.CMB.2.raw
  modified_base (504)..(519): a, c, t, g, unknown or other
tcagcgagagataccacgaccggtgctcgatttagagagcgtcacagggtcctgggcccagtctgtgctgacgcagccgccctcagtgtctggggcccccagggcagacggtcaccatctcctgcactggaaacagctccaacgtcggggcaggttatgatgttcactggtaccagcaccttccacaaacacgcccccaaactcctcatatatggtaacagcattcggccctcgacggggtccctgaccgtattctcttggttccttgtctgacacctcacgccctcccgtgccatccacgtggcctccagcctagaggatggaggctagtattattactgtcagttcttagactataactgatgtgtgtcggcggacgacccacgtaaccgtctaggtcacgacccgagcctccgccccgtcggtcctacctccgttcgtcccccgccttcctcgtctcctctcgtcgtcgacgcgggtcgtcggacgaacggcgacagtagnnnnnnnnnnnnnnnn

SEQ ID NO: 414748 - DNA, 616 bp, Homo sapiens
  misc_feature: GZ8MTXP02HDQJT.11.3.A03.1.454.CMB.2.raw
  modified_base (600)..(616): a, c, t, g, unknown or other
tcagcgagagataccacgaccggtgctcgatttagagagcgtcacagggtcctgggcccagtctgtgctgacgcagccgccctcagtgtctggggcccccagggcagacggtcaccatctcctgcactggaaacagctccaacgtcggggcaggttatgatgttcactggtaccagcaccttccacaaacacgcccccaaactcctcatatatggtaacagcattccggccctcgaggggtccctgaccgattctctggttcccttgtctgacacctcacgccctccctggccatcacgtgggcctccagcctggacggtagtggacggcttaggtatttacttaaccgtgtcgtacggtttcctttagaacctaagtttaaaactgggtattggttgggttacgttcgggaccggggtaaacgggtaccccctaaccgggttaaacccgtccgtaagggtacctacggaccccgtaaaggccctaccggccccccgttcggttaccaccttccttccgttccccctaccccttacctccgttaccttccgtcctccgccgttgacggccgggtacgtcggacgaaggccgacagtacgnnnnnnnnnnnnnnnnn

SEQ ID NO: 414749 - DNA, 488 bp, Homo sapiens
  misc_feature: GZ8MTXP02FHO5Z.11.3.A03.1.454.CMB.2.raw
  modified_base (320)..(321): a, c, t, g, unknown or other
  modified_base (359)..(359): a, c, t, g, unknown or other
  modified_base (368)..(368): a, c, t, g, unknown or other
  modified_base (478)..(478): a, c, t, g, unknown or other
  modified_base (483)..(488): a, c, t, g, unknown or other
tcagcgagagataccacgaccggtgctcgatttagagagcgtcacagggtcctgggcccagtctgtgctgacgcagccgccctcagtgtctggggcccccagggcagacggtcaccatctcctgcactggaaacagctccaacgtcggggcaggttatgatgttcactggtaccagcaccttccacaaaccagcccccaaactcctcatatatggtaacagcattccggcccctcgacggggttcccctgacccgtattctctggttccttgtctgacacctcacgcctccctggccatccactggcctccagcctgagnngaggctgattattactgtcagttccttgactataaacngatgtggtntcgggcggaggacccacgtaaccgtcctagtcacgcccaaggcctcgcccccgtcgcactctcgtcccccgccctcctcgtactctctcgctgcgcgggctggcaaggcncatgnnnnnn

SEQ ID NO: 414750 - DNA, 611 bp, Homo sapiens
  misc_feature: GZ8MTXP02JPFWL.11.3.A03.1.454.CMB.2.raw
  modified_base (383)..(383): a, c, t, g, unknown or other
  modified_base (594)..(611): a, c, t, g, unknown or other
tcagcgagagataccacgaccggtgctcgatttagagagcgtcacagggtcctgggcccagtctgtgctgacgcagccgccctcagtgtctggggcccccagggcagacggtcaccatctcctgcactggaaacagctccaacgtcggggcaggttatgatgttcactggtaccagcaccttccaacaaacacgacccccaaactcctacatatatggtaaacagcattccggccctcgacggggtcccagaccgtattctctggttccttgtctgacacctcacgccctcccgtggcccatccacgtggcctccagcccgtggacggatggacggtctgtatttattactgtactagttcctttagaactaatttaaaacgnggtaattgggtaggttacgtccggggacgggtaaccgggaacccctaacgggttaacccgtccgttaagggtaccgaacggaccccgaaacggcctaccggtcccccgttacggtaccctccttccgttcccgttaccccctaccccttcccgttccgttacttcctccgttcgtcctcgacggcggacgtcggcgaacggcgacagtcgnnnnnnnnnnnnnnnnnn

SEQ ID NO: 414751 - DNA, 485 bp, Homo sapiens
  misc_feature: GZ8MTXP02H6OWZ.11.3.A03.1.454.CMB.2.raw
  modified_base (330)..(330): a, c, t, g, unknown or other
  modified_base (350)..(350): a, c, t, g, unknown or other
  modified_base (361)..(361): a, c, t, g, unknown or other
  modified_base (401)..(401): a, c, t, g, unknown or other
  modified_base (412)..(412): a, c, t, g, unknown or other
  modified_base (472)..(485): a, c, t, g, unknown or other
tcagcgagagataccacgaccggtgctcgatttagagagcgtcacagggtcctgggcccagtctgtgctgacgcagccgccctcagtgtctggggcccccagggcagacggtcaccatctcctgcactggaaacagctccaacgtcggggcaggttatgatgttcactggtaccagcaccttccacaaacacgccccaaactcctcatatatggtaacagcattcgccctcgaggggtccctgaccgattctctggttccttgtctgacacctcagccctcctgccatcactgggctccagcctgaggatgaggctgatttatactgtcngttcctttgactattaaacnggtatgtggtntcgggcggacgggacccacgtaccgtctagtcagccagcncgcccctgtcnctctcgtcccgcctcctcgtactctctcgctagcggcggctcggcgaacggcgcagtagnnnnnnnnnnnnnn

SEQ ID NO: 414752 - DNA, 622 bp, Homo sapiens
  misc_feature: GZ8MTXP02JSKID.11.3.A03.1.454.CMB.2.raw
  modified_base (603)..(603): a, c, t, g, unknown or other
  modified_base (605)..(605): a, c, t, g, unknown or other
  modified_base (607)..(608): a, c, t, g, unknown or other
  modified_base (610)..(622): a, c, t, g, unknown or other
tcagcgagagataccacgaccggtgctcgatttagagagcgtcacagggtccgtgggcccagtctgtgctgacgcagccgccctcagtgtctcggggccccagggcagacggtcaccatctcctgcactggaaacagctccaacgtcggggcaggttatgatgttcactggtaccagcaccttccacaaacacgcccccaaactcctcatatatggtaacagcattcggccctcgacggggtccctgaccgtattctcttggttccttgtctgacacctcacgcctccctggccatccactggggcctccagcccgtggacggatggaggtcttgatttacttacgtgtactagtttccttacgaactagtttaaaacgtggtaacttggtaggttacttccggggacgggtacgggacccctacgggttacccgtccgtacgggtacacggacccgaacgggccgtaccggccccccgttacggtcctaaccgttcccgttccggttccccccgtcccttcccgtcccgttaacgtcccgttccgtccggtccgttagggccggccggggtcgtcgggacgaacggggaccgcgaagtcggngncnncnnnnnnnnnnnnn

SEQ ID NO: 414753 - DNA, 682 bp, Homo sapiens
  misc_feature: GZ8MTXP02J0ZM5.11.3.A03.1.454.CMB.2.raw
  modified_base (662)..(662): a, c, t, g, unknown or other
  modified_base (664)..(664): a, c, t, g, unknown or other
  modified_base (666)..(667): a, c, t, g, unknown or other
  modified_base (669)..(670): a, c, t, g, unknown or other
  modified_base (672)..(682): a, c, t, g, unknown or other
tcagcgagagataccacgaccggtgctcgatttagagagcgtcacagggtcctgggcccagtctgtgctgacgcagccgccctcagtgtctggggcccccagggcagacggtcaccatctcctgcactggaaacagctccaacggtcggggcaggttatgatgttcactggtaccagcaccttccaacaaacacgaccccccaaactcctcatatataggtaacagcattccggccctcgacggggtccctgaccgtattctcttggttcccttgtctgacctaccctcgacgtccctcccgtggcccactccgacgtcgggcctccacgcccgttggacggatcggacggtctaggttaactttagttactgttactacgtttcctttacgaaccttaagtttaaaacgtgggtattaggttagggtttacgttccggggaccgggtaaaccggggaccccttaacccgggttaaaccccggttccgttaagggtacccgtaaccggacccgtaaacgggtcccttcccggtaccccccgtcggtaccctaccgttcccgttcccgttaccccctaccccgttacccgttaccgttacttcccgttcgttccggtcgtacggtacggccgggtcggtacggacgaacggcgcgaaagtcgngngnncnncnnnnnnnnnnn

SEQ ID NO: 414754 - DNA, 558 bp, Homo sapiens
  misc_feature: GZ8MTXP02GZ73A.11.3.A03.1.454.CMB.2.raw
  modified_base (542)..(542): a, c, t, g, unknown or other
  modified_base (544)..(558): a, c, t, g, unknown or other
tcagcgagagataccacgaccggtgctcgatttagagagcgtcacagggtcctgggcccagtctgtgctgacgcagccgccctcagtgtctggggcccccagggcagacggtcaccatctcctgcactggaaacagctccaacgtcggggcaggttatgatgttcactggtaccagccaccttccaacaaacacgcccccaaactcctcatatatggtaacagcattcgccctcgacggggtccctagaccgtattctcgtggttccttgtctgacacctcacgcctccctggccatcacgtggcctccagcctgagatgaggctagattatactgtcagttcttcgactattaaaccgtggtatggtaggttcgttcggggacgggaccgggtaccctaaccggtaaccgtctacggtcacggacccaaggcctcccgcccccgtaggttcccacgttccttccgttaccccgcttaccgtccctggttactcctccgtcgacgtcggacggcgggtctagggcaacgggtcactaactgncnnnnnnnnnnnnnnn

SEQ ID NO: 414755 - DNA, 520 bp, Homo sapiens
  misc_feature: GZ8MTXP02JV4BY.11.3.A03.1.454.CMB.2.raw
  modified_base (321)..(321): a, c, t, g, unknown or other
  modified_base (363)..(363): a, c, t, g, unknown or other
  modified_base (506)..(520): a, c, t, g, unknown or other
tcagcgagagataccacgaccggtgctcgatttagagagcgtcacagggtcctgggcccagtctgtgctgacgcagccgccctcagtgtctggggcccccagggcagacggtcaccatctcctgcactggaaacagctccaacgtcggggcaggttatgatgttcactggtaccagcaccttccacaaacacgcccccaaactcctcatatatggtaacagcattcggccctcgacggggtccctgaccgtattctcgttggttcccttgtctgaccacctcacgccctccctggcccatcacgtcggctccagcctgagntgaggctgatttattactgtcagttcctttagactattaacnggatgtgtgtcgggcggacggacccacgtaccgtctagtcacgacccgagcctccgcccccgtcggtcctacctccttccgtccccacccttcctcgttactcctctcgcgtgacgcgggctacggcgaaggccgacagtcgnnnnnnnnnnnnnnn

SEQ ID NO: 414756 - DNA, 554 bp, Homo sapiens
  misc_feature: GZ8MTXP02G5OLC.11.3.A03.1.454.CMB.2.raw
  modified_base (513)..(513): a, c, t, g, unknown or other
  modified_base (543)..(554): a, c, t, g, unknown or other
tcagcgagagataccacgaccggtgctcgatttagagagcgtcacagggtcctgggcccagtctgtgctgacgcagccgccctcagtgtctggggcccccagggcagacggtcaccatctcctgcactggaaacagctccaacgtcggggcaggttatgatgttcactggtaccagcaccttccaacaaaacacgcccccaaaactcctcaatatatggtaaacagcattcggccctcgaggggtccctgacccgtattctctggttccttgtctgacacctcacgccctccctgccatcactggctccagcctgaggatggagctgaattattacgtgtcagttccttagaactaatttaaaacgtgggtattgtaggttattccggggacggaacggggtaaccccaagttaaacccgtccgtaaggtcccacgacccgaaacggcctccggcccccttcggccctactccgttcgtcccccgcccttcctcgtacttcctccgtcgtcgngacgcgggctcgggcaagggccacatacgnnnnnnnnnnnn

SEQ ID NO: 414757 - DNA, 505 bp, Homo sapiens
  misc_feature: GZ8MTXP02IGCE8.11.3.A03.1.454.CMB.2.raw
  modified_base (358)..(358): a, c, t, g, unknown or other
  modified_base (488)..(505): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagccaccttccaacaaaccacgcccccaaactcctcatatatggtaacagcattccggccctcgaggggtccctgacccgatttctctggttccttgtctgcacctcagcctccctgccatcacgtggcctccagcctgacgatgaggctgattatactgtctagttcctttagactattaaacngtattgtgtgttcggcggacggaccctacgtaaccgtctacgtcagcccaagcctcgcccctggtccactctccgtcccacctcctcgtactcttcgtcgtcgtgcgcggcgtggcgaaggcgcaagtgnnnnnnnnnnnnnnnnnn

SEQ ID NO: 414758 - DNA, 491 bp, Homo sapiens
  misc_feature: GZ8MTXP02FOJ6E.11.3.A03.1.454.CMB.2.raw
  modified_base (435)..(435): a, c, t, g, unknown or other
  modified_base (446)..(446): a, c, t, g, unknown or other
  modified_base (481)..(481): a, c, t, g, unknown or other
  modified_base (486)..(491): a, c, t, g, unknown or other
tcagcgagagataccacgaccggtgctcgatttagagagcgtcacagggtcctgggcccagtctgtgctgacgcagccgccctcagtgtctggggcccccagggcagacggtcaccatctcctgcactggaaacagctccaacgtcggggcaggttatgatgttcactggtaccagcaccttccacaaacacgcccccaaactcctcatatatggtaacagcattcggccctgacggggtccctgacccgattctctggttccttgtctgacaccctcacgtccctccctggccatccacgtcgggcctcccagccctggaggatgaggctagtatttattactgtctacgttctttagactattaaactggtatgtggttagtcgggcggacggacccacgtacgtctaggtcacgcccagctcgccctcgtcnctctcgtcccncctctctactctctcgctgacgcggctggcaggcncatgnnnnnn

SEQ ID NO: 414759 - DNA, 629 bp, Homo sapiens
  misc_feature: GZ8MTXP02GKSXE.11.3.A03.1.454.CMB.2.raw
  modified_base (616)..(629): a, c, t, g, unknown or other
tcagcgagagataccacgaccggtgctcgatttagagagcgtcacagggtcctgggcccagtctgtgctgacgcagccgccctcagtgtctggggccccagggcagacggtcaccatctcctgcactggaaacagctccaacggtcggggcaggttatgatgttcactggtaccagcaccttccaacaaacacgacccccaaactcctacatatataggtaacagctattccggccctacgacggggtccctgaccgtattctcgttcggttccttgtctgaccaccgtcacgccctccctcggcctactccgacgtcgggcctcccacgtcccgtggaaggtactggacggtctagtatttacgtttactcgtctagttcctttacgaactaattaacgtggtattggttggttacggttcgggacgggtaccggggacccctaaccggtaacccgtaccgtacggtaccaccgtacccgaaggtcccgtacccgcccccgttccggtccctaccgttcccgttcccgtcccccgtccccgttcccttaccggttccttcccgttccgtccgtcgtgaccgggtccgggtcgtcgggacgacggcgactacgtgnnnnnnnnnnnnnn

SEQ ID NO: 414760 - DNA, 433 bp, Homo sapiens
  misc_feature: GZ8MTXP01EZ0WG.38.42.D09.1.454.CMB.2.raw
  modified_base (428)..(433): a, c, t, g, unknown or other
tcagtcgatcacgtcacgaccggtgctcgatttagacacatacgcagggaaagggctggagtgggttggccgtattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattactgtatgtatagcagtggctcagggcactactacggtatgggacgtctggggccaagggaccacggtcaccgtctcctcagcctccaccaagggcccatcggtctccccctggcaccctcctccaagagcacctctgggggcacacgcggcctgggctgccctggtcaaggctacttccacgtgatcgactgagcgggctggcaaggcgcatagnnnnnn

SEQ ID NO: 414761 - DNA, 434 bp, Homo sapiens
  misc_feature: GZ8MTXP01DKB03.38.42.D09.1.454.CMB.2.raw
  modified_base (423)..(423): a, c, t, g, unknown or other
  modified_base (426)..(434): a, c, t, g, unknown or other
tcagtcgatcacgtcacgaccggtgctcgatttagacacatacgcagggaaagggctggagtgggttggccgtattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattactgtatgtatagcagtggctcagggcactactacggtatggacgtctggggccaagggaccacggtcaccgtctcctcagcctccaccaaggcccatcggtcttcccctggcaccctcctccaagagcacctctgggggcacacgcggcctgggctgcctggtcaaggctacttccacgtgatcgactgagcgggctggcaaggcgctanagnnnnnnnnn

SEQ ID NO: 414762 - DNA, 540 bp, Homo sapiens
  misc_feature: GZ8MTXP01CR3JG.38.42.D09.1.454.CMB.2.raw
  modified_base (175)..(175): a, c, t, g, unknown or other
  modified_base (312)..(312): a, c, t, g, unknown or other
  modified_base (518)..(540): a, c, t, g, unknown or other
tcagtcgatcacgtcacgaccggtgctcgatttagacacatacgcagggaaagggctggagtgggttggccgtattagaagtaaagctaacagttacgcgacagcatatgttgcgtcggtgaaaggcaggttcaccatctccagagatgattacaaaagaacacggtcgttttcngacaaaatgaaacagacctaaggaaaaaccgaggacacggccgtagttatatgtatgtatagcagtgctacgaggacactacgtacggtatgggacgtcgtgggggaccaagggaccacggtcacccggtctcccanacgccctaccaaccgaagggccccatcccggtcccttcccccgcggccctaacccctccacgaaagcgaccctaccgtcggcgggggacaaccgtcggcccggccgtggggactcgacccgttagggaacaaacggtacctaccgttccgaacgtgtaaactccgaacggcggacggcggcggacggacgaacggacgacgagagnnnnnnnnnnnnnnnnnnnnnnn

SEQ ID NO: 414763 - DNA, 515 bp, Homo sapiens
  misc_feature: GZ8MTXP01A26NW.38.42.D09.1.454.CMB.2.raw
  modified_base (171)..(171): a, c, t, g, unknown or other
  modified_base (373)..(373): a, c, t, g, unknown or other
  modified_base (494)..(494): a, c, t, g, unknown or other
  modified_base (496)..(499): a, c, t, g, unknown or other
  modified_base (501)..(515): a, c, t, g, unknown or other
tcagtcgatcacgtcacgaccggtgctcgatttagacacatacgcagggaaagggctggagtgggttggccgtattagaagtaaagctaacagttacgcgacagcatatgttgcgtcggtgaaaggcaggttcaccatctccagagatgattcaaagaacacggcgtttcngcaaatgaacagcctagaaaaccgaggacacggccgtgtattactgtatgtatagcagtggctcgaggcactacgtacggtatgggacgtcgtggggaccaaggggaccacgggtcaccgtctccctcgacgccctccaccgaacgggccccagtccggtccctcccccgtggcccacccctcctccaagcgccacctcggnggggcacgacgccggcctgggcctcgtcccgtagggtccaaacgggtaccttaccgttaccccgacgtagacgtccgacgtacggacgggcgggacctgggacgaaacgggcgacagtagngnnnngnnnnnnnnnnnnnnn

SEQ ID NO: 414764 - DNA, 474 bp, Homo sapiens
  misc_feature: GZ8MTXP01C89CV.38.42.D09.1.454.CMB.2.raw
  modified_base (461)..(474): a, c, t, g, unknown or other
tcagtcgatcacgtcacgaccggtgctcgatttagacacatacgcagggaaagggctggagtgggttggccgtattagaagtaaagctaacagttacgcgacagcatatgttgcgtcggtgaaaggcaggttcaccatctccagagatgattcaaagaacacggcgtttctgacaaaatgaacagcctagaaaaccgaggacacggccgtgtattactgtatgtatagcagtggctcgagggcactactacggtatgggacgtcgtggggccgaagggaccacggtcaccgtctcctcacgcctcccaccgaagggccccagtcccggtcccttcccccgtcggccacccctcctaccaacgacgccaccgtcgtcgggggcacgacgccggccgtggcctgccctggcaaggtacctacgtccagtgatcgactgacggcggctggacgaaggcgacagnnnnnnnnnnnnnn

SEQ ID NO: 414765 - DNA, 436 bp, Homo sapiens
  misc_feature: GZ8MTXP02I3087.38.42.D09.1.454.CMB.2.raw
  modified_base (430)..(436): a, c, t, g, unknown or other
tcagtcgatcacgtcacgaccggtgctcgatttagacacatacgcagggaaagggctggagtgggttggccgtattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattactgtatgtatagcagtggctcagggcactactacggtatggacgtctggggccaaggggaccacggtcaccgtctcctcagcctccaccaaggcccatcggtctccccctggcaccctcctccaagacgcacctctgggggcacacgcggccctggggctgcctggtcaaggactacttccacgtgatcgactgagcgggctggcaaggcgcatagnnnnnnn

SEQ ID NO: 414766 - DNA, 435 bp, Homo sapiens
  misc_feature: GZ8MTXP02JPL0Q.38.42.D09.1.454.CMB.2.raw
  modified_base (429)..(435): a, c, t, g, unknown or other
tcagtcgatcacgtcacgaccggtgctcgatttagacacatacgcagggaaagggctggagtgggttggccgtattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattactgtatgtatagcagtggctcagggcactactacggtatgggacgtctggggccaaggggaccacggtcaccgtctcctcagcctccaccaaggcccatcggtctccccctggccaccctcctccaagacgcacctctggggcacacgcggccctgggctgcctggtcaaggctacttccacgtgactcgactgagcgggctggcaggcgcatagnnnnnnn

SEQ ID NO: 414767 - DNA, 444 bp, Homo sapiens
  misc_feature: GZ8MTXP02I9RNO.38.42.D09.1.454.CMB.2.raw
  modified_base (313)..(313): a, c, t, g, unknown or other
  modified_base (437)..(444): a, c, t, g, unknown or other
tcagtcgatcacgtcacgaccggtgctcgatttagacacatacgcagggaaagggctggagtgggttggccgtattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattactgtatgtatagcagtggctcagggcactactacggtatggacgtcgtggggccaaggggacccacgttcaccgtctcctcagcctccaccaggccccanccggtctccccctggcacccctcctccaagacgcaccctcgtcgggggcacacgccgccctgggctgccctggtcaaggactacttccacgtgatcgactgagcgggctggcaggcgcagtagnnnnnnnn

SEQ ID NO: 414768 - DNA, 492 bp, Homo sapiens
  misc_feature: GZ8MTXP01B4RXZ.3.10.A10.1.454.CMB.2.raw
  modified_base (249)..(249): a, c, t, g, unknown or other
  modified_base (348)..(348): a, c, t, g, unknown or other
  modified_base (413)..(413): a, c, t, g, unknown or other
  modified_base (451)..(451): a, c, t, g, unknown or other
  modified_base (458)..(458): a, c, t, g, unknown or other
tcagagacgcactccacgaccggtgctcgatttagcgtcgatctcaggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgccaaagcaatatgcttattggtaccaanaaaagccaggccaggcccctgtggtggtgatatataaagacagtgagaggccctcagggatccctgagcgattctctggctccagctacagggcaaacngtcacgttgaccatcagtgagtccaggcagaggacgaggctgactatatgcaatcagcagacaanagtaaatcttatctttatgtcttcggatcttgggaccngggttcncgttctaaggtcaagcccaggcccaacccgctcg

SEQ ID NO: 414769 - DNA, 522 bp, Homo sapiens
  misc_feature: GZ8MTXP01EOKXS.3.10.A10.1.454.CMB.2.raw
  modified_base (252)..(252): a, c, t, g, unknown or other
  modified_base (266)..(266): a, c, t, g, unknown or other
  modified_base (270)..(270): a, c, t, g, unknown or other
  modified_base (277)..(277): a, c, t, g, unknown or other
  modified_base (289)..(289): a, c, t, g, unknown or other
  modified_base (299)..(299): a, c, t, g, unknown or other
  modified_base (343)..(343): a, c, t, g, unknown or other
  modified_base (471)..(471): a, c, t, g, unknown or other
tcagagacgcactccacgaccggtgctcgatttagcgtcgatctcagggggtgggtccaggaggcagaacgtctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgcctaaagcaatatgacttaatggtacaanaaagcagcagcccngtgngtgatanataaagacagtnagaggccctnagggatcctgagcgagttctctggctcagctacgagggcaaacngtcacgttgacccatcagtgatcgagcaggagacgagctgactagttattgacaatcagacaagacaaacagtaaatacttatacgtttatgtcttacgggattacgttgggaacctaggggttaccnccgttacctaagggtccaacgccccaaggccccaaaccccttaagttcccg

SEQ ID NO: 414770 - DNA, 493 bp, Homo sapiens
  misc_feature: GZ8MTXP01D77L4.3.10.A10.1.454.CMB.2.raw
  modified_base (251)..(251): a, c, t, g, unknown or other
  modified_base (297)..(297): a, c, t, g, unknown or other
  modified_base (343)..(343): a, c, t, g, unknown or other
  modified_base (457)..(457): a, c, t, g, unknown or other
  modified_base (464)..(464): a, c, t, g, unknown or other
  modified_base (470)..(470): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttatgtacaanaaagcagcagccctgtgtgtgatatataaagacagtgagagccctnagggatccctgagcgacttctctggctccaagctcgagggacaacngtcacgttgaccatcagtggagtccaggcaggaggacgaggctgacttattagttgtacaatcagcagacaaacagtaatacttatctttaatgttcttcggatcgtgggaccngggttcnccgtcnggtcagcccaaggccaaaccccg

SEQ ID NO: 414771 - DNA, 521 bp, Homo sapiens
  misc_feature: GZ8MTXP01BHN7I.3.10.A10.1.454.CMB.2.raw
  modified_base (425)..(425): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtcgtccccaggacagacggccaagatcacctgctctggagatgcattgccaaagcaatatgcttattggtacaacaaagcaggcagccctgtggtggtgatatataaagacagtgagagccctgagggactcctgagcgattctctggctccagctacgagggcaacgagtacacgttgaccatcgagtgacgtccgaggcaggaggacgtagctgactattattgacaatcgagcagacaacagtaatnttatactttatgtcttggattcgttacgggaccgtagggttccgttccgttccgtaaggtcaacggacccacggttaccccaacccgttaactccg

SEQ ID NO: 414772 - DNA, 584 bp, Homo sapiens
  misc_feature: GZ8MTXP01BTM3C.3.10.A10.1.454.CMB.2.raw
  modified_base (214)..(214): a, c, t, g, unknown or other
  modified_base (254)..(254): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctgganatgcattgaccaaagcaatatgtcttattggtaaccaaanaaagccaggcaggccctgtggtgtgatatataaagacagtgagacggccctagagggactcccgtgacgcgtattctccgtggctcgagctacgagggaacaacgagtcacgttcgaccatcgagtgagtccgaggacgaggacggacgaggtctagacttaattacgttgtacgtaaatgaacgacaagtaacaaactaagttaaacttactttaattacttttagtcgtcgtttcggttagttccgttagggtaccgtaacgggttaacccgttcgttacggtaaccacggccctaaacgggccccttaaccctaacgttcgtaaccc

SEQ ID NO: 414773 - DNA, 516 bp, Homo sapiens
  misc_feature: GZ8MTXP01CDHCF.3.10.A10.1.454.CMB.2.raw
tcagagacgcactccacgaccggtgctcgatttagcgtcgatctcagggggtgggtccaggaggcagaactctgggtgtctcaccatggcccggatccctctacttctccccctcctcactctctgcacagactctgaggcctcctatgagctgacacagccaccctcggtgtcagtgtccccaggacagacggccaagatcacctgctctggagatgcattgaccaaagcaatatgcttatggtaccaacaaaagccaggccaggccctgtggtggtgatatataaagacagtgagaggccctgagggatcccgtgagcgattctcgtcggcctccagctacgaaagggacaacgagtccacgttgaccatcaggtggagtccaggcaggaggacgaggctagactattatgtacaagtcagcaagacaaacagtaattacttattctttatgtcttggattcgtgggacagggtcaccgttcttaggtcacgcccagcccaacctcgttcgtcc

SEQ ID NO: 414774 - DNA, 520 bp, Homo sapiens
  misc_feature: GZ8MTXP01CPB4E.3.10.A10.1.454.CMB.2.raw
  modified_base (256)..(256): a, c, t, g, unknown or other
  modified_base (476)..(476): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaaccaaanaaaagccaggccaggcccctgtggtgtgatatataaagacagtgagaggccctgagggactcccgtgagcgtacttctctggctccaagctcgagggacaacagtcacgttgaccatcagtgagtccaggcaggaggacgaggctgacttattaagttgtacaatcagcaagacaaacagtaatacttatctttaatgttctttcggattcgtgggaccngggttccaaccgtcgttaaggcacgacccgaaggcccaaacccc

SEQ ID NO: 414775 - DNA, 505 bp, Homo sapiens
  misc_feature: GZ8MTXP01B4075.3.10.A10.1.454.CMB.2.raw
  modified_base (254)..(254): a, c, t, g, unknown or other
  modified_base (309)..(309): a, c, t, g, unknown or other
  modified_base (450)..(450): a, c, t, g, unknown or other
  modified_base (467)..(467): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaanaaaagccaggccaggcccctgtggtggtgatatataaagacagtgagaggccctnagggatcccgtgagcgattctctggctccaagctcgagggacaacagtcacgttgaccatcagtggagtccaggcagaggacgaggctagactattagttgtacaaatcagcagacaacagtaatacttatcttaatgttnttcggatcgtgggaccngggttcaaccgtctaaggtcacgcccaagcccaacccc

SEQ ID NO: 414776 - DNA, 533 bp, Homo sapiens
  misc_feature: GZ8MTXP01DYT28.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttatggtaaccaacaaaagccaggccaggccctgtggtgtgatatataaagacagtgagatcgccctcgagggtactcccgtgacgccgatttctcgtggcctccgagcctacgaacggggaaccaaacgagtacgaacgttcgacccattcgagtggagtccaaggcaaggagggacgaggctagtacttaagtttacgttgtacaaatcagcaagaacaatagtaatacttatctttattgtcttgatcgttgggacttagggtcacgtctaggtcacgccaagaacccc

SEQ ID NO: 414777 - DNA, 492 bp, Homo sapiens
  misc_feature: GZ8MTXP01EVI8J.3.10.A10.1.454.CMB.2.raw
  modified_base (411)..(411): a, c, t, g, unknown or other
  modified_base (426)..(426): a, c, t, g, unknown or other
  modified_base (438)..(438): a, c, t, g, unknown or other
  modified_base (444)..(444): a, c, t, g, unknown or other
  modified_base (460)..(460): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttatggtacaacaaaagcaggccaggcccctgtggtggtgatatataaagacagtgagaggccctgagggatccctgagcgtattctctggctccgaagctcgagggaacaaacagtcacgttgactatcagtgagtccaggcaggagacgaggctgactattagtgtanaaatcagcagacaanataatacttatnttaatnttcttcgatgtggacnggttcaacgtctaaggtcagccaagccaaccc

SEQ ID NO: 414778 - DNA, 737 bp, Homo sapiens
  misc_feature: GZ8MTXP01ERIHZ.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgcttattggtaaccaaacaaagccaggccaggccctgtggtgtgatatataaagacagtgagagccctgagggactcccgtgacgcgtacttctcgtggcctcccgaaagccttcgaacggggaaccaaacgtacggtacctaacggtttacgaacccaagttccgaagggttcgggacgttacccgaaggggaccgaagggaacggggaccggaagggtaccgttagggtaaacctttaaagttttaacggtttaggttaacgtaaacttacccgaaaggtaaccaaacggaacctaaaaaccgttaagttaaaactttaaaccttttaatttaacctttttaaagttcggtttaccgtttacggggttattacccgggttacgggggttaaaccccgttacgggggttaccccgtaaaccccgggttcccgtttaacggggtacccgtaacccgggacccccgtaaaccggggttaaccccccgtaaaacccccg

SEQ ID NO: 414779 - DNA, 510 bp, Homo sapiens
  misc_feature: GZ8MTXP01DKKC0.3.10.A10.1.454.CMB.2.raw
  modified_base (331)..(331): a, c, t, g, unknown or other
  modified_base (463)..(463): a, c, t, g, unknown or other
  modified_base (470)..(470): a, c, t, g, unknown or other
  modified_base (477)..(477): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaaccaacaaagccaggccaggcccctgtggtggtgatatataaagacagtgagaggccctgagggatccctgagcgacttctntggctccaagctcgagggacaaacagtcacgttgaccatcagtggatccaggcaggaggacgaggctagactattagttgtacaatcagcagacaaacagtaatacttatctttaatgttcttcggattcgngggaccngggttcnccgtcgtggtcacgacccaacggcccaaacccc

SEQ ID NO: 414780 - DNA, 524 bp, Homo sapiens
  misc_feature: GZ8MTXP01DLYM6.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaaagcaaatatgcttattggtaccaaacaaaagccaggccaggcccctgtggtgtgatatataaagacagtgagaggccctcagggatccctgagcgacttctctggctccaagctcagggacaaacagtcacgttgaaccatcagtggagtccgaggcagaggacgaggctagacttattagttgtacaatcagcagacaacagtaatacttatctttaatcgttcttcgggattcggtacgggaccttggggttccaaccgtctaaggtcacgcccaacggccctaaacccc

SEQ ID NO: 414781 - DNA, 536 bp, Homo sapiens
  misc_feature: GZ8MTXP01AM01J.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaaccaacaaaagccaggccaggcccctgtggtggtgatatataaagacagtgagaggccctcgaggggatcccgtgagcgattctctggctccaagctcgagggacaacagtcacgttgaccatcagtgagtccaggcagaggacgaggctgacttattagtgtacaatcagcagacaacagtaatacttattcgtttaatgttcttcggattacgtcggggttacccttaggggttccaacccggttcctaacgggtccgacgaccccaacgggcccctaaaccccg

SEQ ID NO: 414782 - DNA, 533 bp, Homo sapiens
  misc_feature: GZ8MTXP01C4JJM.3.10.A10.1.454.CMB.2.raw
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtcgtcccaggacagacggccaagatcacctgctctggagatgcattgaccaaagcaatatgcttattggtaaccaacaaaagccaggccaggccctggtggtggtgatataataaagacagtgagaggccctgagggactcccgtgagcgtattctcctggctccagctacgagggaacaaacagtcacgttgaccatcagtggagtccgaggcaggaggacgaggctgacttagttattgtacaaatcaagacaagaacaaacagttaaatacttaattcgtttatgtcttcggattcgttggactaggggttcaccggttctaagggtccaacgacccaacggcccaacccgctcg

SEQ ID NO: 414783 - DNA, 524 bp, Homo sapiens
  misc_feature: GZ8MTXP01C96KJ.3.10.A10.1.454.CMB.2.raw
  modified_base (333)..(333): a, c, t, g, unknown or other
  modified_base (381)..(381): a, c, t, g, unknown or other
  modified_base (430)..(430): a, c, t, g, unknown or other
  modified_base (472)..(472): a, c, t, g, unknown or other
tcagagacgcactccacgaccggtgctcgatttagcgtcgatctcagggggctgtgggtccaggaggcagaactctgggtgtctcaccatggcctggatccctctacttcctccccctcctcactctctgcacagactctgaggcctcctatgagctgacacagccaccctcggtgtcagtgtccccaggacagacggccaagatcacctgctctggagatgcattgaccaaagcaatatgcttatggtaccaaacaaaagccaggccaggccctgtggtgtgatataataaagacagtgagaggccctgagggatccctgagcgtacttctntggctcccaagctcaagggacaaacagtcacgttgaccatcagtgganccaggacagagacgagctgatattgttgtacaatcagcagtaaccaaanataatacttatcttaatgttcctttaggatcgtagggaccgngggttcctaacccgtcgttaagggcacgaccccgaaacggccccaaaccccg

SEQ ID NO: 414784 - DNA, 497 bp, Homo sapiens
  misc_feature: GZ8MTXP01C6ZN0.3.10.A10.1.454.CMB.2.raw
  modified_base (251)..(251): a, c, t, g, unknown or other
  modified_base (298)..(298): a, c, t, g, unknown or other
  modified_base (345)..(345): a, c, t, g, unknown or other
  modified_base (385)..(385): a, c, t, g, unknown or other
  modified_base (431)..(431): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttatgtacaanaaagcagccagccctgtgtgtgatatataaagcagtgagaggccctnagggatccctgagcgtattctctggctccaagctcgagggacaaacngtcacgttgaccatcagtggagtccaggcagagacgagcngactattagttgcaatcagcagacaaacagtaaatctatctttaangttcttcggattcgtgggacccttgggttccaaccgtcgtggtcaggccccaaggcccctaacccc

SEQ ID NO: 414785 - DNA, 508 bp, Homo sapiens
  misc_feature: GZ8MTXP01CCS20.3.10.A10.1.454.CMB.2.raw
  modified_base (309)..(309): a, c, t, g, unknown or other
  modified_base (357)..(357): a, c, t, g, unknown or other
  modified_base (467)..(467): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaccaacaaaagccaggccaggcccctgtggtgtgatatataaagacagtgagaggccctnagggatccctgagcgtacttctctggctccaagctcgagggacaaacngtcacgttgaccatcagtggagtccaggcagaggacgaggctgactattagtgtcaatcagcaagacaacagtaatacttatcttaatgttcttcgggatcgtgggaccngggttccaaccgtctaaggtcagacccaaggcccaaccccg

SEQ ID NO: 414786 - DNA, 540 bp, Homo sapiens
  misc_feature: GZ8MTXP01BTN0T.3.10.A10.1.454.CMB.2.raw
  modified_base (256)..(256): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgcttattggtaccaanaaaagcaggccaggcccctgtggtggtgatatataaagacagtgagaggccctgaggggactcccgtgagcgtacttctcgtggcctccaagctcgagggacaacagtcacgttgaccatcaggtggagtccgaggacagaggacgaggctagacttattagttgtacaatcagcagacaaactagtaaactattattctttaatgttcttacggattcggtacgggaccgttagggttccaaccgttcgtaaggtccacggccccaacggcccctaaaccccg

SEQ ID NO: 414787 - DNA, 531 bp, Homo sapiens
  misc_feature: GZ8MTXP01DK1HS.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgcttattggtaaccaacaaaagccaggccacggcccctgtggtggtgatataataaagacagtgagaggccctgagggatccgtgagcgattctctggctcagctacgagggaacaacagtcacgttcgaccatcagtgagtccgaggcaggaggacgaggctgactattattgtacaatcaagcaagacaacagttaaatacttattcttatgttcttcggatcgttagggaccgtgggttccaccggttcgtaaggtcaacgacccgaacggaccctaaccccgcttaaccg

SEQ ID NO: 414788 - DNA, 629 bp, Homo sapiens
  misc_feature: GZ8MTXP01DIEGH.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagcccaccctcggtgtcagtgtccccaggacagacggccaagatcacctgctctggagatgcattgaccaaagcaatatgcttattggtaaccaaacaaaagccaggccaggcccctggtggtggtgaatataataaagacagtgagacggccctcgagggactcccgtggagcgtacttctcgtggcctccgaacggtctcgaagggaccaaacgtagtaccacgttcgaaccctatcgaaggtgggacgtccgaagggacgaagggacgggaacggagggcctaggtaactttagttaagtttcgtactaaattccgaagacaagaactaaacgtaagttaaacttacttaatttcttttaatcgtttcgtttacggaacttcggtacgggttaacccgttggggttaccctaaccggttaccgttaacggtaccgacgaccccgtaaacggccccctaaaccccg

SEQ ID NO: 414789 - DNA, 615 bp, Homo sapiens
  misc_feature: GZ8MTXP01DJHF7.3.10.A10.1.454.CMB.2.raw
  modified_base (608)..(608): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtcgtccccaggacagacggccaagatcacctgctctggagatgcattgaccaaagcaatatgtacttattacggaaccaacaaaagccaggccacggccctgtggtggtgataataataaagcagtgagacggccctagacgggctccgtgacgtcgtattccgtcgtcggctcccgagcgtaacgaagggaacaaacgacgttaccacgttacgaccattcgaggtcggacgtccgagggacaggaacggggacgtagggccttaggaacttagtttacgtagttacaaagttccaaaggcctaaagaacctaaactaagtttaaaactcttttaatctttaattcggttaacttgggttaatccggttagggacccgtaagggttccaccggttctaagggccaacggccccaaacggccctaaaccccgngtaaccg

SEQ ID NO: 414790 - DNA, 504 bp, Homo sapiens
  misc_feature: GZ8MTXP01DJC70.3.10.A10.1.454.CMB.2.raw
  modified_base (450)..(450): a, c, t, g, unknown or other
  modified_base (462)..(462): a, c, t, g, unknown or other
  modified_base (470)..(470): a, c, t, g, unknown or other
  modified_base (501)..(501): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgacttattggtaccaacaaaagccaggccaggccctgtggtggtgatataataaagacagtgagaggcctgagggatccctgagcgattctcctggctcagctacgagggcaacagtcacgttgaccatcagtgagtcaggcagaggacgaggctgactattattgtcaaatcagacagaacaacagtaaatacttatactttatgttcttggntcgttgggaccngggttccncgttctaaggtcaacgccaggcccaacccgntcg

SEQ ID NO: 414791 - DNA, 497 bp, Homo sapiens
  misc_feature: GZ8MTXP01ERHMQ.3.10.A10.1.454.CMB.2.raw
  modified_base (466)..(466): a, c, t, g, unknown or other
  modified_base (494)..(494): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtcgtccccaggacagacggccaagatcacctgctctggagatgcattgaccaaagcaatatgcttattggtaaccaacaaaagccaggccaggcccctgtggtggtgatataataaagacagtgagaggccctgagggatcccgtgagcgattctctggctccagctacgaagggcaaacagtcacgttgaccatcagtggagtcgaggcaggaggacgtagctgactattatgtacaatcagcagacaacagtaatcttatcttatgtcttgatcgttaggctaggttcncgttctggtcaacgccacggccaacccntcg

SEQ ID NO: 414792 - DNA, 585 bp, Homo sapiens
  misc_feature: GZ8MTXP01EBFK7.3.10.A10.1.454.CMB.2.raw
  modified_base (494)..(494): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaaagctaaatatgtaccttaagttacggtaaccaaacaaaagcccaaggccaacggtcccctggtggtggtgataataagtaaagacagtgagacggccctagagggactcccgtgacgcgattctccgtggctccgagcctaacgagggaacaacgagtcacgttgaccatcagtgacgtccgaggcgaaggacgggacgaggctagtaactattattcgtataatcgaagacaagaaccaagtataaattacttattactttangttcttaggattcgttacgggaccgtagggttccaccgttaccgtaaggtaccaacggaccccgaacggaccccaaccccgttaagtcccg

SEQ ID NO: 414793 - DNA, 597 bp, Homo sapiens
  misc_feature: GZ8MTXP01C2DGS.3.10.A10.1.454.CMB.2.raw
  modified_base (283)..(283): a, c, t, g, unknown or other
  modified_base (481)..(481): a, c, t, g, unknown or other
tcagagacgcactccacgaccggtgctcgatttagcgtcgatctcagggggctgtgggtccaggaggcagaactctgggtgtctcaccatggcctggatccctctacttcctccccctcctcactctctgcacagactctgaggcctcctatgagctgacacagcccaccctggtgtcagtcgtccccaggacagacgccaagatcacctgctctggagatgcattgaccaaagcaatatgcttatggtaaccaaacaaagcaggcaggccctggtggtggtnatatataaagacagtagagacgccctcgagggactcccgtgagcgtacttctcgtggcctccgaacgctcgacgggaaacaaacgtacgtaccgtacggttacaaccctagttaccgaagggttacggagttacccggaagggacgaaggagggaaccggtagggctaggaacttattaagttgtaaccaatacaganagaacaaataataatacttattgttaatcgttcttcgaagttcgtacgggaccgttcgggttccgtaaccgttccgtaagggtccaccgttaccgaaaccggccccgtaaaccccg

SEQ ID NO: 414794 - DNA, 479 bp, Homo sapiens
  misc_feature: GZ8MTXP01COLID.3.10.A10.1.454.CMB.2.raw
  modified_base (282)..(282): a, c, t, g, unknown or other
  modified_base (406)..(406): a, c, t, g, unknown or other
  modified_base (408)..(408): a, c, t, g, unknown or other
  modified_base (412)..(412): a, c, t, g, unknown or other
  modified_base (414)..(414): a, c, t, g, unknown or other
  modified_base (416)..(416): a, c, t, g, unknown or other
  modified_base (418)..(418): a, c, t, g, unknown or other
  modified_base (420)..(420): a, c, t, g, unknown or other
  modified_base (423)..(423): a, c, t, g, unknown or other
  modified_base (436)..(436): a, c, t, g, unknown or other
  modified_base (438)..(438): a, c, t, g, unknown or other
  modified_base (440)..(440): a, c, t, g, unknown or other
  modified_base (443)..(443): a, c, t, g, unknown or other
  modified_base (446)..(446): a, c, t, g, unknown or other
  modified_base (462)..(462): a, c, t, g, unknown or other
  modified_base (476)..(476): a, c, t, g, unknown or other
tcagagacgcactccacgaccggtgctcgatttagcgtcgatctcagggggtgggtccaggaggcagaactctgggtgtctcaccatggcctggatccctctacttcctcccctcctcactctctgcacagactctgaggcctcctatgagctgacacagccaccctcggtgtcagtgtccccaggacagacggccaagatcacctgctctggagatgcattgaccaaagcaatatgcttatggtaacaacaaaagccaggccaggccctgtggtgtgatanataaagacagtgagaggccctgagggatcccgtgagcgattctcctggctcagctacaagggcaaacagtcacgttgaaccatcgagtggagtccaggcaggagacgaggctagactatagttnanaatnananananaanataatatatattntntntgntgngacgcgcgcgcgtgcncgcacgaccaaccnctc

SEQ ID NO: 414795 - DNA, 699 bp, Homo sapiens
  misc_feature: GZ8MTXP01AVWFH.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaaccaaacaaaagccaaggccaggccctgtggtggtgatataataaagacagtgagacggccctacgaggggactcccgtgacgcgtactttcctcgtcgggccttcccgaaacggtcccttaacgaaacgggggaaaccaaaccgtacggttaccgtaacggtttacggaaacccctaagtttccgaaaggggtttaggggaaccgttacccgaagggggaccaaggggaacggggaaccgggagggccttaagggaaccttttaagtttaggtttcgggttaacctaaaagttccgaaaggtaccaaaggaaaccaaaaccgtaagttaaactttactttaattcttttaagtcgtttcgttacgggattccgtagggggacccttcgggggttactaaccccggtcgttaacggggtcacggacccctaacgggcccctaaaccccg

SEQ ID NO: 414796 - DNA, 498 bp, Homo sapiens
  misc_feature: GZ8MTXP01DNDGG.3.10.A10.1.454.CMB.2.raw
  modified_base (254)..(254): a, c, t, g, unknown or other
  modified_base (308)..(308): a, c, t, g, unknown or other
  modified_base (462)..(462): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttatggtaccaanaaaagccaggccaggcccctgtggtgtgatatataaagacagtgagaggccctnagggatccctgagcgattctctggctcaagctcgagggacaacagtcacgttgaccatcagtggatcaggcagagacgaggctagactattagttgtacaatcagcaagacaaacagtaatacttatctttaatgttcttcggatcgtgggacngggttcaaccgtctgtcagcccaacggcctaacccc

SEQ ID NO: 414797 - DNA, 593 bp, Homo sapiens
  misc_feature: GZ8MTXP01C7J3E.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctcccctcctcactctctgcacagactctgaggcctcctatgagctgacacagccacctcggtgtcagtgtcccaggacagacggccaagatcacctgctctggagatgcattgaccaaagcaatatgcttatggtaccaaacaaaagccaggccaggccctgtggtggtgatatataaagacagtagagaggccctagagggatccctagacgcgtaacttctcgtggcctccgaaagctcgaaggggaacaaacgtaggtacaacggttcgaaccctattacgaaggttcgggaacgtcccgaaaggggacaagggacgggaacgtagggacctagaaacttagttattaggtacaaatcaagcaagaacaaataagtaaacttacttaatctttaatcgttcgtttcggaattccgttaggggaacccgttgggttaccaacccgtacttaacgggcacggacccaaggttcccgtcccgg

SEQ ID NO: 414798 - DNA, 547 bp, Homo sapiens
  misc_feature: GZ8MTXP01ARJNX.3.10.A10.1.454.CMB.2.raw
  modified_base (251)..(251): a, c, t, g, unknown or other
  modified_base (416)..(416): a, c, t, g, unknown or other
  modified_base (484)..(484): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaanaaaagccaggccaggcccctgtggtggtgatatataaagacagtgagaggccctcgagggactcccgtgagcgtattctctggctccagctacgagggaacaacagtacacgttcgaccatcagtgacgtccgaggcagaggacgaggctgactattatgcaatnagacagacaacagtaaactattattactttagtgttccttggattcgttgggaccgtaggggttaccnccggttccgtaagggttccaacggaccccgaacgggacccctaaaaccccgttcgttaacccg

SEQ ID NO: 414799 - DNA, 633 bp, Homo sapiens
  misc_feature: GZ8MTXP01C7NPF.3.10.A10.1.454.CMB.2.raw
  modified_base (258)..(258): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgcttattggtaaccaaanaaagccaggccaggccctgtggtgtgatatataaagacagtagagacggccctagagggactcccgtgacgcgtacttcctcgtggcctccgaagcctcgagggacaaacgagtcacgtgaacccagtcgaggtggagtccgaagggcaaggagggaaccgagggacctaggtaacttaagtttattcgtaactaaataccgaaggccaaagaacaaaacgtagttaaaattaacctttaattaccttttaatcggtttacgtttacgggaatttaccgggtaacggggttaccccgttgggggttaccccaaccgggtttcccgtaacggggtcccaaccggaacccccgtaagggaaccccctaaaacccccg

SEQ ID NO: 414800 - DNA, 577 bp, Homo sapiens
  misc_feature: GZ8MTXP01DBSFQ.3.10.A10.1.454.CMB.2.raw
  modified_base (419)..(419): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgtacttattcggtaaccaaacaaaacgccaggccacggcccctggtcggtggtgataataataaagacagtagagacggccctacgagggtactcccgtagacgcgtattctccgtaggctcgagctaacgaagggaacaacagtacacgttgaccatcgagtgactcgagcaggaggacgngctagacttatattagtacaatcagacagaaccaatattaaactacttattactttaatgttctacggttattcgacgggtacccgtagggttacccgccgttacgtaacggtacgaaccgaccccgacggttacccaaccccgttaacgttaacccg

SEQ ID NO: 414801 - DNA, 514 bp, Homo sapiens
  misc_feature: GZ8MTXP01BWIFA.3.10.A10.1.454.CMB.2.raw
  modified_base (250)..(250): a, c, t, g, unknown or other
  modified_base (392)..(392): a, c, t, g, unknown or other
  modified_base (420)..(420): a, c, t, g, unknown or other
  modified_base (472)..(472): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgccaaagcaatatgcttattggtaccaanaaaagccaggccaggcccctgtggtggtgatatataaagacagtgagaggccctgagggatcccgtgagcgattctcctggctccgagctacagggaacaaacagtcacgttgaccatcagtgatcagcagaggacgaggcngactattattgacaaatcagcagacaanagtaaatacttatactttatgtcttcggattcgttgggacctaggggttccnccgttctaagggtccaacgcccaaggcccaacccgaattccg

SEQ ID NO: 414802 - DNA, 485 bp, Homo sapiens
  misc_feature: GZ8MTXP01ACLQZ.3.10.A10.1.454.CMB.2.raw
  modified_base (420)..(420): a, c, t, g, unknown or other
  modified_base (437)..(437): a, c, t, g, unknown or other
  modified_base (454)..(454): a, c, t, g, unknown or other
  modified_base (460)..(460): a, c, t, g, unknown or other
  modified_base (466)..(466): a, c, t, g, unknown or other
  modified_base (482)..(482): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaaccaaacaaaagccaggccaggcccctgtggtgtgatatataaagacagtgagaggccctgagggactcctgagcgattctctggctcagctcgagggaacaacagtcacgttgaccatcagtgatcgaggcaggaggacgaggctagactattatgtacaatcagcagacaangtaaatcttatctttangtcttgatcgttggacnggttcncgttcngcaagccagccaaccntcg

SEQ ID NO: 414803 - DNA, 584 bp, Homo sapiens
  misc_feature: GZ8MTXP01C4Q7Y.3.10.A10.1.454.CMB.2.raw
  modified_base (279)..(279): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttatggtaaccaaacaaagccaggccaggcccctgtggtgngatataataaagacagtgagacgccctagagggactccgtgagctattctcctggctcagctaacgagggaacaacagtacacgttcgaaccatcgagttggagtcccgaggcgaaggacggacgaggaccgtagaacttagttattacgtactaacgtacacgaacaagaacctaaagtaattaacttaactttatttactttagtcgttcgttacgttacgtcggttacggtaaccggtcggttaccgttcccgttacgtaacgaccaacgaacccgacgttacccctaaccgttcttaaccg

SEQ ID NO: 414804 - DNA, 602 bp, Homo sapiens
  misc_feature: GZ8MTXP01DOA69.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggcaagatcacctgctctggagatgcattgaccaaagcaatatgtacttattacggtaaccaaacaaaacgccgaggccacggcccctaggtggtggtgaatataaagtaaagacaggtgagaacggcccctagagggactcccgtgacgcgtattctcgtcggctccgagcctaacgaagggaacaaacgacgtaccacgttacgaacctatcgaagtgagtccgaggcaaggacggacgaggctagaactatttatgtacaaatcaagacaagaaccaataagttaaaacttactttaattactttaagtcgttaacgttcggaattcggttacgggaccgtacggttaccgttacccgttacgtaacggtacaacgacccgaacggaccctaaccccgaattcccg

SEQ ID NO: 414805 - DNA, 471 bp, Homo sapiens
  misc_feature: GZ8MTXP01CCMNA.3.10.A10.1.454.CMB.2.raw
  modified_base (258)..(258): a, c, t, g, unknown or other
  modified_base (332)..(332): a, c, t, g, unknown or other
  modified_base (342)..(342): a, c, t, g, unknown or other
  modified_base (354)..(354): a, c, t, g, unknown or other
  modified_base (363)..(363): a, c, t, g, unknown or other
  modified_base (418)..(418): a, c, t, g, unknown or other
  modified_base (427)..(427): a, c, t, g, unknown or other
  modified_base (429)..(429): a, c, t, g, unknown or other
  modified_base (431)..(431): a, c, t, g, unknown or other
  modified_base (434)..(434): a, c, t, g, unknown or other
  modified_base (437)..(437): a, c, t, g, unknown or other
  modified_base (445)..(445): a, c, t, g, unknown or other
  modified_base (448)..(448): a, c, t, g, unknown or other
  modified_base (450)..(450): a, c, t, g, unknown or other
  modified_base (457)..(457): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagcccaccctcggtgtcagtcgtccccaggacagacggccaagatcacctgctctggagatgcattgaccaaagcaatatgcttattggtaccaaanaaagccaggccaggcccctgtggtgtgatatataaagacagtgagaggccctagagggatccctgagcgattcnctggctcaanctgaggacaacngtcacgttnaccatcagtgatcaggcagagcgaggctagatattatgtacaatcagcagacaanatatatatntntnttntgngtgtgcgngcncncgtcgcncgacaacgcgaacc

SEQ ID NO: 414806 - DNA, 508 bp, Homo sapiens
  misc_feature: GZ8MTXP01B7WIV.3.10.A10.1.454.CMB.2.raw
  modified_base (350)..(350): a, c, t, g, unknown or other
  modified_base (423)..(423): a, c, t, g, unknown or other
  modified_base (453)..(453): a, c, t, g, unknown or other
  modified_base (465)..(465): a, c, t, g, unknown or other
tcagagacgcactccacgaccggtgctcgatttagcgtcgatctcaggggctgtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgccaaagcaatatgcttattggtacaacaaaagccaggccaggcccctgtggtggtgatatataaagacagtgagaggccctgagggatccctgagcgattctctggctccaagctcagggacaacngtcacgttgacccatcagtggagtccaggcaggaggacgaggctgactattagtgtcaatcagcagacaaacngtaaatacttatcgtttaatgttcttcggntcgtgggacccnggggttcaaccgtcctaagggtcacgcccaaggcccaaccccg

SEQ ID NO: 414807 - DNA, 610 bp, Homo sapiens
  misc_feature: GZ8MTXP01B5822.3.10.A10.1.454.CMB.2.raw
  modified_base (258)..(258): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccacctcggtgtcagtgtccccaggacagacggccaagatcacctgctctggagatgctattgacctaaagcaaatatgtacttaattggtaaccaaanaaagccaggccaggccctgtggtgtgatataataaagacagtagagacggccctagagggactcccgtgacgcgtagttctccgtggctccgaagccgtaacgaacggggaacaaacgtagtaccaccgttagaaccccaataccgaggttacgggaacgtcccgaagggccaaagggaacgggacggaggcctaggaacttattaattcggtaactaaattcaagacaagaacaaactagttaaacttacttattactttatgttaacttacggatcgttacgggaaccgtagggttccaccgttccgtaaggtcaaccgcccaacggttccccaacccgttcgttaaccg

SEQ ID NO: 414808 - DNA, 508 bp, Homo sapiens
  misc_feature: GZ8MTXP01AMMGZ.3.10.A10.1.454.CMB.2.raw
  modified_base (253)..(253): a, c, t, g, unknown or other
  modified_base (459)..(459): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgaccaaagcaatatgcttattggtaaccaaanaaagccaggccaggcccctgtggtggtgatatataaagacagtgagaggccctgagggactcccgtgagcgattctctggctccagctacagggaacaacagtcacgttgacgatcagtggagtcgaggcagaggacgaggctagacttattatgtacaatcagcaagacaacagtaatacttatctttaatgttcttcggatcgngggaccaggttcgccgttctaaggtcaacgcccaaggcccaaccgctcg

SEQ ID NO: 414809 - DNA, 561 bp, Homo sapiens
  misc_feature: GZ8MTXP01CCXZI.3.10.A10.1.454.CMB.2.raw
  modified_base (216)..(216): a, c, t, g, unknown or other
  modified_base (333)..(333): a, c, t, g, unknown or other
  modified_base (553)..(553): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctgganatgcattgaccaaagcaatatgcttattggtaaccaaacaaaagccaggccaggccctgtggtgtgatataataaagacagtgagacggccctagagggactccgtgagcgtattcncctggctcgagctaacgagggaacaacagtcgacgttagaccatcaggtgacgtccgaggcaggaggacgagctagactattatgtacatcagcaagacaaactagttaaactacttaattactttatcgttaacgttcgggattcgttaggggaaccgtacgggttaccgaccggttccgtaagggtccaacggaccccaaagggacccctaaaccccngttaaccg

SEQ ID NO: 414810 - DNA, 511 bp, Homo sapiens
  misc_feature: GZ8MTXP01BRNHS.3.10.A10.1.454.CMB.2.raw
  modified_base (391)..(391): a, c, t, g, unknown or other
  modified_base (466)..(466): a, c, t, g, unknown or other
  modified_base (504)..(504): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgccaaagcaatatgcttatggtaccaacaaaagccaggccaggcccctgtggtggtgatatataaagacagtgagaggcccctgagggatccctgagcgattctctggctccagctcgagggcaacagtcacgttgaccatcagtggagtccgaggcagaggacgagcgngactattatgtacaatcagcagacaacagtaatacttatctttatgtcttggatcgttggggacctagggttccnccggttcctaaggtcaacgcccaaggacccaaccccgngtaaccg

SEQ ID NO: 414811 - DNA, 521 bp, Homo sapiens
  misc_feature: GZ8MTXP01C5CK8.3.10.A10.1.454.CMB.2.raw
  modified_base (249)..(249): a, c, t, g, unknown or other
  modified_base (421)..(421): a, c, t, g, unknown or other
  modified_base (469)..(469): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttatggtacaanaaaagccaggccaggccctgtggtgtgatatataaagacagtgagaggccctgagggactcccgtgagcgattctctggctccagctacgagggaacaacgagtcacgttgaccatcagtggagtcaggcaggaggacgaggctagactattatgtacaatcagcagacaanagtaaatcttatcttatgtcttggatcgttcgggacctaggggttccnccgttcgtaacgggtcaacggccccaaggttccccaaacccttcgttaaccg

SEQ ID NO: 414812 - DNA, 704 bp, Homo sapiens
  misc_feature: GZ8MTXP01AWLP7.3.10.A10.1.454.CMB.2.raw
  modified_base (218)..(218): a, c, t, g, unknown or other
  modified_base (257)..(257): a, c, t, g, unknown or other
  modified_base (287)..(287): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctgganatgcattgaccaaagcaatatgcttattggtaaccaaanaaaagccaggccaggcccctggtggtggtnatataataaagacagtgagacggccctgagggactcccgtgacgcgtacttctcgtcggcctccgaaagtcctcgaaggggtaaccaaacgacgtacgtaacggtttacgaaccctagttaccgaggttacgggacgttacccggagggaccgaagggacgggaacgggacgggtacttaggaacctttaagtttaaggtttcggtaactaaacgttaccgaaagaccgaaaggtaaaccctaaaagtaacggtttaaaacttaaacttttaacgtttacctttttaaagttcgtttaccggttttacggggttactttaccgggtacgggggttaacccgttcggggttaccgtaaccccggttcgttaacgggttccgaaccggaccccgaacggttaaccccgtaaaacccccg

SEQ ID NO: 414813 - DNA, 548 bp, Homo sapiens
  misc_feature: GZ8MTXP01CWC30.3.10.A10.1.454.CMB.2.raw
  modified_base (278)..(278): a, c, t, g, unknown or other
  modified_base (417)..(417): a, c, t, g, unknown or other
  modified_base (541)..(541): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgcttatggtacaacaaagcaggcagccctgtggtgtgatanataaagacagtgagaggccctgagggactcccgtgacgcgtattctcgtggctcacgctaacgagggaacaacgagtaccacgttcgaccatcgagtggacgtccgaggcaggaggacgagcgtagactattattgtanaaagtcaagacgaagaacaactagttaaactactttattactttatgttcttacggattcgttgggaaccgtgggttccgttccgttccgtaaggtccaacgtcccaacggaccctaaccccgngttcccg

SEQ ID NO: 414814 - DNA, 500 bp, Homo sapiens
  misc_feature: GZ8MTXP01B6KW7.3.10.A10.1.454.CMB.2.raw
  modified_base (469)..(469): a, c, t, g, unknown or other
tcagagacgcactccacgaccggtgctcgatttagcgtcgatctcagggggctgtgggtccaggaggcagaactctgggtgtctcaccatggactggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaagcaggccaggcccctgtggtgtgatatataaagacagtgagaggccctcagggatccctgagcgattctctggctccaagctcgagggacaacagtcacgttgaccatcagtggagtccaggcaggaggacgaggctagactattagttgtcaagtcagcagacaacagtaatacttatctttaatgttcttggatcgtggacttgggttcnccgtcgaaggtcacgcccaaggcccaacccg

SEQ ID NO: 414815 - DNA, 530 bp, Homo sapiens
  misc_feature: GZ8MTXP01AGKFJ.3.10.A10.1.454.CMB.2.raw
  modified_base (364)..(364): a, c, t, g, unknown or other
  modified_base (463)..(463): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaccaaacaaaagccaggccaggcccctgtggtggtgatataataaagacagtgagaggccctcgaggggactcccgtgacgcgtacttctctggctccaagctcgagggacaacngtcacgttgacccatcgaggtggagtccgaggcaggaggacgagggctagacttattagtgtacaatcagcaagacaaacagtaatacttatctttaangttcttgatcgtcgggaccttgggttccaaccgtctaacggtccacgaccctaacggccctaacccc

SEQ ID NO: 414816 - DNA, 507 bp, Homo sapiens
  misc_feature: GZ8MTXP01AO6C7.3.10.A10.1.454.CMB.2.raw
  modified_base (426)..(426): a, c, t, g, unknown or other
  modified_base (471)..(471): a, c, t, g, unknown or other
  modified_base (503)..(503): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgccaaagcaatatgcttatggtaccaaacaaaagccaggccaggcccctgtggtggtgatatataaagacagtgagaggccctgagggactcccgtgagcgattctcctggctccagctacgagggaacaacagtcacgttgaccatcagtggagtccgaggcaggaggacgaggctgactattatgtacaatcagcaagacaanagtaaatcttatctttatgtcttcggatcgagggaccagggttcnccgttctaaggtcaacgcccgagcccaacccngtcg

SEQ ID NO: 414817 - DNA, 573 bp, Homo sapiens
  misc_feature: GZ8MTXP01C3BS7.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaaccaacaaaagccaggccaggcccctgtggtggtgatatataaagacagtgagaggccctgagggatccctgagcgattctctggctccagctacgaagggcaacagtcacgttgaccatcgagtggagtccgaggcagaggacgaggctagactattattgtacgaatcaagcaagaacaactagtaaattacttattactttattgttcttacggttattcgttacgggtaaccgtacggggttacccaccgggttacccgtaagggttacccaaccggtaccccgaaacggggacccctaaacccccgttcgtttaaccccgg

SEQ ID NO: 414818 - DNA, 572 bp, Homo sapiens
  misc_feature: GZ8MTXP01A8WP1.3.10.A10.1.454.CMB.2.raw
  modified_base (444)..(444): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaaagatcacctgctctggagatgcattgaccaaagcaatatgcttatggtaacaacaaaagccaggccaggcccctgtggtggtgatatataaagacaggtgagaggccctgagggactcccgtgagcgtacttctcgtggctcccgaagcctcgaacggggacaaacgagtaccacggttagaacccatcgaaggtggacgtcccgaggacaggagggacgaggctaggactagtttagtgtanaatcagacagaacaaacagtaattaacttatctttaagtcgttctcggttatcggtcggggttacccttggggttccctaaccggttccgtaagggtccacggaccccgaacggttccccaaaccccg

SEQ ID NO: 414819 - DNA, 663 bp, Homo sapiens
  misc_feature: GZ8MTXP01D64C5.3.10.A10.1.454.CMB.2.raw
  modified_base (264)..(264): a, c, t, g, unknown or other
tcagagacgcactccacgaccggtgctcgatttagcgtcgatctcagggggctgtgggtccaggaggcagaactctgggtgtctcaccatggcctggatccctctacttcctccccctcctcactctctgcacagactctgaggcctcctatgagctgacacagccaccctcggtgtcagtcgtccccaggacagacggccaagatcacctgctctggagatgcattcgaccaaagcaaattatgtcttaattggtaaccaaanaaagccaaggccaggcccctggtggtggtagatataataaagacaagtagagacggcccctagagggactcccgtagacgcgtacttcctcgtggcctccgaaagtcctcgaagggaacaaaccgagtcctaacgttcgaacccatcgaaggtggagtccgaaggacgaaggagggacgaggctaggaacttagtttagttgtacaatacgaagaccgaagaaactaaactaagttaaattaacctttatttccttttaaagtcggtttacgtttacgggttaacttaccgggttacggggttaacccgttacggggttaccccgtaacccgggttaccgttaaccgggttacccgaacccggacccccgtaaaaccgggaacccccgtaaaacccccg

SEQ ID NO: 414820 - DNA, 525 bp, Homo sapiens
  misc_feature: GZ8MTXP01EPZOL.3.10.A10.1.454.CMB.2.raw
  modified_base (374)..(374): a, c, t, g, unknown or other
  modified_base (451)..(451): a, c, t, g, unknown or other
tcagagacgcactccacgaccggtgctcgatttagcgtcgatctcaggggggtggggtccaggaggcagaactctgggtgtctcaccatggcctggatccctctacttctcccctcctcactctctgcacagactctgaggcctcctatgagctgacacagccacctcggtgtcagtgtccccaggacagacggccaagatcacctgctctggagatgcagttcgaccaaaagcaatatgcttattggtaaccaaacaaaagccaggaccacggcccctgtggtggtgatataataaagacagtgagaggccctagagggactccgtgacgcgtattctcctggctccagctacgagggaacacagtcacgttnacatcagtgatcgaggcaggaggacgaggctagactattatgaccgaatcagacagacaatagtaatactatcttangtcttgattcgttcgggactggggttccaccgttcgtaaggctaacgacccacggacccaacccgttaagtccg

SEQ ID NO: 414821 - DNA, 775 bp, Homo sapiens
  misc_feature: GZ8MTXP01EHBOW.3.10.A10.1.454.CMB.2.raw
  modified_base (223)..(223): a, c, t, g, unknown or other
  modified_base (668)..(668): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacacgcccaccctcggtgtcagtcgtccccaggacagacggccaagactcacctgctcgtgganatgcattcgaccaaagcaaattatgtactttaagttacggtaaaccaaacgaaaaacggccgaacgggcccgaaccgggtccccccgttgggtacggggttagggttaggtaaattaaagttaaaacgtaaaaaaggaacgtaaagggttaggaaacgggaaccgggtacccccgttacggaaacgggggtaaccttccccgtaggaacggtaccgtaactttccgtacgtcgggtcctacccggaaacgtccgttaacgggaaacggggaaaccctaaacgtaacggttacccgtaaacggtttcggaaaccctacgtaccgaagggttgggaaccgtaccgaagggaccgaagggaacggacggaggctaaggtaactttaagttacttggtaacaatacgaagaacaagaaactaaacgtaataaactttaacttaactttntttaaacgttgttcgttacgggttactcggtacggggttaacccgttgggttaccctaacccggtacgtaacggtaccgacgaccccgaaccgaaccccgtaacccc

SEQ ID NO: 414822 - DNA, 505 bp, Homo sapiens
  misc_feature: GZ8MTXP01B4DCB.3.10.A10.1.454.CMB.2.raw
  modified_base (455)..(455): a, c, t, g, unknown or other
  modified_base (500)..(500): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgaccaaagcaatatgcttattggtaccaacaaaagccaggccaggcccctgtggtggtgatatataaagacagtgagaggccctgagggatccctgagcgattctctggctccagctacagggaacaaacagtcacgttgaccatcagtggagtccaggcaggaagggacgaggctgactattattgtacaatcagcagacaacagtaaatacttatcttatgtcttcgatcgnggacctagggttcaccgttctaaggtcaagcccaggcccaacccncgtcg

SEQ ID NO: 414823 - DNA, 566 bp, Homo sapiens
  misc_feature: GZ8MTXP01BPJCV.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttatggtaccaacaaaagccaggccaggccctgtggtggtgatataataaagacagtgagaggccctgagggactccgtgagcgattctctggctccgagctcgagggcaacagtcacgttgaccatcagtgagtccgaggcaggaggacgagcgagacttattattgtacgaattcgaagcaagaaccaaagtaagttaaatacctttattacttttaatgttaacgtttcggaattcgttacggggtaacccgtaaggggttcccacccggttccgtaagggtccaacggaccccgaacgggacccccaaaaccccttgttaacccg

SEQ ID NO: 414824 - DNA, 511 bp, Homo sapiens
  misc_feature: GZ8MTXP01EBK1Z.3.10.A10.1.454.CMB.2.raw
  modified_base (248)..(248): a, c, t, g, unknown or other
  modified_base (466)..(466): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccacctcggtgtcagtgtcccaggacagacggccaagatcacctgctctggagatgcattgaccaaagcaatatgcttatggtaccaanaaaagcaggcaggccctgtggtggtgatatataaagacagtgagagcctagagggatccgtgagcgattctcgtggctccgagctacgagggaacaacagtcacgttgaccatcagtgagtcaggcaggagacgaggctagactattatgcaatcgagcaagacaacgtagtaaattacttatactttatgttcttggatcgttcggacctgggttcnccgttctaaggtcaacgtccccaaggcccaaccccgttaagtccg

SEQ ID NO: 414825 - DNA, 513 bp, Homo sapiens
  misc_feature: GZ8MTXP01ERX9R.3.10.A10.1.454.CMB.2.raw
  modified_base (253)..(253): a, c, t, g, unknown or other
  modified_base (352)..(352): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttatggtacaanaaagcaggccaggccctgtggtgtgatatataaagacaggtgagaggccctgagggatccctgagcgtacttctactggctccaagctgagggacaacngtcacgtgaccatcagtggatccaggcaggagacgagctagactattagtgtacaatcagcagacaatgtaatacttatctttaatagttcttcgaatcggtgggaccgttgggttccctaaccggtctaagggtcacggcccaacggttcccaaaccccg

SEQ ID NO: 414826 - DNA, 770 bp, Homo sapiens
  misc_feature: GZ8MTXP01C26IC.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtcccaggacagacggccaagatcacctgctctggagatgcattgaccaaaagcaaatatgacttataggtaaccaaacaaaagccacggaccacggcccctaggtggtggtagataataataaaagacagtgagacggccctagagggactccgtagagcgtattctccgtggctcccgagctaacgaacgggaacaaacgtaggtacctaacggttacgaaccctattaccgaaggttagggaacgttaccccggaaggggaccaagggggaaacgggtaaccggtaaggggcctttaagggaaaccgtttaagtttaactttaggttaaccgaaaattacccgaaggaaccaaaggtaaaacccaaaagttaaaggttaaaaaactttaccgtttttaaagtttaccctttaaatttcggttaaccccgttttagggggaaacttttcccgggttacggggggtaaaacccgtaacggggggtttaccccaaacccggggtttccccgttaaagggggttacccaaccgggtaaaccccccgaaaacggggttacccccccaaaaaccccccgtttaacgttaacccgg

SEQ ID NO: 414827 - DNA, 739 bp, Homo sapiens
  misc_feature: GZ8MTXP01DM65R.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgtcttatggtaccaaacaaaagccaggccacggccctgtggtggtgatataataaagacagtgagacggccctacgagggactcccgtgagcgacttctcgtggcctccgaagcctcgacggggaacaaacgtacgtacgacggtttacgaaccctaagttccgaaggtaggggtacgtacccgaagggaccgaagggaacgggaacggaacggggtacttacggtaaacctttaaagttttaaggtttcggtaactaaacttaccgaaaggaccaaacggaaactaaaaccgtaaaggtttaaaactttaaccgttttaaagtttaccgtttttaattacggtttaccgttttaccgggttaaacgtttaccgggttacgggggttaaaccccgttacgggggtttacccgtaaccccgggtttacccggttaaccggggttcccgaaccgggttaaacccccgtaaaccggggaacccccccttaaaaacccccccgg

SEQ ID NO: 414828 - DNA, 577 bp, Homo sapiens
  misc_feature: GZ8MTXP01D9LGY.3.10.A10.1.454.CMB.2.raw
  modified_base (572)..(572): a, c, t, g, unknown or other
tcagagacgcactccacgaccggtgctcgatttagcgtcgatctcagggggtgggtccaggaggcagaactctgggtgtctcaccatggcctggatccctctacttcctcccctcctcactctctgcacagactctgaggcctcctatgagctgacacagccaccctcggtgtcagtcgtccccaggacagacggccaagatcacctgctctggagatgcattgaccaaagcaatatgtcttattaggtaaccaaacaaaacgcaggccacggcccctagtggtgtgatataataaagacagtgagaggccctacgagggactccgtagagacgattcctccgtcggctcacgctaacgaagggaacaaacgtagtacctacgttacgaaccatacaggtggagtacccgagggacaggaaggacgaggctgaacttattaattgtacgaaatcaagacaagaacaaacattaaattacttattcgtttaatgttaacttcggatcgttagggaacccgtagggttccaccggttactaagggtacaacgaccccgaaggccctaacccccnttccg

SEQ ID NO: 414829 - DNA, 566 bp, Homo sapiens
  misc_feature: GZ8MTXP01E17PV.3.10.A10.1.454.CMB.2.raw
  modified_base (562)..(562): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgcttattacggtaaccaaacaaaagccaaggccacggcccctggtggtggtgatataataaagacaggtgaggacggccctgagggactcccgtagacgcgtattctcgtggctaccgagcctaacgagggaacaaacgacgtacacgttagaccatcgagtggacgtacgaggcaggaggacgagctagacttaattatagacaatcgagacaagaacaaataagttaacttacttattattactgttccttggatcgttagggaccgtagggttccttccggttcctaagggacaacgacccgaacggacccctaacccgttntccg

SEQ ID NO: 414830 - DNA, 598 bp, Homo sapiens
  misc_feature: GZ8MTXP01CC9UI.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttcctccccctcctcactctctgcacagactctgaggcctcctatgagctgacacagcccaccctcggtgtcagtcgtccccaggacaggacggaccaagatcacctgctcgtggagatgcattgaccaaagcaatatgtacttagttacggtaaccaaacaaaagccaggccacggcccctggtggtgtgaatataataaagacagtgagacggccctgacgggactcccgtgacgcgtacttctgtcggcctccgaagccgtcgaacgggaaccaaacgtacgtacctacgttcgaccctatcgaggtcggacgtaccgagggacagggaggacgaggctagtacttagttagttgtacaatcgagacaagacaaatagttaatacttattctttaatcgttactttcggattcggtacgggaccgttagggttccctaacccggtacgtaacggtccgacgaccccgtaaacggccccgtaaaccccg

SEQ ID NO: 414831 - DNA, 652 bp, Homo sapiens
  misc_feature: GZ8MTXP01BUZ0Q.3.10.A10.1.454.CMB.2.raw
  modified_base (218)..(218): a, c, t, g, unknown or other
  modified_base (257)..(257): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctggtgtcagtcgtccccaggacagacggccaagatcacctgctctgganatgcattgaccaaagcaatatgacttataggaaccaaanaaaagccacggccaggccctgtggtgagatataataaagacaggtagaggacggaccctacggagggacttcccgaggacgtaccgtacgtttcctcgttcggaccttcccaaaggtcctaacggaacggggaaaccaaaccgtacggtacaaccgggtttcaaacccctataccgtaggtgggaacgtccgaagggacgaaggaacgggtacggagtacgtaagtaacgttaagttaggttagtacctaaagaccgaaggaacaaacgtaaaccctaaacgttaaagttaaacctttaagttacctttatttaattcgttacgttacgacgttacgggtacgacggttcgttaccgtcgtacgttcgacgaccgaccgtaacgcccctaacccg

SEQ ID NO: 414832 - DNA, 533 bp, Homo sapiens
  misc_feature: GZ8MTXP01BCCTN.3.10.A10.1.454.CMB.2.raw
  modified_base (358)..(358): a, c, t, g, unknown or other
  modified_base (488)..(488): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttatggtaccaacaaaagccaggccaggccctgtggtggtgatatataaagacagtgagaggccctgagggactcccgtgagcgtacttctctggctccaagctcgagggacaacgngtcacgttgaccatcgaggtggacgtccgaggcaggaggacgaggctagacttattagttgtactaagtcaagcaagaacaaactagtaaattacttaattctttaatgttcttacggatcgtgggacgngggttccaaccgtctaaggtcacgacccaacggccctaacccccg

SEQ ID NO: 414833 - DNA, 623 bp, Homo sapiens
  misc_feature: GZ8MTXP01A7W7C.3.10.A10.1.454.CMB.2.raw
  modified_base (218)..(218): a, c, t, g, unknown or other
tcagagacgcactccacgaccggtgctcgatttagcgtcgatctcagggggctgtgggtccaggaggcagaactctgggtgtctcaccatggcctggatccctctacttctcccctcctcactctctgcacagactctgaggcctcctatgagctgacacagccaccctcggtgtcagtcgtccccaggacagacggccaagatcacctgctctgganatgcattgaccaaagcaatatgtcttataggtaaccaaacaaagccaggccacggcccctggtcggtggtagaatataagtaaagacgtagtagaggacggtccctagagggtactccgtagacgcgtacttcctacgtggcctccgaaagtcctaacggaacgggaaacaaaccgtacggtaccgtacggttacgaaccctagtccgtaggtacgggacgttacgagggacgaaggacggacgaggctagacttattagtgtacactacgagacaagaacaaacgtataaacttacttattactttaagttcgttcgtttacgcgttaccggtagggttaccgttcgggttacctaaccggttccgtaaggtaccacggttacccaaccggcccctaaaccccg

SEQ ID NO: 414834 - DNA, 663 bp, Homo sapiens
  misc_feature: GZ8MTXP01BUXDH.3.10.A10.1.454.CMB.2.raw
  modified_base (220)..(220): a, c, t, g, unknown or other
tcagagacgcactccacgaccggtgctcgatttagcgtcgatctcagggggctgtgggtccaggaggcagaactctgggtgtctcaccatggcctggatccctctacttcctccccctcctcactctctgcacagactctgaggcctcctatgagctgacacagccaccctcggtgtcagtcgtccccaggacagacggccaagatcacctgctctgganatgcattgaccaaagcaatatgtacttataggtaaccaaacaaaagccaaggccacggccccgtggtcggtggtagaataataagtaaaagacaggtagagacggccctagagggtactcccgtgacggacgtacttccgtcgtcggcctaccgaagtctcggaacgggaaccaaacgacgtacacggttacgaaccctatcgaggtcggacgtccgaaggacgaaggaagggaccgtaggcttaggtaacttaagtttagtacgttacaaagtcgaaagcgtaaagaacctaaacgtaagttaaacttaaccttttattccttttaaagtcgtttacgtttacggttagttaccggtacggggaacccgttcgggttacccgtaacccggttacgttaacgggacccacggaccccgaaacggttcccccgtaaaacccccg

SEQ ID NO: 414835 - DNA, 514 bp, Homo sapiens
  misc_feature: GZ8MTXP01ASR2S.3.10.A10.1.454.CMB.2.raw
  modified_base (328)..(328): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttatggtacaacaaagcaggccaggccctgtggtggtgatatataaagacagtgagaggccctcgagggactccctgagcgtattctntggctccaagctcgagggacaaacgagtcacgttgaccatcagtggacgtcgaggcagaggacgaggctgacttattagttgtacaatcagcagacaaacagtaatacttatctttaatgttctgatcgtgggacttggggttcaacccggtctaacgggtcacgttcccgaacggcccaaccccg

SEQ ID NO: 414836 - DNA, 705 bp, Homo sapiens
  misc_feature: GZ8MTXP01E3IMQ.3.10.A10.1.454.CMB.2.raw
  modified_base (215)..(215): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctgganatgctattcgaccaaagctaaatatgtactttaagttacggtaaaccaaaacgaaaacgcccgaacgggacccgaacggtcccccgttggttcgggtggtagtaattaataaagtaaaagacgtaggtaggaaggacggcccctaggaacgggtactccccgaggacgcgtaactttcctaccgtcggctaccgagcctaacgaacgggaacaaacgagtcctacgttcgaacctatacgaggtggacgtaccgaggacaagggacggacggaggctagtacttagttatgactaatcgaagacaaacgaacaaacgtaagttaaaacttactttaacttactttaagttcggttaaccgttcggttaacttccgggttaaacgggaacccggttaacggggttaccccttaacccggtttacccggtaaggtcccgaaacccggaaccccgtaaaccgggaaccccctaaaaccccgttcgttaacccg

SEQ ID NO: 414837 - DNA, 533 bp, Homo sapiens
  misc_feature: GZ8MTXP01AIGQG.3.10.A10.1.454.CMB.2.raw
  modified_base (250)..(250): a, c, t, g, unknown or other
  modified_base (395)..(395): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgaccaaagcaatatgcttattggtacaanaaagccaggccaggccctgtggtgtagatataataaagacagtgagagccctgagggactccctgacgcgtattcgtcctggctccgagctacgagggaacaacagtcacgtgaccatcagtgagtcgaggcaggaggacgagcngactattatgacaatcagcaagacaacgagtaatacttattcttatgttctcgattcgttacgggaacctaggggttcttaccgttaccgtaagggtaccaacggaccccgaacggacccctaacccgaacgttcccg

SEQ ID NO: 414838 - DNA, 551 bp, Homo sapiens
  misc_feature: GZ8MTXP01DUBYG.3.10.A10.1.454.CMB.2.raw
  modified_base (475)..(475): a, c, t, g, unknown or other
  modified_base (542)..(542): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaaagatcacctgctctggagatgcattgaccaaagcaatatgtcttattcggtaaccaaacaaaagccaaggccaggcccctgtggtggtgatataataaagacagtgagaggccctagaggggatcccgtgacgcgtattcgtcctggctccgagctaacgagggaacaaagagtacacgttacgacctagtcgagtggatccgaggcaaggaggacgagggctagaactattattgtacaattcagacaagaacaacgattaaatacttatctttangttcttagattcgttagggacctggttcgttccgttctaagggtcaacgacccaggacccctaaccncgttaaccg

SEQ ID NO: 414839 - DNA, 568 bp, Homo sapiens
  misc_feature: GZ8MTXP01C8C3K.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacaggacggccaagatcacctgctctggagatgcattgaccaaagcaatatgcttataggtaaccaaacaaagccaggccaggccctgtggtggtgatatataaagacagtgagagccctgagggactcctgagcgtacttctgtcggctccgaagctcgaagggaacaaacgagtccaacggttgaaccctatcgacggtgggaacgtccgaaggacaaggaggacgaggtctaggaacttatttagtgtactaatcagcaagacaaactaagtaaatacttaattctttaatgttcgtttacgagttcgtgggttacccgttgggttccctaaccgtctaacggtacgacgacccgtaacgggcccctaaaccccg

SEQ ID NO: 414840 - DNA, 608 bp, Homo sapiens
  misc_feature: GZ8MTXP01EJ2G8.3.10.A10.1.454.CMB.2.raw
  modified_base (257)..(257): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtcgtccccaggacagacggccaagatcacctgctctggagatgcattgaccaaagcaatatgtacttattcggtaaccaaanaaaaacgccaggccacggcccctgtggtggtgatataataaagacagtgagacggcctagagggactccgtgacgcgtattctctggctcagctaacgaggaacaacagtaccacgttcgaacctagtcgaggtggacgtccgaaggcgaaggtaacggacggagggctacggaacttatttagttacgtacgtaaattcgaagaccaagtaaaccaaacgtaaagttaaacttaacttaatttactttaagtcgttaacgttggactcggttacggaccgtaagggttcccgaccggttacgtaacggtcgaaccgacccgaacggacccctaaacccgttcgttaaccg

SEQ ID NO: 414841 - DNA, 563 bp, Homo sapiens
  misc_feature: GZ8MTXP01B8B2H.3.10.A10.1.454.CMB.2.raw
  modified_base (257)..(257): a, c, t, g, unknown or other
  modified_base (477)..(477): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgcttattggtaccaaanaaagccaggccaggcccctgtggtggtgatatataaagacagtgagaggccctgagggactcccgtgagcgtacttctcgtggctccaagctcgagggacaacagtcacgttgaccatcgagtggagtccgaggacgaggaggacgaggctagacttattagttgtacaatcagcagacaaacagttaaatactttaattctttaatcgttcgttacggngttccgtcggggacccgttacggggttccctaacccggttccgtaaggtcccacggttaccccgaaccgggttccccaaacccccg

SEQ ID NO: 414842 - DNA, 670 bp, Homo sapiens
  misc_feature: GZ8MTXP01DOH6W.3.10.A10.1.454.CMB.2.raw
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgctattgaccaaagcaaatatgtacttattacggtaaccaaacaaaagccaaggccaacggcccctggtggtggtagaatataaagtaaaagacaggtgaagacggcccctagaggggactcccgtagacgtcgtattctccgtggctccgagctaacgagggaacaaacgagtacacggttacgaccattaccgaggtcggacgtccgaggacgaagggacgggacggggctaggtaactagttagttcgtacaatcaagacaaacgaacaaagttaacgttaaattaacctttaattaccttttaagtcgtttcgtttaacggacgtttaccgtacggggttacccgtaacgggtttacccaccgggttacccgttaacggggttaaccctaaccgggtaacccccaaacccggggtaccccaaacccccggtaacttcccggttaaccccg

SEQ ID NO: 414843 - DNA, 532 bp, Homo sapiens
  misc_feature: GZ8MTXP01E0K7G.3.10.A10.1.454.CMB.2.raw
  modified_base (460)..(460): a, c, t, g, unknown or other
  modified_base (468)..(468): a, c, t, g, unknown or other
  modified_base (479)..(479): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagcccaccctcggtgtcagtcgtcccaggacagacggccaagatcacctgctctggagatgcattgccaaagcaatatgcttattggtaccaaacaaaagccaggccaggcccctgtggtggtgatatataaagacagtgagacggccctcgaggggactcccgtgacgcgactttcctctggcctccgaagcctcgagggacaacagtcacgttcgaccatcaggtggagtcccgagggcaggagacgaggctgactagttattgcaatcagcagacaacataatacttatctttaangttctggntcgtggaccgnggggttccaacccggtcgtaacggtccacggacccaacggttcccaacccccg

SEQ ID NO: 414844 - DNA, 709 bp, Homo sapiens
  misc_feature: GZ8MTXP01DSRHG.3.10.A10.1.454.CMB.2.raw
tcagagacgcactccacgaccggtgctcgatttagcgtcgatctcagggggtgggtccaggaggcagaactctgggtgtctcaccatggcctggatccctctacttcctccccctcctcactctctgcacagactctgaggcctcctatgagctgacacagcccaccctcggtgtcagtcgtccccaggacagacggccaagatcacctgctcgtggagatgctattgaccaaagcaatatgtacttagttacggtaaccaaacgaaaacgccgacggaccacggccccgtggtgggtaggtagaataataaagtaaagacagtagaggacggccctagacgggtactcccgtagacgtcgtattccgtccgtcggcctccgagtcctaacggaacgggaaccaaacgtacgtaccgtaaccgttacgaaccctagtaccgagggtacggacgtaccgagggacgaagggaacgggaccggaggtactacgtaacttagtttaagttcggtaactaaacgttacgaacgaacgaaacgaaaccgtaaacgtaaagtttaaattacctttaatttactttaagttcggtttaacgttacggttacgtaccgggttacgggtaacccgttagggttaccccgttaccggttaccggtaacggtaccaacccggaacccgaaccggaccccctaaacccgttcgttaacccg

SEQ ID NO: 414845 - DNA, 620 bp, Homo sapiens
  misc_feature: GZ8MTXP01B9TK8.3.10.A10.1.454.CMB.2.raw
  modified_base (394)..(394): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagcccaccctcggtgtcagtcgtccccaggacagacggcaagatcacctgctctggagatgctattgaccaaagcaatatgtacttaagttaggtaaccaaacgaaaacgccaaggcccagggcccctggtgggtggtgaataataagtaaagactaggtgaacggacggtcccctagacgggtactcccgtagacgtcgtattctcgtcggctccgagctacgacgggaacaacngtccagttagacctatcgagtcgacgtccaggcgaggaggacgaggctagactattagtgtacaatcaagacaagaacaacgtaagtttaaacttactttaattacgttttatgtttaacgtttacgggttattaccggacgggtacccgtagggttacccgttaccgttaccgtaacgggtaccgaaccgaccccggaaacggacccaacccccttgttaacccg

SEQ ID NO: 414846 - DNA, 513 bp, Homo sapiens
  misc_feature: GZ8MTXP01BNEXU.3.10.A10.1.454.CMB.2.raw
  modified_base (254)..(254): a, c, t, g, unknown or other
  modified_base (369)..(369): a, c, t, g, unknown or other
  modified_base (457)..(457): a, c, t, g, unknown or other
  modified_base (469)..(469): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtcccccaggacagacggccaagatcacctgctctggagatgcattgccaaagcaatatgcttatggtaccaanaaagccaggccaggccctgtggtgtgatatataaagacagtgagaggccctgagggactcccgtgagcgtacttctctggctccgaagctcgagggacaacagtcacgttgaccntcagtggatccaggcagaggacgaggctgactattagttgtacaatcagcaagacaaacagttaatacttatctttaatgttctcggnttcgtggaccgngggttccaaccgtcgtaagtcacgcccaacggttcccaaccccg

SEQ ID NO: 414847 - DNA, 757 bp, Homo sapiens
  misc_feature: GZ8MTXP01ADC9L.3.10.A10.1.454.CMB.2.raw
  modified_base (253)..(253): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgaccaaagcaatatgcttattggtaaccaaanaaaagccaggccaggccctgtggtggtgatatataaagacagtgagaggccctgagggactcctgagcgtattctctggctcagctacgagggaacaacgagtacctacggttcgaacccagttacgaggttagggaacgttacccggaagggaccgaaagggaacggggtaaccggtaggggtacccgttaagggtaaacctttaaagtttagttttacggtaaccgggtaaaacttccggaaacggtacccaaaagggaaacccctaaaacgtaaaggtttaaaaactttaccttttaaacgttttaccctttttaaagtttcgggtttaacccgttttacgggggttaaccttttacccgggttaaccggggggtaaaccccgttaacggggggtttccccttaaaccccgggtttaccccggttaacgggggttacccaacccgggtaaccccccgaaaacggggttaccccccaaacccccggttaacctttccccggg

SEQ ID NO: 414848 - DNA, 529 bp, Homo sapiens
  misc_feature: GZ8MTXP01D27Z7.3.10.A10.1.454.CMB.2.raw
  modified_base (257)..(257): a, c, t, g, unknown or other
  modified_base (282)..(282): a, c, t, g, unknown or other
  modified_base (473)..(473): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgcttattggtaaccaanaaagcaggccaggccctgtggtgtnatataataaagacagtgagacggccctgagggactcccgtgagcgtacttctctggctccaagctcgagggacaacagtcacgttgacatcagtgagtcgaggacaggaggacgaggactagtacttattagttgtactaatcagcagaacaatagttaattacttattctttaattcgttcttacggttntcggtaggccgttaggttccaaccgtcgtaacgtcacgacctaacggccttcccgg

SEQ ID NO: 414849 - DNA, 608 bp, Homo sapiens
  misc_feature: GZ8MTXP01B7V0P.3.10.A10.1.454.CMB.2.raw
  modified_base (328)..(328): a, c, t, g, unknown or other
  modified_base (456)..(456): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgtcttattaggtaaccaaacaaagccaggccacggcccctgtggtgtgatataataaagacagtagagacggccctgagggactccgngagcgtattctcgtggctccaagctcgaagggacaaacgagtacacgttcgaaccctagtcaggtggacgtccgaggacgaggaggacgaggtctagtacttattagttgtacaatcagacaacgaanaaactaagttaaattacttaatttcttttaagtacgtttcgttacgggttattaccgggtgggaacccgttagggggttaccctaacccgggttacccgttaaggggtaaccccaccggaaccccgtaaacccgggcccctaaaaccccccg

SEQ ID NO: 414850 - DNA, 632 bp, Homo sapiens
  misc_feature: GZ8MTXP01B5IO8.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttatgtacaacaaagcagcagccctgtggtgtgatatataaagacagtgagacggccctgagggtactcccgtgacgcgtacttcctcgtcggcctacccgaagctccggaaaggggaaccaaacgagtaccgacggtttagaacccattcgaacggtggacgtccgaggacgaagggaacggacggaggcgtagtaacttaagttagtttagtacaaattcgaagacaagaacaaacgtaagtaaacttaactttattcttttaattcgttcgttaccggttagttaccggtcggggttaacccgttacggggttccccgttaaacccgggttcccgtaacgggttcccgaacccggacccctaaaccggggaacccctaaaaccccccg

SEQ ID NO: 414851 - DNA, 510 bp, Homo sapiens
  misc_feature: GZ8MTXP01DJ09T.3.10.A10.1.454.CMB.2.raw
  modified_base (251)..(251): a, c, t, g, unknown or other
  modified_base (397)..(397): a, c, t, g, unknown or other
  modified_base (455)..(455): a, c, t, g, unknown or other
tcagagacgcactccacgaccggtgctcgatttagcgtcgatctcagggggtgggtccaggaggcagaactctgggtgtctcaccatggcccggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaanaaaagccaggccaggcccctgtggtgtgatatataaagacagtgagagccctgagggactccctgagcgattctcgtcggctcagctcgaaagggacaacgagtactacgttgaccatcgagtgagtccgaaggcaagaggaacgnggctgacttattatgtacaatcaagcaagacaacagtaatacttatcttatgtctggnttgtggacctgggtcacgttcttaggcacgccgaagcccaaccgtcttcgtaacc

SEQ ID NO: 414852 - DNA, 601 bp, Homo sapiens
  misc_feature: GZ8MTXP01D36E4.3.10.A10.1.454.CMB.2.raw
  modified_base (369)..(369): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgtacttattaggtaacaaacaaagccaaggccacggccctggtggtggtgaataataataaagacagtgagacggccctagagggactccgtgagtctacttctgtcggcctccaagctgaggacaacncgtacacgttgacctatcgaggtggacgtccgaaggacgaaggaggacggagtcgtagtaacgttatttagttacgtacaaatcagacaagaacaaacgtagttaaattactttaatttctttaagttgttaccgtttaggttacgttccggtacgggttaccgttacgggttaccgtaacccgttacgtaacgggtacccgacgaccccgaacggttaacccctaaccccg

SEQ ID NO: 414853 - DNA, 516 bp, Homo sapiens
  misc_feature: GZ8MTXP01ATHWG.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttatggtaccaacaaagccaggccaggcccctgtggtgtgatatataaagacagtgagacggccctgagggactcccgtgagcgattctcctggctccagctacgagggaacaacagtcacgttgacatcagtgagtccgaggcagaggacgaggctgactattatgacatcagcagacaacagtaaatacttatactttatgttcttgggatcgttgggacctaaggggttccaccgttcctaagggtcaacgtcccaggcccaacccgttaagtccg

SEQ ID NO: 414854 - DNA, 505 bp, Homo sapiens
  misc_feature: GZ8MTXP01APOWL.3.10.A10.1.454.CMB.2.raw
  modified_base (246)..(246): a, c, t, g, unknown or other
  modified_base (265)..(265): a, c, t, g, unknown or other
  modified_base (343)..(343): a, c, t, g, unknown or other
  modified_base (411)..(411): a, c, t, g, unknown or other
tcagagacgcactccacgaccggtgctcgatttagcgtcgatctcaggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgccaaagcaatatgtttatgtacaanaaagcaggccaggccctgnggtggtgatatataaagacagtgagaggccctgagggatcccgtgagcgattctctcggctcagctcaagggacaacngtcaacgttgaccatcagtgagtccaggcagaggacgaggctgactatatgtcaatcagacagacaanagtaatacttatctttatagttcttcggattcgtagggaccgagggtcaccgttcttagggtcagccccaagggccaacccaacgttcgtaacc

SEQ ID NO: 414855 - DNA, 642 bp, Homo sapiens
  misc_feature: GZ8MTXP01DOF8N.3.10.A10.1.454.CMB.2.raw
  modified_base (215)..(215): a, c, t, g, unknown or other
  modified_base (256)..(256): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtcgtccccaggacagacggccaagatcacctgctctgganatgcattgaccaaagcaatatgtacttatcggtaaccaaanaaagccaggccaggccctgtggtgtgatataataaagacagtgagacggccctgagggactccgtagacgcgtattctccgtggctccgagtctacgaagggaacaaacgacgtacacgttacgaacctatacgaggtggacgtccgaggcgaaggaggacgaggtctagaacttaagttagttcgtaacaattacgaagtaccgaagaaacctaaacgtaaagtttaaactttactttaacgtttactttaagttcgttaaccgttacgggttacttaccggttacggggtaacccgtcgggggttacccttacccgttccggttaacggtcccgaaccggtaaccccgaaccgggttaacccctaaccccgttaacgtttcccg

SEQ ID NO: 414856 - DNA, 579 bp, Homo sapiens
  misc_feature: GZ8MTXP01E19TD.3.10.A10.1.454.CMB.2.raw
  modified_base (278)..(278): a, c, t, g, unknown or other
  modified_base (353)..(353): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtcgtccccaggacagacggccaagatcacctgctctggagatgcattgaccaaagcaatatgcttatgtacaacaaagcagccagccctgtggtgtgatatanaaagacagtgagacggccctgagggactcccgtgacgcgtattctctcggctccagctacgaacgggaacaacgngtcacgttgaccatcagtggacgtccgagacgaggacggacgaggtctagtacttattatcgtacgaatacgacgtacaacgaaaccaacttaagttaacttactttattactttagtcgttaacgttacgactcggttacggaccggtacggttcccgttacccggttaccgtaacggaccgaacccgaccccgaaccggttaccccctaaccccttcgttcccg

SEQ ID NO: 414857 - DNA, 593 bp, Homo sapiens
  misc_feature: GZ8MTXP01EQS1C.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgtcttattggtaaccaaacaaagccaggccacggcccctggtggtggtgatatataaagacagtgagacggccctgagggactccgtgacgcgtacttctcgtggcctccgaacgctcgagggacaacgagtacacgttcgacctagtcaggtcggagtccagggacaggacggacgaggctaggtacttatttagttgtactaaatcgaagacaagaactaaactaagttaaattaacctttattcttttaagtcgtttcgttacggttaagttcggtacggggttaaccgttcggggttacctaaccgtccgttaaggtccacggttaccccgaacggcccctaaaccccg

SEQ ID NO: 414858 - DNA, 604 bp, Homo sapiens
  misc_feature: GZ8MTXP01BY119.3.10.A10.1.454.CMB.2.raw
  modified_base (258)..(258): a, c, t, g, unknown or other
  modified_base (362)..(362): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgtcttattggaaccaaanaaagcagccaggccctgtggtgtgatataataaagcagtgagacgccctgagggactcccgtgagcgtacttctcgtggcctcgaagctcgagggaacaaacgngtcacgttgacctatcgaggtggacgtaccgaggacaagggaggacggaggctagacttattagttgtactaaagtccgaagacaacgaactaaactaagttaaacttactttattacttttaagtcgtttacgttacggttacttaccgggtacggggttaacccgttcggggttaccctaacccgggttcccgttaagggtcccaacggttaccccgaaacgggttccccctaaaccccg

SEQ ID NO: 414859 - DNA, 585 bp, Homo sapiens
  misc_feature: GZ8MTXP01BUI4W.3.10.A10.1.454.CMB.2.raw
  modified_base (200)..(200): a, c, t, g, unknown or other
  modified_base (377)..(377): a, c, t, g, unknown or other
tcagagacgcactccacgaccggtgctcgatttagcgtcgatctcagggggtgggtccaggaggcagaacgtctgggtgtctcaccatggcctggatccctctacttctccccctcctcactctctgcacagactctgaggcctcctatgagctgacacagccaccctcggtgtcagtgtccccaggacagacggcaagntcacctgctctggagatgcattgacctaaaagcaaatatagacttaattcggtaaccaaacgaaaagccaggccaaggcccctggtggtggtagatataataaagacagtagagacggccctagacgggtactcccgtgacgtcgattctcgtggctcgagctacgagggaacaacngtcacgttcgaccagtaccagtacggactaccgagggcaggtaacggacgaggctagactattaactgtacaatcagtcaagacaactagtaaacttcttaatctttaagtgtcgttggaaacttcgttacgggacctagggttcccaccggttccgtaagggtccccgaaggtcccccgaaggttaccccctaacccgaacgttccg

SEQ ID NO: 414860 - DNA, 567 bp, Homo sapiens
  misc_feature: GZ8MTXP01A6KT9.3.10.A10.1.454.CMB.2.raw
  modified_base (448)..(448): a, c, t, g, unknown or other
  modified_base (466)..(466): a, c, t, g, unknown or other
  modified_base (485)..(485): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtcgtccccaggacagacggccaagatcacctgctctggagatgcattcgaccaaagcaatatgtacttataggtaaccaaacaaaagccaggccaggcccctggtggtggtgatataataaagacagtgagagccctgagggactccgtgagcgtattctccgtggctcagctacgagggaacaacgagtcacgtgaccatcgagtggagtccgaggacgaggacggacggacgctagtactattattgtacaaatcgagacaagaacctaanaattaattacttaatttntttaatgttcttacggttnttccggttgggtaccgcgggttaccgttcccgttacggtcgacgaacggaccccaacggttaccccaacccttcgttaaccg

SEQ ID NO: 414861 - DNA, 685 bp, Homo sapiens
  misc_feature: GZ8MTXP01DRBGQ.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttcctccccctcctcactctctgcacagactctgaggcctcctatgagctgacacagccaccctcggtgtcagtgtccccaggacagacggccaagatcacctgctctggagatgcattgaccaaagcaatatgacttataggtaaccaaacaaagccaggccaacggcccctgtggtggtgaatagtaataaaagactaggtagagacggccctacgagggactccccgtgacgcgtaacttcctcgtcggcctcccgaaacgctcgaaaggggaacaaacgtacgtacctacggttagaaccctagttacgaaggttcgggaacgttcccgaagggaccgtaagggaacgggtaaccggaagggtcctagggtaaatttaaacgtttatttaggtaacctaaaattccggaaaagaaccgaaacgaaactaaaacgtaaacgttaaactttaactttaacgtttacttttaagtcgtttacgttacggttacgttacggtacgggttaaccgttacgggttaccctaaccggttacgtaacggtaccaccggacccgtaaccgaacccctaacccg

SEQ ID NO: 414862 - DNA, 542 bp, Homo sapiens
  misc_feature: GZ8MTXP01A8FSA.3.10.A10.1.454.CMB.2.raw
  modified_base (215)..(215): a, c, t, g, unknown or other
  modified_base (489)..(489): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctgganatgcattgaccaaagcaatatgtacttatggtaaccaaacaaagccaggccacggcccctgtggtggtgatataataaagacagtgagacggccctagagggactcccgtagacgcgtattcctcgtggctccgagctaacgagggaacaacgagtcacgttgaccatcagtgatcgagcagaggagagctagacttattatgtacgaatcagacaagacaactagtaaatacttattcttagtgtctggatcgttagggacctaggggttccnccgttccgtaaggtccaacggaccccaaggacccctaaccccttgttaacccg

SEQ ID NO: 414863 - DNA, 587 bp, Homo sapiens
  misc_feature: GZ8MTXP01AJ2II.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgacaaagcaatatgcttattggtaccaaacaaagccaggccaggcccctggtggtgtgatatataaagacagtgagaggccctgagggactcccgtgacgcgtattctccgtggctccagctacgagggaactaacgagtcacgtgacatcagtgacgtcgagcaggacggacgaggtctaggacttattagttgtaactaagtcgagacaacgaactaacaagttaaacttaactttattacttttaatcggttaacgttacggaattcggttacggggtaccgtaggggttcccttaccgggttccgtaaggggttccaaccgtacccccgaacgggacccccaaaccccggttaattccccg

SEQ ID NO: 414864 - DNA, 620 bp, Homo sapiens
  misc_feature: GZ8MTXP01DB9CI.3.10.A10.1.454.CMB.2.raw
  modified_base (375)..(375): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagcccaccctcggtgtcagtcgtccccaggacagacggccaagatcacctgctctggagatgcattgaccaaagcaatatgtcttagttacggtaaccaaacaaaagccaggccacggccctggtggtgtgaatataataaagacagtagagacggccctgagggtactcccgtgagcgtattctcgtggcctccaagctcgagggacaaacgngtccacgttgaccctatcgaggtggacgtccgaggcaggagacggaggctagtaacttatttagttacgtacaagtcgaagaccgaagaacctaaaacgtagttaaacttactttattacttttaagtcgtttcgttacgggagtttcggtacggggttaacccgttgggggttaccctaacccgggttaccgtaacgggttacccaacccggttaccccgtaaacccgggcccctaaacccccg

SEQ ID NO: 414865 - DNA, 592 bp, Homo sapiens
  misc_feature: GZ8MTXP01AV9V5.3.10.A10.1.454.CMB.2.raw
  modified_base (214)..(214): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctgganatgcattgccaaagcaatatgcttatggtaccaaacaaagccaggccaggccctgtggtggtgatataataaagacagtgagaggcccctgagggactcccgtgacgcgatttctccgtggctcagctacgagggaacaacgagtacacgttcgacatcgagtggactccgaggcaggacgggacgaggctgactattagttgactaatcgaagcaacgaacaaactaagttaaacttactttaatttcttttaaacgtggttcgtttacgggaatttccggttacgggtaaccggtacgggttacccgacccggtttaccgtaaggggtcctaaccggccccgtaaacgggaccccctaaaccccttaacgttcccg

SEQ ID NO: 414866 - DNA, 563 bp, Homo sapiens
  misc_feature: GZ8MTXP01A3CZ5.3.10.A10.1.454.CMB.2.raw
  modified_base (254)..(254): a, c, t, g, unknown or other
  modified_base (471)..(471): a, c, t, g, unknown or other
  modified_base (489)..(489): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggcaagatcacctgctctggagatgcattgaccaaagcaatatgcttattggtaaccaaanaaagccaggccacggccctgtggtgtgatataataaagacagtgagacggccctagagggactccgtagagcgtattctcgtcggctccagctacgagggaacacagtcacgttgaccagtcagtgagtcgaggcaaggacgggacgacggtctaggtacttattacgttgacaagtcagacaagaaacacgaagttaatactttagtactttagtntaacgttcggagttccgngggtaaaccgtgggttaccgcccggttacgtaacggtaccaacgacccgacggaccctaaccccgttgtaaccg

SEQ ID NO: 414867 - DNA, 580 bp, Homo sapiens
  misc_feature: GZ8MTXP01ERTYA.3.10.A10.1.454.CMB.2.raw
  modified_base (353)..(353): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgccaaaagcaatatgcttataggtaacaaacaaaagccaggccaggcccctgtggtgtgatatataaagacagtgagaggccctgagggactcccgtgacgcgattctctggctcagctaacagggcaaacngtcacgttgaccatcgagtggacgtccgaggcaaggagggacgaaggctagaacttattaagttgactaatcagaccaagaacaaacgtagtaaacttacttattaccttaatggttcttacgggattcggttacgggaacccgtagggggtttcccaacccgggtttccgtaagggttcaaccgggccccgtaaaacgggccccaaaaccccccgttgttaacccg

SEQ ID NO: 414868 - DNA, 573 bp, Homo sapiens
  misc_feature: GZ8MTXP01AJUUE.3.10.A10.1.454.CMB.2.raw
  modified_base (254)..(254): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaaccaaanaaaagccaggccaggcccctgtggtggtgaatataataaagacagtgagacgccctgagggactccgtagacgcgtattctccgtggctcagctacgaagggcaacagtcacgttgaccatcagtggatcgaggcaggaggacgaggctagacttattattgtactaatcgtaagacaagaaacaactaagttaaacttacttattactttatcgttcttacgggttacttcggttacgggaaccgttaggggttcccaccgttaccgttaaggggacctaacggaccccaaacgggcccctaaacccgcgttaacccg

SEQ ID NO: 414869 - DNA, 715 bp, Homo sapiens
  misc_feature: GZ8MTXP01BPIKQ.3.10.A10.1.454.CMB.2.raw
  modified_base (257)..(257): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgcttattggtaaccaanaaagcaggccaggcccctgtggtggtgatataataaagacagtgagacggccctgagggactccctgagcgtacttctcgtggcttccgaaagccttcgaaggggaaccaaacgtacggtacctacggtttacgaaccctagtacgtaacgggttcgggaacgttacccgaagggacgaacggggaacgggacgggaacgggtcgtacgggtaaaccttttaacgtttaaggtttcgggttaacctaaaacgttccgtaaggtaccgaaacgggaaacctaaaaccgttaaaggtttaaaactttaaccttttaagtttacctttttaaagttcggtttaccgtttacgggttaaacgttccggttacgggggttacccgttacgggggttccctaaacccgggttcgtaacgggttccgacggttaccccgtaaagggttccccgttaacccccggg

SEQ ID NO: 414870 - DNA, 605 bp, Homo sapiens
  misc_feature: GZ8MTXP01CVUPU.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgtacttattggtaaccaaacaaaagccaggccacggcccctgtggtggtgatataataaagacagtgagacggcctcgagggactccgtgacgcgtattctcctggctcgagctacgagggaacaaacgtagtcaacgttcgaacctagtaccgaggttaggacgtcccgagggaccgaagggagggacggaggtctaggacttaattattgtacaatcgagacaagaacaaacgtagttaaacttacttattactttatgttcgttacggattcggttagggtaaccgtcgggttaccgttacccggttccgtaacgggtaccaaccggaccccgaacgggaccccctaaccccgttcgttaacccg

SEQ ID NO: 414871 - DNA, 590 bp, Homo sapiens
  misc_feature: GZ8MTXP01EOSVX.3.10.A10.1.454.CMB.2.raw
  modified_base (328)..(328): a, c, t, g, unknown or other
  modified_base (370)..(370): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaaatatgtcttagttaggtaaccaaacaaaagccaggccacggcccctggtggtggtgatataataaagacagtgagacggcctgagggactcccgngacgcgtattctcgtggctccagctacgaagggaacaaacgngtacacgttcgaccatcgagtggacgtccgaggcaggacggacgagctagactattagtgtacaatcgagacagaacaacgtaagtaaacttcttattactttaatgttcgttacggttattcggttacgggaaccgtaggggttcccacccggttccgtaacgggtacccgtaaccggaccccgaacggttaccccctaaaaccccgttcgttaacccg

SEQ ID NO: 414872 - DNA, 698 bp, Homo sapiens
  misc_feature: GZ8MTXP01BD3OM.3.10.A10.1.454.CMB.2.raw
  modified_base (223)..(223): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctctatgagctgacacacgccaccctcggtgtcagtcgtccccaggacaggaccggacaagactcacctgctcgtgganatgctattcgaccaaagcaatatgtacttaagttcggtaaaccaaacaaacgccgacggccacggcccgtggtggtggtagtaattaataaagtaaaggactaggtagaacggacggtcccctaggaacgggtacttcccgaggacgccgtactttcgtcgtcggccctccgaacgtccgtaacggaaacgggaacccaaacgtacgttaccgtaacggtttacgaaccctagtccgaaggttcggaacgtaccggagggaccgaagggaggacggacggtctacggtaatttatttaggttacgtaactaagtcaacggacaacgaaactaaactaagttaaacctttatttactttacgtttaagttcgttacgttacggttagttaccgggtacgggttaccggttacgggttccctaacccggttacgtaacggtaccacccggacccgaaccggttaacccctaaccccg

SEQ ID NO: 414873 - DNA, 514 bp, Homo sapiens
  misc_feature: GZ8MTXP01B2E8R.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttatggtacaacaaagccagccaggccctgtggtgtgatataataaagacagtgagacgccctgagggatcccgtgagcgtacttctctggcctcaagctcgagggacaacgatcacgttgaccatcagtgagtccgaggacaggaggacgaggctagaactattagttgtacaatcagcaagacaaacagtaatacttatctttaagtgttctcgatcgtgggaccgttgggttcctaaccgtcgtaagtcagccctaacggccctaacccg

SEQ ID NO: 414874 - DNA, 600 bp, Homo sapiens
  misc_feature: GZ8MTXP01DOWJW.3.10.A10.1.454.CMB.2.raw
  modified_base (255)..(255): a, c, t, g, unknown or other
tcagagacgcactccacgaccggtgctcgatttagcgtcgatctcagggggctgtgggtccaggaggcagaactctgggtgtctcaccatggcctggatccctctacttctccccctctcactctctgcacagactctgaggcctcctatgagctgacacagccacctcggtgtcagtcgtccccaggacagacggccaaagactcacctgctctggagatgctattgaccaaagcaatatgcttatgtaacaanaaagcagcagccctgtggtgtgatataataaagacagtgagacggccctacgagggactccccgtagagtcgtaattcctcgtggcctccgaagctcgaagggaacaaacgtacgtacctacgttacgacccagttcgaaggtggacgtccgaaggacgaggaggacgagggctagtaacttaatttagttacgtactaaattcgaagaccaaggaaccaaaatagttaaatttaccttaattcttttaaagtcgtttacgttacggaacgttcggtacgggttaccgttagggttaccctaacggttacgtcggtacacggaccctaacgggccctaaaccccg

SEQ ID NO: 414875 - DNA, 791 bp, Homo sapiens
  misc_feature: GZ8MTXP01DVKBY.3.10.A10.1.454.CMB.2.raw
  modified_base (217)..(217): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctggacacagccaccctcggtgtcagtcgtccccaggacagacggccaagatcacctgctctgganatgcattcgaccaaagctaatatgtacttaagttacggtaaacccaaaacgaaaacgcccgaacgggacccaacgggtccccctggtagggtggtagaattaataaagtaaaagacagtagaagacggcccctagagggtactccgtagacgcgtacttccgtcgtcggctaccgagtctaacggaagggaacaacgtagtacctaacgttacgaaccctagtacgaggtacggacgtacccgagggaccgaaagggaacgggaaccggtagggtaccgttaggtaaactttaatttaagtttacggtaaacgtaaacttacgaaacggtaaccaaaacggtaaacctaaaaccgttaaaggtttaaaacctttaaccgttttaagttttaaccttttaaagttcgggtttaacgtttaacggggttacgtttaccgggttaacgggggtaaacccgttacggggggttaaccccttaccccggggtttaccggtttaaccgggtaacccgtaaacccgggtaacccccgtaaaccggggaaccccctaaaccccggttaacgtttaaccccgg

SEQ ID NO: 414876 - DNA, 676 bp, Homo sapiens
  misc_feature: GZ8MTXP01D8OND.3.10.A10.1.454.CMB.2.raw
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacacgccaccctcggtgtcagtcgtccccaggacagacggccaagatcacctgctctggagatgctattcgaccaaagctaaatatcgtacttagtacggtaaccaaacaaacgccgaacggccacggcccctggtcgggtggtagaataataaagtaaagacgaggtagaggacggccctagacgggactccgtagacgcgtattccgtcgcggtctaccgagcctaacgacgggaacaaacgtacgtacctacggttacgaacctagtacgtacgtacggtacggtacgacggacgaacgggaaacggacggacggtacgtacgtaacgttaagttaacggttacgttaacgtaacgtaacgtaacgtaacgaaacgtaaacgtaaaacgtaaacgttaaactttaaactttaactttactttaacgtttacgttacgttacgttacgtacgtacggttacggttacggttaccgtaaccgtacgtaacgtacgacgaccgtaaccgaacccgtaaccg

SEQ ID NO: 414877 - DNA, 614 bp, Homo sapiens
  misc_feature: GZ8MTXP01AKMHE.3.10.A10.1.454.CMB.2.raw
  modified_base (221)..(221): a, c, t, g, unknown or other
  modified_base (289)..(289): a, c, t, g, unknown or other
  modified_base (539)..(539): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaaagactcacctgctctgganatgcattgaccaaagcaatatgtcttaattggaaccaaacaaaagccaggccaggcccctgtggtgtnatataagtaaagacaggtagagacggccctacgagggacttccccgtaggacgtcgtaactttccgtcgtcggcctcccgaagcccgtcgaaacgggggaaccaaacgtacggtaccctaacggttacgaacccctattacgacggttagggacgtcccaaggggaccaagggacggaccggaaggcctaggactttaagttaacgttgaactaataccgagtacaagaacaaacgtataatactttatntttaatgttcttcgagttcgtgggaccgttggttccaaccgtgtaacgtcgcgttacccgaacgttcccaacccg

SEQ ID NO: 414878 - DNA, 796 bp, Homo sapiens
  misc_feature: GZ8MTXP01EPBCG.3.10.A10.1.454.CMB.2.raw
  modified_base (218)..(218): a, c, t, g, unknown or other
  modified_base (257)..(257): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccacctcggtgtcagtcgtccccaggacagacggccaagatcacctgctctgganatgcattgaccaaagcaatatgtacttatggtaaccaanaaaagccaggccacggccctggtggtggtagatataataaagacagtagagacggcccctagagggactcccgtagacgtcgtacttcctcgtcggccttacccgaagtccctaacggaacggggtaaacctaaaccgtacggtacctaacgggtttacgaaccctacgttacgaaggttacgggacgttacccgaaaggggaccgaagggtaacggggaccggaaggtacccgttagggtaaacctttaagtttaacggtttacggtaacctaaagttacccgaaaggtaacctaaaacgggaaaccctaaaaaacgggtaaagtttaaaactttaaaccgtttttaaagtttaacctttttaaagtttccgggtttaaccgtttaccgggggttaaacttcccgggttttaaacggggggaaaccccgtttaacggggggtttacccctaacccccggggtttaccgttaaaccggggttaccccgaaaccgggttacccccggtaaaaccgggaacccccccttaaaaccccccgg

SEQ ID NO: 414879 - DNA, 612 bp, Homo sapiens
  misc_feature: GZ8MTXP01D2ISV.3.10.A10.1.454.CMB.2.raw
  modified_base (291)..(291): a, c, t, g, unknown or other
  modified_base (465)..(465): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtcgtccccaggacagacggccaagatcacctgctctggagatgcattgaccaaagcaaatatgtacttattggtaaccaaacaaaacgccaggccacggcccctgtggtgtgatanaataaagacagtgagaaggccctgacgggactccgtgacgcgtattctcgtcggcctccgacgtccgtaacgaagggaaccaaacgtacgtacccgaacgttacgacccaagttcgaaggttggaacgtccgagggcgaagaagggacgaggctagacttattattgtacaatnagacaagaccaaatattaaacttacttagttatttaagtgttaaccttcggattccgggttacgggtaccgtacggggttccttacccgttaccgtaacgggtaccaacggaccccaacggacccctaaaccccgttcgttaacccg

SEQ ID NO: 414880 - DNA, 813 bp, Homo sapiens
  misc_feature: GZ8MTXP01CGAUI.3.10.A10.1.454.CMB.2.raw
  modified_base (280)..(280): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgacttatggtaacaacaaagcaggccaggccctgtggtgtnatatataaagacagtgagacggccctagagggactcccgtaggagcggtacttcctcgtcggcccttaccgaacgggtccttcggaaacgggggaaaccctaaaccgtacggttacccgtaaccggtttacgaacccctaaagttccggtaaagggttacgggggtaacggttaccccgaagggggaccgaaacggggaaacgggggaaccgggtaacggggaccttaacgggtaaaccttttaagttttaaagttttcgggttaacctaaacgttaccgaaacggttaaccaaacggtaaaccaaaaaccgtaaaggtttaaaactttaaaccgttttaattttaccttttttaaatttccgggtttaaccgtttacggggttaaaccgttttaccggttaacggggggttaacccccggttaaacggggggttccccttaaccccggggtttaacccgttaacggggttaaccccgtaaccgggttaccccccgggtaaaaacccggggccccccttaaaaacccccccgg

SEQ ID NO: 414881 - DNA, 695 bp, Homo sapiens
  misc_feature: GZ8MTXP01CZ4M8.3.10.A10.1.454.CMB.2.raw
  modified_base (256)..(256): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgaccaaaagcaatatgtacttattggtaaccaaanaaaagccaggccaggcccctgtggtgtgatataataaagacagtgagaggccctgagggactcctgagcgattctcgtggctcgagctaacgaagggaacaaacgagtacacgttacgaacctagtcgaaggtggaacgtacccgaagggccaaagggtaaggggaaccggagggaccgttacgggaactttaatttaaagttcggttaacgaaaacttcccgaaaggtaccaaacggaaacccaaaacggtaaagtttaaaaacttacttttaaacctttcttttaagttacggtttaacgtttaccgggttatttacccggttgggggtaaacccgttaggggttacccgttaacccgggttacctttaacgggggtaaccctaaccggtacccccgaaaacgggaccccctaaaacccccgttaacgtttaacccg

SEQ ID NO: 414882 - DNA, 671 bp, Homo sapiens
  misc_feature: GZ8MTXP01CZRS4.3.10.A10.1.454.CMB.2.raw
  modified_base (301)..(301): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgtacttattacggtaaccaaacaaaacgccgaaggccacggcccctggtggtggtagataataanaaagacgagtagaggacggccctacgagggactcccgtagacgcgtattcctccgtcggctccagtcctacgaacgggaacaaacgtacgtacctaacggttcgaaccctataccgaggttacggacggtacccgaagggaccaaggggaaggaccggaggtacgtacgtaacttaatttagttacgtactaaagtaccgaagacaagtaaacaaactaagttaaacttaactttaattcttttaatcggtttaacgttcggttagttacggacggggtaaaccgtcgggttacccgttacccggttccgtaacgggttccgaaaccggtaccccgaacccgggaccctaacccccgttaacgtttcccg

SEQ ID NO: 414883 - DNA, 815 bp, Homo sapiens
  misc_feature: GZ8MTXP01EKN0H.3.10.A10.1.454.CMB.2.raw
  modified_base (221)..(221): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagcccaccctcggtgtcagtcgtccccaggacagacggccaagatcacctgctcgtgganatgctattgaccaaagcaaattatgtcttaagtacggtaaccaaacaaaacgccgaggccacggccctggtggtggtagaataataataaagacaaggtaggaagacggtcccctaggacgggtactcccgtaggaagcgtacttccgtcgtcggtacctcccaaaggtcctaaccggaaaggggtaacccaaacgtacggtacccgtaaacgggtttaccgaaaccctagtaccgtacgggtacgggtacgtaacccggagggacccggaagggaacggggaacgggacggacgttaacggtaaactttaagtttaagggtttacggtaaacctaaaagttacgaaacgggacctaaaacgggaaaaccctaaaacgggtttaaagttaaaacgttttaaaccttttacgtttaaacccttttttaaagttaccggttttaccgggtttaaacccgggttaacgtttacccgggttaacgggggttaaaccccgggttgggttaaccccggtaacccccggtttaccggtaacggttaccccgaacccgggttaacccccgaaaccggggttaacccccttaaacccccccgg

SEQ ID NO: 414884 - DNA, 652 bp, Homo sapiens
  misc_feature: GZ8MTXP01A6JPD.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgacttattggtaaccaaacaaaagccaggccacggcccctgtggtggtgatatataaagacagtgagacggccctgagggactcccgtaggacgcgtattcctccgtggctccgaggtcctaacgaaggggaaccaaacgacggtacacgttgaaccctatccgaggtggacgtcccgaagggcaaggaacgggacggaacgggtctaggacttatttagttaggttaccaaagttcgaaggaccaaaggaacccaaagtaagtttaaattactttaattcttttaagtcgttaacgtttcgggttatttacggttcgggtaaaccggtacgggttcccgttacccgttaccggttaacgggtcccgtaaccggtacccccgaacgggacccccctaaaccccgttaacgttcccgg

SEQ ID NO: 414885 - DNA, 570 bp, Homo sapiens
  misc_feature: GZ8MTXP01C07ZN.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgtacttatggtaaccaacaaaagccaggccaggcccctgtggtggtgatataataaagacagtgagacgccctgagggtactccgtgagcgtattctcgtcggctcgagctacgaggaacaacgagtacacgtacgacatacgagtacggacgtccgaggcgaaggaggacgaggctagacttattattgtactaatcgaagacaagaacaactaagttaaacttactttattactttattgttcgttcggattccggttagggtaccgtagggttcccgaccgttaccgtgtacgtaaccgacccgtacggaccctaaccccgcgttaacccg

SEQ ID NO: 414886 - DNA, 633 bp, Homo sapiens
  misc_feature: GZ8MTXP01D0D0J.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagcccaccctcggtgtcagtcgtccccaggacagacggccaagatcacctgctctggagatgcattgaccaaaagcaaattatgtacttagttacggtaaccaaacaaaacgcccgaggaccaacggtccccctaggtggtggtgataataataaagacagtgagaggccctagagggactcccgtagacgcgtattctccgtggctccgagtctaacgagggaacaaacgagtcacgttcgaccatcagtggatccgaggcaggacggacgaggctagacttattattgtacaatacagtacaagaactaaacgattaaactattatttacttttagtcgttaacgttacggttacgttacgttaggggtaaacccgtacggggttacccgttaccccggttaccgttaacgggttccgaacccggtaacccccgaacgggaccccctaaacccccgttaacgtttaaccccgg

SEQ ID NO: 414887 - DNA, 640 bp, Homo sapiens
  misc_feature: GZ8MTXP01BS2B1.3.10.A10.1.454.CMB.2.raw
  modified_base (282)..(282): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagcccaccctcggtgtcagtcgtccccaggacagacggccaagatcacctgctctggagatgctattgaccaaagcaatatgtcttattggtaaccaaacaaaagccaggccaggccctgnggtgtgatatataaagacagtgagaggccctcaggggactcccgtggacgcgtacttctcgtggcctccaagcctcgacggggaacaaacgagtcacgttacgaacctatacgaggttagggacgtccgaagggccgaagggacgggacggaggtcgtagtacgttattagttgtacctaatccgaagacaacgaacaaacgaattaaacttactttaacttacttttaagttcgtttacgttacggttcgttaccggttacggggttacccgttacgggttacccgtaaccccggttaccggtttaacgggtcccgtaaccggacccccggtaaaccgggccccctaaaacccccgg

SEQ ID NO: 414888 - DNA, 686 bp, Homo sapiens
  misc_feature: GZ8MTXP01C1I0P.3.10.A10.1.454.CMB.2.raw
  modified_base (266)..(266): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagcccaccctcggtgtcagtcgtccccaggacagacggccaaagatcacctgctcgtggagatgacattcgaccaaaagcaaatatgcttaattggtaaccaaanaaaagccaggccaggcccctagtggtgtgatataataaagacagtagagacggccctagaggggactcccgtagacgcgtacttcctcgtggcctccaaggtcctcgaaacggggaaccaaaacgacggtacaacgttcgaaccctaagttccaaggtacgggtacttaccaagtaggaccgaagggaacgggacggttaaaggccgttaaggaacctttaagttttaacttggttaaacaaacttacccggaaagaacgaaacgtaaacgtaaaacgtaaacgttaaacttaaactttaactttaacttttaacgtttacgtttacgtttacggttacgttacggttacgggttaccggttaccgggtaaccgtaccgtaaccgttacggtaccgaccgtaacccgaacccgtaacccg

SEQ ID NO: 414889 - DNA, 584 bp, Homo sapiens
  misc_feature: GZ8MTXP01DZ5PI.3.10.A10.1.454.CMB.2.raw
  modified_base (217)..(217): a, c, t, g, unknown or other
  modified_base (256)..(256): a, c, t, g, unknown or other
tcagagacgcactccacgaccggtgctcgatttagcgtcgatctcagggggctgtgggtccaggaggcagaactctgggtgtctcaccatggcctggatccctctacttctcccctcctcactctctgcacagactctgaggcctcctatgagctgacacagccacctcggtgtcagtcgtccccaggacagacggccaagatcacctgctctgganatgcattgaccaaagcaatatgtcttattggtaaccaanaaaagccaggccaggccctggtggtgtgaatatataaagacagtgagaggcccctagagggtactcccgtggacgcgtattctcgtcggccttccgaagtcctcggaagggaaccaaacgacgtaccacgttcgacccattcgaggtggacgtccgaaggacgaaggaggacgaggctagtaacttattacgttgtacaaagtcagcaagacaaatagtaatacttattcttaagtcgttacttcggttattcggtcgggaaacgttcgggttacccaaccggttacgtaacggttccgacggacccgtaaacggaaccctaaccccg

SEQ ID NO: 414890 - DNA, 656 bp, Homo sapiens
  misc_feature: GZ8MTXP01BU86Q.3.10.A10.1.454.CMB.2.raw
  modified_base (257)..(257): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagcccaccctcggtgtcagtcgtccccaggacagacggccaagatcacctgctctggagatgcattgaccaaagcaatatgacttatggaaccaanaaagccaggccaggccctggtggtgtgatataataaagacagtgaagacggcccctgagggactcccgtgagcgtacttcctcgtggccctccgaacgcctcggaacgggacctaaacgcgtcctacggtttacgaacccattcgacggtggacgtccgaagggtacgaaggacggggtacgaggccgtagtaacttagtttagttacggttaactaaattccgaaagccgaaagaacctaaaacgtaagtttaaactttaaccgtttaatttcgttttaaagttcgttacggttacggttacttacgggttacggggacccgttacgggggttacctaacccggttccgtaacggtccgacccggacccgaaacccgggttaacccctaaacccccgg

SEQ ID NO: 414891 - DNA, 759 bp, Homo sapiens
  misc_feature: GZ8MTXP01ARK1J.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaccaaacaaagccaggccaggcccctggtggtggtgatataataaagacagtgagacggccctagagggactcccgtagacgcgtactttcctacgtcggtccctccgaaacgtccgtaaccggaaacggggaaaccctaaaccgtacggttacccgtaacggtttacggaaacccctaagttaccgtaaagggttcgggaacggttaccccgaaggggaccgaaaggggaacgggaacgggacgggtacctaagggttaacctttaaagttttaacgggtttacggtaactaaacgttacccgaaaggttaccgaaaacggtaaacctaaaaccgttaaggttaaaaccttttaactttaacttttaccgtttttaaagttcgttttaccgtttaccggggttaacgtttaccggggttacgggggttacccgggttccgttaaccccggttaaccggttacgggtccaaccggtaccccggaaccgtaaccccgaaccccgttaaccg

SEQ ID NO: 414892 - DNA, 662 bp, Homo sapiens
  misc_feature: GZ8MTXP01ES87W.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctcgtggagatgctattgaccaaagcaatatgtcttaattaggtaaccaaacaaagccaggccgaacgccctggtggtggtgaatatataaagacagtagagacggcccctgagggactcccgtagacgcgtacttcgtctcggcctccgaagcctcgaagggaaccaacgtacgtaccgtaacggtttcgaaaccctagtcgtagggttacggggacgttacccgaagggaccgaagggaacggggacgagggtacctaggtaacttaagtttagttacgtactaaagtacgaacggactaaacgaaacctaaacgtaagttaaactttaactttaacgtttatttaaagttcgttttaccggttacggttacgttcgggtacgggaccgttacggttccgtaaccgtacgtaacgggtacaccggaccctaaaccggcccctaaacccg

SEQ ID NO: 414893 - DNA, 536 bp, Homo sapiens
  misc_feature: GZ8MTXP01CY7DL.3.10.A10.1.454.CMB.2.raw
  modified_base (215)..(215): a, c, t, g, unknown or other
  modified_base (248)..(248): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctgganatgcattgccaaagcaatatgcttatgtacaanaaagcagcagccctgtggtgtgatatataaagacaggtgagacggccctcgaagggactcccgtgacgcgtattctctggctccgagctaaccgagggaacaaacgagtccacgttcgaccatcagtcgagtccaggcaaggaggacgaggctagactattatgtacatcagcagtaacaacgagtaaattacttattcttattcgttcttcggattcgttagggacctgggttccgccgttcctaaggtccaacgtccccgaacggaccctaaccccgcgttaaccg

SEQ ID NO: 414894 - DNA, 648 bp, Homo sapiens
  misc_feature: GZ8MTXP01BHXXF.3.10.A10.1.454.CMB.2.raw
  modified_base (344)..(344): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgtacttaattcggtaaaccaaacaaaacgccaacggccacggcccctggtgggtggtagtaataataataaagacaggtagaggacggccctagacgggactcccgngacgcgtattctcgtggctcgagctaacgaagggaacaacgagtacacgttacgactatacgagtggacgtcgaggcgaggacggacgagctagacttattagttcgacgtaactcgaacgacgaaagaaacctaaacgtaagttaaactttactttaactttacttttaagttcgttaacgtttacggttacgttacggttacggggtaacccgtacgggttacccgttacccgggttacccgttaacgggtaccctaaccggaccccgaaaccggacccctaaaccccgttcgtttaacccg

SEQ ID NO: 414895 - DNA, 823 bp, Homo sapiens
  misc_feature: GZ8MTXP01AO74A.3.10.A10.1.454.CMB.2.raw
  modified_base (215)..(215): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtcgtccccaggacagacggccaagatcacctgctctgganatgctattgacaaagcaatatgtacttaagttacggtaaccaaacgaaaacgcccgaacgggacccgaacgggtccccccgttgggtacgggttagggtagtaagttaacgtaaaagttaaaaggaaccgtaaggttaggaacggtaacgggtacccccgttacggaacgggggtaaccttcccccggtaggtaaccggtaccggttaacttttcccgttcccgttacggggtacccttacccggtaacggtcccgttaaacccgggaaacgggggtaacccctaaaacgtaccgggttacccgtaaccggtttacgaaccccgtaagtaccgtacggtacgggtaacggtaccggacgggacgaagggaacgggaacggacggtacgtaggaactttaagtttagttacggttactaattacgaacgacgaaacgaaaccgaaacgtaaagttaaactttaactttaactttacttttacgttacgttaacgtttacgggttacgttcggttacgggtaaccggtaacgggttaccgttcccgttaccgtaacggtaccgtaaccaccccggggggaaccaccccgtaaccccgttccgttaacccg

SEQ ID NO: 414896 - DNA, 713 bp, Homo sapiens
  misc_feature: GZ8MTXP01AZZ2T.3.10.A10.1.454.CMB.2.raw
  modified_base (218)..(218): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctgganatgcattgaccaaagcaatatgtacttattaggtaaccaaacaaaacgccaggccaggcccctggtggtggtgaatataataaagacaggtaggagacggccctacgagggactcccgtagagcgtacttcctcgtcggctccgaacgtcgtcgaacggggaacctaaacgtacgtaccgtaaccggtttacgaaccctaagtccgtaagggttagggaaccggtcccgaagggacgaagggacgggaacggacgggtcctaggtaaactttatttaaggtttcggtaactaaagttacccgaagactaaacggaaacctaaaaccggtaagtttaaactaaccttttaattcttttaaagttcggttaccgtttacgggttagttacccggttacggggacccgttacgggggttccctaaaccccgggttccgttaacgggtaccccgaaccggttacccccgtaaaccgggttaaccccctaaaacccccgg

SEQ ID NO: 414897 - DNA, 745 bp, Homo sapiens
  misc_feature: GZ8MTXP01D62P7.3.10.A10.1.454.CMB.2.raw
  modified_base (365)..(365): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacacgcccaccctcggtgtcagtcgtccccaggacagacggccaagatcacctgctctggagatgcattgaccaaagctaaatatgtacttagttcggtaaccaaacaaaacgccaacggccacggcccctaggtcggtaggtgaataagtaaataaaggacaggtgaaggaacggccctcgagggtactcccgtgacgctattctccgnggctcagctaacgaagggaacaacgacgtacacgttcgaacctgtaccagggtggaacgtcccgaagggccgaagggaacgggaccgagggtaccgtaggtaaaccgtttaatttaagtttacggtaacctaaagttccgaaacgtaacgaaacggaaaccctaaaaccggttaaagtttaaaaaactttaacccgttttaattttaccgtttttaaagttcggttttaaacccgtttacgggttaacgtttccgggttaacgggggtaaaccccggtcggggttaaccccgttacccgggttaaccgttaacgggggtaacctaaccccggaaccccggaaacgggttacccccaaaacccccgttcgtttaaccccgg

SEQ ID NO: 414898 - DNA, 775 bp, Homo sapiens
  misc_feature: GZ8MTXP01A5BF7.3.10.A10.1.454.CMB.2.raw
  modified_base (741)..(741): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacacgccaccctcggtgtcagtcgtccccaggacagaccggccaagactcacctgctctggagatgcattcgaccaaagcaaattatgtacttagttacggtaaaccaaacgaaaacgccgacggacccgacgggtccccttgggtcggtggttagtaataaattaaagtaaacggaacgtaaggtaggaacggaccgggtacccccgtacggaacgggggtaccttccccggtaggaacggtccgtaaccttttccgtacgtcgggtacccttacccgaaagggtccctaaccggacggggtaaaccctaaacgtacgtaccgtaccggttacggaaccctagtacgagggttacggacgttacccgagggaccgaagggacgggaacggaggtactaacggtaacgtttagttacgttaggtaactaacgtcgaaacgtaaccgaaacgaaactaaaacgttaacgttaaactttaacctttaagtttccttttaaagttccgttacggtttacggttcgttaccggttaccgggaaccggttacggttaccccgttaaccgtaccgttaacggtaaccnccgggttaccccaacgggttaacccctaaccccg

SEQ ID NO: 414899 - DNA, 678 bp, Homo sapiens
  misc_feature: GZ8MTXP01C6XXW.3.10.A10.1.454.CMB.2.raw
  modified_base (213)..(213): a, c, t, g, unknown or other
  modified_base (561)..(561): a, c, t, g, unknown or other
tcagagacgcactccacgaccggtgctcgatttagcgtcgatctcagggggtgggtccaggaggcagaactctgggtgtctcaccatggcctggatccctctacttcctccccctcctcactctctgcacagactctgaggcctcctatgagctgacacagccaccctggtgtcagtgtccccaggacagacgcaagatcacctgctctgganatgctattgaccaaagcaaatatgtactttaagtacggtaaaccaaacaaaacgccaaggacccacggccccgtggtgggtggtagaattaagtaaataaaagacgagtagagacggccctagagggactccgtagacgcgtattctccgtggctcgagcgtaacgaacgggaacaaacgtacgtacgtaacgttacgaaccctagttaccgaggttcggaacgtacccggaagggaccgaaggaacgggacgagggtacctaggaacttaagttaagttagtacgaaattcgaaagccgaaagaaaccgaaactaagttaaaaccttatttaacttacttttaaagngttttaacgttacggacgtttcgttaacggggtaccgtacgggttaccttacccggttaccgttaagggacccaacggacccccgaaacggacccctaaaaccccgttgttaacccg

SEQ ID NO: 414900 - DNA, 501 bp, Homo sapiens
  misc_feature: GZ8MTXP01ARHDN.3.10.A10.1.454.CMB.2.raw
  modified_base (250)..(250): a, c, t, g, unknown or other
  modified_base (348)..(348): a, c, t, g, unknown or other
  modified_base (427)..(427): a, c, t, g, unknown or other
  modified_base (457)..(457): a, c, t, g, unknown or other
  modified_base (464)..(464): a, c, t, g, unknown or other
  modified_base (471)..(471): a, c, t, g, unknown or other
  modified_base (498)..(498): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttatggtacaanaaagcagcaggccctgtggtggtgatatataaagacagtgagaggccctgagggactcctgagcgattctctggctcgagctacgagggaacaaacgngtcacgttgaccatcagtggagtccgaggcaggaggacgtaggcgtagacttattattagtacaatcagacagaacaanaagtaatacttatcttatgtcttggatcgngggaccngggttcncgttctaaggcaagcccagcccaaccntcg

SEQ ID NO: 414901 - DNA, 595 bp, Homo sapiens
  misc_feature: GZ8MTXP01B7OZ7.3.10.A10.1.454.CMB.2.raw
  modified_base (217)..(217): a, c, t, g, unknown or other
  modified_base (240)..(240): a, c, t, g, unknown or other
  modified_base (331)..(331): a, c, t, g, unknown or other
tcagagacgcactccacgaccggtgctcgatttagcgtcgatctcaggggggtgggtccaggaggcagaactctgggtgtctcaccatggcctggatccctctacttctccccctcctcactctctgcacagactctgaggcctcctatgagctgacacagcccacctcggtgtcagtcgtccccaggacagacggccaagatcacctgctctgganatgctattcgaccaaagcaaatntgtacttattacggaaccaaacaaagccaggccacggccctggtggtgtagatataagtaaagacagtgagacgccctagagggactccgngacgcgtattcctcgtcggctccgagcctaacgaacgggaacaaacgagtcacgtcactatcgagtgacgcgaggcaggacggacgagcgtagtacttaagttattagtacgtaaatcgagacaagtaacaaacgtaagttaactttacttagttcctttaagttcgtttcgtacgttgttaccggttacgggtaaccgtcgggttaccgttaccgttcgttaacggctaaccggacccaacggacccctaacccgttaatccg

SEQ ID NO: 414902 - DNA, 665 bp, Homo sapiens
  misc_feature: GZ8MTXP01E2IJT.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgctattcgaccaaagcaatatgtacttagttacggaaccaaaacaaacgccgacggccgacggccccgtggtggtggtagattaataagtaaagactaggtaggacgaacggtcccctacggaacgggtacctccccgtagacgtcgtactttcctccgtcggctccgagcctaacgaacgggaacccaaacgtcgtaccacggttacgaacctagtcgtaaggttagggacgtacccgagggaccgagggacgggacggagtcgagtactttattatcgtacgaatcgaacgacaacgaactaaactaagttaaacttacttattactttagtcggttaacgttacggattcggttacggggaacccgtcgggttcccgttacccggttaccgttaacggccgaaccggtacccccgaaacggaccccctaaccccgaagttcccg

SEQ ID NO: 414903 - DNA, 682 bp, Homo sapiens
  misc_feature: GZ8MTXP01B5AQE.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctctatgagctgacacagccacctcggtgtcagtcgtccccaggacagacggacaagatcacctgctctggagtatgctattcgaccaaagtcaaattatagtacttagttacggtaaaccaaacaaaacgccacggtcccgacggtccccgtggtggtgtagtaataataagtaaagacgaggtagaacggacggtaccccgtagacggggtactccccgtagacggtcgtaacttccgtcgtcggaccctacccgacgtacctcggaaacgggaaacctaaaccgtacgttaccgtaacgggttacgaacccctaagtccggaaggttacgggacgaccggaaagggccgaaagggacggaaccggtggacttaggtaaacttagtttagttacgtaactatacaaaggcaaacgaactaaagattaactacttattcctttaagtacgttgttacgaggtttacgcggttaaccggttacggttaccaaccgttccgtaagggtccacggaccccgtaacggttccgtcccccgg

SEQ ID NO: 414904 - DNA, 676 bp, Homo sapiens
  misc_feature: GZ8MTXP01DDH4Z.3.10.A10.1.454.CMB.2.raw
  modified_base (215)..(215): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctgganatgcattgaccaaagcaatatgtacttattcggtaacaaacaaaagccaggccacggccctgtggtggtgatataataaagacagtgaagacggccctgagggtactcccgtgacgcgtattcctccgtcggctccgagccgtaaccgaagggaaccaaacgacgttaccacgtttacgaacctagtaccgaggtagggacgtaccggaagggcgaaagggaagggacggaggtctaggaacttaatttaagttcgtaacgtaaattacgaagaccaaaggaaaccctaaagtaagttaaaactttacgtttaactttacgtttagtttcggttaaccgtttcggttaagttccggttaggggtaacccgtacggggttacccgttacccggttccggtaacgggttacccaaccggtaccccgaaaccgggttacccctaaaccccggttaactttcccg

SEQ ID NO: 414905 - DNA, 711 bp, Homo sapiens
  misc_feature: GZ8MTXP01A7ZI9.3.10.A10.1.454.CMB.2.raw
tcagagacgcactccacgaccggtgctcgatttagcgtcgatctcagggggtgggtccaggaggcagaactctgggtgtctcaccatggcctggatccctctacttcctccccctcctcactctctgcacagactctgaggcctcctatgagctgacacagcccaccctcggtgtcagtcgtccccaggacagacggccaagatcacctgctctggagatgctattgaccaaagcaattatgtacttagttacggtaaaccaaaacgaaaacgcccgaacggtcccgaaccgggtcccccgtaggttcgggtgggtaggaattaataaagtaaaacgaacgtaggtagaggaaccggtcccgtacggaacgggactcccgtaggacgcggtactttctccgtggtcctcgacgctacgaacgggtaacaacgagtcgtacggttcgaacctatcgagtgggagtaccgaggcaagggacggacgaggcgtagtactattatcgtacgtaatcgtagacaacggtaactaaaccgtaaggtttaaactttaactttaactttacgttttacttcggttaaccgtttacgggttacgtttacggttccggggtaaaccggtaccgggttacccgttacccggtttccgtaaccgggttaccgaacccggtaaccccgacccgggaacccctaaccccgttaaccgttaacccg

SEQ ID NO: 414906 - DNA, 733 bp, Homo sapiens
  misc_feature: GZ8MTXP01BHBUO.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtcccccaggacaggacggccaagatcacctgctctggagatgcattgaccaaagcaaattatgtcttattacggtaaccaaacaaagccaggccacggccctgtggtgtagatataataaagacaggtagaggacggccctagagggactcccgtagagcgtacttctcgtacggcctaccaagtcctcgaaagggtacccaaacgtacgtaccgtacggttacgaaccctagttaccgaggttagggaacgttcccggaaggggaccgaagggaacgggacgggtaacggacgttagtaaaccgtttaagtttaagttacggttaactaaacgttccgaaacgtacgaaacgaaacctaaaacgtaagtttaaaacttaaccttttacgttaacgtttttaagttcggtttaccggttttacgggttaaacgtttaccggggtaaccgggttaacccgggttacgggggttacccctaacccgggtttacccgtaacgggtttcccgaaaccggttacccccgaaacccgggttaaccccctaaaaccccg

SEQ ID NO: 414907 - DNA, 503 bp, Homo sapiens
  misc_feature: GZ8MTXP01D477A.3.10.A10.1.454.CMB.2.raw
  modified_base (307)..(307): a, c, t, g, unknown or other
  modified_base (329)..(329): a, c, t, g, unknown or other
  modified_base (384)..(384): a, c, t, g, unknown or other
  modified_base (406)..(406): a, c, t, g, unknown or other
  modified_base (427)..(427): a, c, t, g, unknown or other
tcagagacgcactccacgaccggtgctcgatttagcgtcgatctcaggggctgtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgaccaaagcaatatgcttattggtaaccaacaaaagcaggccaggccctgtggtggtgatatataaagacagtgagaggccctnaggggatccctgagcgattctntggctccaagctcgagggacaacagtcacgttgaccatcagtggatccaggcagnggacgagctgacttattaggtntcaaatcagcaagacaaacgntaatacttatctttaatgttcttcggatcgtggaccttagggttcaaccggtctaagtcagaccaagcccaacccg

SEQ ID NO: 414908 - DNA, 839 bp, Homo sapiens
  misc_feature: GZ8MTXP01AZ5AP.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagctaatatgtactttattacggtaaccaaacgaaaaacgccgaacggcccaacgggtccccctggtacgggttggtagaacgttaataagtaaaaacggtaccgaaggttacggaacggaaccgggtacccccttacggaaacggggggtaaccttcccccgtagggaaccggtaccggttaaactttccgtccccggttacggggtaccttacccggacgtcccgtaaccggaacggggaacctaaaaccgtcgttaccgtaaccgtttacgaccctaacgtacgtaacgggtcgtaacggaccccgaagggacccgaaggggaaaccggggaccggaacgggtacgttaacggggaaacccttttaacgtttaagtttaccggtaacctaaagttaccgacgaacccgaaaggtaaaccgtaaaaccttaaggtttaaactttaactttaacctttaagttttacttaacgggtttccgttacggttagttaccgggttacggggtaaacccggttaacggggttccccgttaaccgttacccggttcgggtaccgaaccgaaccccggtaaccggacccccgtaaaacccccttcgttaaccccgg

SEQ ID NO: 414909 - DNA, 759 bp, Homo sapiens
  misc_feature: GZ8MTXP01BPCT6.3.10.A10.1.454.CMB.2.raw
  modified_base (221)..(221): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagcccaccctcggtgtcagtcgtccccaggacagaccggccaagatcacctgctctgganatgctattcgaccaaagcaaattatgtactttaattacggtaaaccctaaacaaaacgccgacgggacccgaacgggtccccccgttaggtgggttcgggtagtaaattaataaagtaaaagactaaggttagaaggacggcccctaggaacggggtacttacccgtggacggtccgtaacctttccgtacgtcggggtacccttcccgaacggtaccctcggaaacggggaaacccaaacgtacgtcctaacgggttcgaaacctataccgtaggtacgggacgtaccgaggacgagggaacggacgaggctaggaacttagtttaggtacgtataactacgacgacaagtaaccaaacgttaagttaaactttaccgtttaatttaccgtttaagtttcggtttacgtttaccggttaacgttacccgggtaacgggttaaccgggttacgggttaccccgtaaccccggtttaccggttaaccgggtaccctaaccggaaccccgaacccgggttaaccccctaaaccccccggg

SEQ ID NO: 414910 - DNA, 602 bp, Homo sapiens
  misc_feature: GZ8MTXP01D87LC.3.10.A10.1.454.CMB.2.raw
  modified_base (234)..(234): a, c, t, g, unknown or other
  modified_base (255)..(255): a, c, t, g, unknown or other
  modified_base (360)..(360): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagnaatatgcttatggaaccaaanaaagcaggccaggccctgtggtgtgatataataaagacagtgagaggccctagagggactccctgagccgtattctcgtggcctcccaagcctcgagggaaaccnaaacgtacgtacctaacggttacgaaccgtacgtacgtacgtagggacgtacgacggacgaaggacggggacggacggtacgtagtacgtattaagttagtactaactacaacgacgaagaaactaaacttaaagttaaactttaaacgtttaactttaacttttacgtttacgtttacgtttaacggtacgttaacggttacgggtaccggttaccgggttaaccggttaacccgtaaccg

SEQ ID NO: 414911 - DNA, 624 bp, Homo sapiens
  misc_feature: GZ8MTXP01A573L.3.10.A10.1.454.CMB.2.raw
  modified_base (221)..(221): a, c, t, g, unknown or other
  modified_base (241)..(241): a, c, t, g, unknown or other
  modified_base (373)..(373): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaaggacagacggccaagatcacctgctcgtgganatgcattgaccaaagcaatntgcttataggtaaccaaacaaagccaggccacggcccgtgtggtgtgatataataaagacagtagagacggccctagagggactccgtgacgcgtacttctcgtggcctccaacgctcgaagggaccaaacnggtactacggttagacccatcgaggtgagtaccaggacgaggaggacgagtctagtaacgttattacggttgtaacctaatacaagaccaagaacccaaagtaacgttaaattaacgttattacctttaagtcgtttacgttaccggttagttaccggtcgggggttaaacccgcggggttaccctaaccgggttacccgttaacggggtaccaccgggaccccgtaaaccgggaacccccttaacccccg

SEQ ID NO: 414912 - DNA, 595 bp, Homo sapiens
  misc_feature: GZ8MTXP01A9LME.3.10.A10.1.454.CMB.2.raw
  modified_base (195)..(195): a, c, t, g, unknown or other
  modified_base (211)..(211): a, c, t, g, unknown or other
  modified_base (233)..(233): a, c, t, g, unknown or other
  modified_base (273)..(273): a, c, t, g, unknown or other
  modified_base (282)..(282): a, c, t, g, unknown or other
  modified_base (289)..(289): a, c, t, g, unknown or other
  modified_base (308)..(308): a, c, t, g, unknown or other
  modified_base (319)..(319): a, c, t, g, unknown or other
  modified_base (458)..(458): a, c, t, g, unknown or other
  modified_base (564)..(564): a, c, t, g, unknown or other
  modified_base (585)..(585): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctctatgagctgacacagccacctcggtgtcagtcgtcccaggacagacgcaagntcacctgctcgtgganatgcattgaccaaagctaaatntgtcttatacggaaccaaacaaagccaggccacggtcccnggtggtgtnatataanaaagcagtgagacgccgtnagggtctccgngacgtcgtattcgtacgtcggctaccgagtcgtaacgaacgggaacaaacgtagtcgtaccgtacgaccagttccgaaggtcgacgtcccgaagggcaagggtaacgacggtagcgtaagacttaattagttacggaanaaagtaaacgcaaagaaacaaacgtaagttaacttaacttatttctttaatcgttcggtaacgtaagttcgtacgggactacgggtccttaccggttcgttagccncgaaccgaacgccccaacgtnttaacgtccc

SEQ ID NO: 414913 - DNA, 588 bp, Homo sapiens
  misc_feature: GZ8MTXP01AWLOS.3.10.A10.1.454.CMB.2.raw
  modified_base (302)..(302): a, c, t, g, unknown or other
  modified_base (330)..(330): a, c, t, g, unknown or other
  modified_base (361)..(361): a, c, t, g, unknown or other
  modified_base (443)..(443): a, c, t, g, unknown or other
tcagagacgcactccacgaccggtgctcgatttagcgtcgatctcagggggtgggtccaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgtatttttatattctctgtctcctgtaccaacacaccagacaaacgcccccaaactcatctattatgatntcactgctccggccctcgtagggtttcnctatcgtcctttctgtctcaagtctgccacnccggccctccctgacccacgtccgtcgggcctccgaggcgtaggacggacggagtctcggtcttacgttactgcaggtctanaatactaacgaaggtacgaccacctctccgtcggtggttaaggttgggtggacgggtaccaaggtcgtcggttacccggttccgttacgggtaaccacggaaccccgacgggtccttcccggtaacccccgttcggttaaccccg

SEQ ID NO: 414914 - DNA, 717 bp, Homo sapiens
  misc_feature: GZ8MTXP01D12QT.3.10.A10.1.454.CMB.2.raw
  modified_base (224)..(224): a, c, t, g, unknown or other
tcagagacgcactccacgaccggtgctcgatttagcgtcgatctcagggggctgtgggtccaggaggcagaactctgggtgtctcaccatggcctggatccctctacttcctccccctcctcactctctgcacagactctgaggcctcctatgagctgacacacgcccaccctcggtgtcagtcgtccccaggacagaccggccaagatccacctgctctgganatgctattcgaccaaagctaaattatgtacttagttacggtaaaccaaacaaaacgaccgacggaccgacggtacccccgtggtagggtggtagaattaacgtaaataaaagacgtaaggtagaacggacggtcccttaggaacggggtactccccgtagacgccgttacttccgtcgtcggcctccgaaacgcctaacggaacgggaaccaaacgtacgtaccgtaaggttaccgacctagtaccgtaggtacggacgtaccgaaggacgaagggaggacggtacggactaggtaactttagtttagggttacgtactaaagtaccgagtaacgaacgtaaaccgtaaataacgttaaatttaactttactttagtttaaattcgtttacgtacggttaacgttccgggtacgggttaaccggttacggttaccgtaacccggttaccggtaacggttcgaacccgttacccgaacggaacccctaaacccg

SEQ ID NO: 414915 - DNA, 717 bp, Homo sapiens
  misc_feature: GZ8MTXP01BDG9Y.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagcccacctcggtgtcagtcgtccccaggacagacggccaagctcacctgctcgtggagatgctattcgacctaaagctaaattatgtactttaagttacggaaccaaaacgaaacggccaacggcccgaccggccccgttaggtcgggtggtagtaattaagtaagtaaaagactaggtaggaacggccgaccccgtaggaacggtacttcccgaggacgtcgtactttcgcgtcggtcctccgaacgtccgtcggaaacgggtaacaacggtacgttaccgacgttacgacctagtacgagggttacggacgtaccggaaggacgaagggacgggtaacggaggtacgtagtaactttaagtttaggttacgtaacgtaactaccggaaagaacgaaactaaaccgtaaatttaactttaaactttaactttaagtttactttaacgttacgttaccgtttaggttccgttacggtaaccggttaccggttcggttacccgtaaccgtacgttaaccgacccgacccgaacccgtaaccgaaccccgtaacccg

SEQ ID NO: 414916 - DNA, 678 bp, Homo sapiens
  misc_feature: GZ8MTXP01CVCAW.3.10.A10.1.454.CMB.2.raw
  modified_base (266)..(266): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacaggaccggcaagatcacctgctcgtggagatgctattcggaccaaagcaatatgtacttagtaggtaaccaaanaaacgccgacggccacggccccttggtcggtggtgaatataataaagacaggtgacgacgcccgtagacggggtactcccgtagacgacgtacttcgtcgtggtccctaccgaacgtcctaacggaacgggaaacctaaaccggtagttaccgtaacggtttcggaaaccctagttcgaagggttcgggacgtacccggagggacgagggacggacgtacgggctagtacgtttattacggttcgtactaatacgagtacgaacgaactaaacgtaaacgttaatttaacgtttatttacgttttaaacgtgttaccggtttacgttgttaccggtacggggttacccgttgggttacccgtaacccggtacttaacgggtaccacggaccccgtaacggaacctaaccccg

SEQ ID NO: 414917 - DNA, 686 bp, Homo sapiens
  misc_feature: GZ8MTXP01A5EU2.3.10.A10.1.454.CMB.2.raw
  modified_base (221)..(221): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagcccaccctcggtgtcagtcgtccccaggacagacggccaagatcacctgctcgtgganatgctattcgaccaaagcaaatatgtcttagtggtaaccaaacaaagccaggccacggcccctgtcggtggtgatataataaagacgagtagagacggcccgtgagggactcccgtgagcgtacttcgtcgtcggtcctcgacgctcgaggaccaagtacgtacgacgttacgacccatacgaggtacggacgtaccggagggacgaacgggacggaacggacggcgtaacggtaactttaagttactttagtaacgattacgaacggtacgaacgtaaacaaacgtaacgttaaaactttaacgtttaaatttaccgtttaattaacggtttcggttaccggttacgtttaccgggtaacggggttaccggttaccggggttaacccggtaacccggtttaccggtaaccggtttacccgacccgggttaccccgttaaacccgggaaccccctaaaacccccg

SEQ ID NO: 414918 - DNA, 718 bp, Homo sapiens
  misc_feature: GZ8MTXP01DNPWF.3.10.A10.1.454.CMB.2.raw
  modified_base (470)..(470): a, c, t, g, unknown or other
tcagagacgcactccacgaccggtgctcgatttagcgtcgatctcaggggggtgggtccaggaggcagaactctgggtgtctcaccatggcctggatccctctacttcctccccctcctcactctctgcacagactctgaggcctcctatgagctgacacacgcccaccctcggtgtcagtcgtccccaggacaggacggccaagatcactgctcgtggagatgactagttcgaaccaaagactaaattatgtactttaagttacggtaaaccaaaacgaaaacgccgaacggacccgacggtccccttggtacgggtggtagaattaataaataaaagactaaggtggaaggaccggtcccctaggaacgggtacctcccgtaggacgacgtactttccgtaccgtcggtcctaccgagccgtaaaccggaagggtaaccaaacgtcgtacctacggttacgaacctanacggtaggtagggtactacccggaggacgaagggaacgggacggagtacgtagaacttatttacgtcgtaactaatcgaacgaacaaacgtaaactaaacgtaaatttaaactttaactttactttacgtttagttccggtttaacgtttacggacgttcgggttacggaccggtacgggttaccttacccggttagtaacggtacccaaccgtaaccccgaaccgacccctaacccgcgttaacccg

SEQ ID NO: 414919 - DNA, 486 bp, Homo sapiens
  misc_feature: GZ8MTXP02IZHL9.3.10.A10.1.454.CMB.2.raw
  modified_base (303)..(303): a, c, t, g, unknown or other
  modified_base (450)..(450): a, c, t, g, unknown or other
tcagagacgcactccacgaccggtgctcgatttagcgtcgatctcaggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgccaaagcaatatgcttattggtaccaacaaagccaggccaggcccctgtggtggtgatatataaagacagtgagaggccctnagggatccctgagcgattctctggctcagctcagggcaacagtcacgttgacgatcagtgagtccaggcagaggacgaggctgactattattgtcaatcagcaagacaacagtaatacttatctttatgtcttcggatctgggaccngggtcacgtctaaggtcagcccaagccaacccatcg

SEQ ID NO: 414920 - DNA, 503 bp, Homo sapiens
  misc_feature: GZ8MTXP02F5MTC.3.10.A10.1.454.CMB.2.raw
  modified_base (254)..(254): a, c, t, g, unknown or other
  modified_base (429)..(429): a, c, t, g, unknown or other
tcagagacgcactccacgaccggtgctcgatttagcgtcgatctcagggggctgtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgaccaaagcaatatgcttattggtaccaanaaaagccaggccaggcccctggtggtggtgatatataaagacagtgagaggccctagagggactcccgtgagcgattctctggctccagctcgagggacaaacagtcacgttgaccatcgagtgagtccgaggcaggaggacgaggctagactattatgtacatcagcagacaanagtaatactatctttatgtctcggatcgtacggacagggtcaaccgtcttacggcaggcccaaaggacaacccc

SEQ ID NO: 414921 - DNA, 580 bp, Homo sapiens
  misc_feature: GZ8MTXP02IS45T.3.10.A10.1.454.CMB.2.raw
  modified_base (326)..(326): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgtacttagttggtaaccaaacaaaagccaaggccacggcccctggtggtggtgatataataaagacagtgagacgcctagagggactccngagcgtattctcgtggctccagctacgagggacaacgagtaccacgttacgaccatcgaggtgacgtccgaggacaaggaggacggaggctagacttattattgtacaatcagacaagaacaaactaagtaaattactttattactttaatcgttacttacgggtattcggtacgggaaccgtacggggtacctaacccggttccgtaaggtcccaacggtaccccgaaacggacccccaaacccgtacttccg

SEQ ID NO: 414922 - DNA, 501 bp, Homo sapiens
  misc_feature: GZ8MTXP02I7BAA.3.10.A10.1.454.CMB.2.raw
  modified_base (254)..(254): a, c, t, g, unknown or other
  modified_base (410)..(410): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaanaaaagccaggccaggcccctgtggtggtgatatataaagacagtgagaggccctcagggatccctgagcgattctctggctccagctcgagggacaacagtcacgttgaccatcagtggagtccagcagaggacgaggctgactattatgtcaatnagcagacaacagtaatactatctttaatgttacttcggatcgtgggacctagggtcaaccgtcgtacggtcacgccaacggcccaaacccg

SEQ ID NO: 414923 - DNA, 506 bp, Homo sapiens
  misc_feature: GZ8MTXP02HN1QE.3.10.A10.1.454.CMB.2.raw
  modified_base (310)..(310): a, c, t, g, unknown or other
  modified_base (331)..(331): a, c, t, g, unknown or other
  modified_base (408)..(408): a, c, t, g, unknown or other
  modified_base (414)..(414): a, c, t, g, unknown or other
  modified_base (422)..(422): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaaccaacaaaagccaggccaggcccctgtggtggtgatatataaagacagtgagaggccctnagggatccctgagcgattctntggctcagctcagggacaacagtcacgttgaccatcagtgagtccaggcaagaggacgaggctgacttattattgtnaatcancagacaanagtaaatacttatctttagtgttcttacggatctcgggacctagggtcaacgtccgtaggtcagacccacggtaccaaaccccg

SEQ ID NO: 414924 - DNA, 509 bp, Homo sapiens
  misc_feature: GZ8MTXP02JIUIS.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtacaacaaagccagccagcccctgtggtggtgatataataaagacagtgaagaggccctcgagggactccctgagcgattctcctggctccagctcgagggacaacagtcacgttgaccatcagtgagtccaggcagaggacgaggctgactatttatgtacaaatcagcaagacaacagtaatacttatactttatgttcttcgatcgtgggacctagggtccaacgtccgaaggtcacgacccaaggccccaacccgataccg

SEQ ID NO: 414925 - DNA, 573 bp, Homo sapiens
  misc_feature: GZ8MTXP02HKV59.3.10.A10.1.454.CMB.2.raw
  modified_base (280)..(280): a, c, t, g, unknown or other
  modified_base (286)..(286): a, c, t, g, unknown or other
  modified_base (290)..(290): a, c, t, g, unknown or other
  modified_base (305)..(305): a, c, t, g, unknown or other
  modified_base (333)..(333): a, c, t, g, unknown or other
  modified_base (365)..(365): a, c, t, g, unknown or other
  modified_base (448)..(448): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgaccaaagcaatatgacttaattggtaaccaaacaaaagccaaggccaggacccctggnggtgtnatanataaagcagtgaagnggccctgagggactccctgagcgattcnctggctcagctcgaagggcaacagtcacgttnaccatcagtgatccaggcagaggacaggctagacttattattgacaattcatcaaagacaaacgtataatacttattacttangttacgttcggaattccgtaggggaaaccctaggggttaccaaacccgggtttccgttaaaacggtccgtaaaccgggtaccccctaaaacgggacccccaaaaccccccggttaatttacccgg

SEQ ID NO: 414926 - DNA, 499 bp, Homo sapiens
  misc_feature: GZ8MTXP02GOUDY.3.10.A10.1.454.CMB.2.raw
  modified_base (251)..(251): a, c, t, g, unknown or other
  modified_base (306)..(306): a, c, t, g, unknown or other
tcagagacgcactccacgaccggtgctcgatttagcgtcgatctcaggggctgtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgccaaagcaatatgcttatggtaccaanaaaagccaggccaggcccctgtggtggtgatatataaagacagtgagaggccctnagggatccctgagcgattctctggctccagctcagggacaaacagtcacgttgaccatcagtgagtccaggcaggagacgaggctgactattattgtacaatcaagcagacaacagtaatacttatactttatgtcttcggatcgtcgggacctaggggtcaacgtcgtaggtcagcccaaggcccaaacccg

SEQ ID NO: 414927 - DNA, 471 bp, Homo sapiens
  misc_feature: GZ8MTXP02IF8U2.3.10.A10.1.454.CMB.2.raw
  modified_base (247)..(247): a, c, t, g, unknown or other
  modified_base (319)..(319): a, c, t, g, unknown or other
  modified_base (401)..(401): a, c, t, g, unknown or other
  modified_base (408)..(408): a, c, t, g, unknown or other
  modified_base (424)..(424): a, c, t, g, unknown or other
  modified_base (439)..(439): a, c, t, g, unknown or other
  modified_base (444)..(444): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctggtgtcagtgtccccaggacagacggccaagatcacctgctctggagatgcattgccaaagcaatatgcttatgtacaanaaaagcaggccaggccctgtggtgtgatatataaagacagtgagaggccctgagggatccctgagcgattcnctggctcagctcgagggcaacagtcacgttgacatcagtgatccgagcagaggacgaggctgactattattgtacaatcagnagacaanagtatactatcttatntctgatcgtgggacnggtcnctcgtaagtcagccaagccaaccatcg

SEQ ID NO: 414928 - DNA, 508 bp, Homo sapiens
  misc_feature: GZ8MTXP02HHR19.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctgagggatcccgtgagcgattctctggctccagctcgagggacaaacgagtcagttgacccatcagtgagtccagcagaggacgagggctagactattatgtacaatcagcagacaaacagtaatacttatctttaatgttcttcggattcgtgggacctagggtcaaccgtctaggtcacgacccaaggacccaaacccg

SEQ ID NO: 414929 - DNA, 495 bp, Homo sapiens
  misc_feature: GZ8MTXP02HYZD8.3.10.A10.1.454.CMB.2.raw
  modified_base (402)..(402): a, c, t, g, unknown or other
  modified_base (422)..(422): a, c, t, g, unknown or other
  modified_base (460)..(460): a, c, t, g, unknown or other
tcagagacgcactccacgaccggtgctcgatttagcgtcgatctcaggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtacaaacaaaagccaggccaggcccctgtggtggtgatatataaagcagtgagaggccctgagggatccctgagcgattctctggctccagctcgagggacaacagtcacgttgacccatcagtgagtccaggcagaggacgaggctagactattnttgtcaatcagcagaacaanagtaaatactaatctttatgttctcggatcgtcggacngggtcaaccgtctaaggcagcccaaggccaaaccc

SEQ ID NO: 414930 - DNA, 580 bp, Homo sapiens
  misc_feature: GZ8MTXP02IBCFW.3.10.A10.1.454.CMB.2.raw
  modified_base (253)..(253): a, c, t, g, unknown or other
  modified_base (305)..(305): a, c, t, g, unknown or other
  modified_base (359)..(359): a, c, t, g, unknown or other
tcagagacgcactccacgaccggtgctcgatttagcgtcgatctcagggggtgggtccaggaggcagaactctgggtgtctcacatggcctggatccctctacttctccccctcctcactctctgcacagactctgaggcctcctatgagctgacacagccaccctcggtgtcagtgtccccaggacagacgaccaagatcacctgctctggagatgctattgaccaaagcaatatgctttatggtaaccaanaaaagccaggccacggcccctggtggtggtgatataataaagacagtgaagnggccctgaggggactccgtgagcgtattctctggctccagctcgagggacaacngtcacgttgaccatccaggtggacgtccgaggacgaggacgggacggaggctaggtacttattattgtacaaatcgagacaagaacaaactagttaaatactttatactttaatcgttacttacgggtattcggtacgggaacctacgggggtacctaccggtccgttaacgggtaccaaccggacccaaaaccgggccccctaaaaccccgtcgttaccg

SEQ ID NO: 414931 - DNA, 503 bp, Homo sapiens
  misc_feature: GZ8MTXP02JXY7K.3.10.A10.1.454.CMB.2.raw
  modified_base (251)..(251): a, c, t, g, unknown or other
  modified_base (441)..(441): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaanaaaagccaggccaggcccctgtggtggtgatatataaagacagtgagaggccctgagggatcccgtgagcgattctcctggctccagctcgagggcaacagtcacgttgaccatcagtgagtccgaggcagaggacgaggctagactattatgtacaatcagacagaacaacagtaatacttatctttangttcttggattcgtggaccaggtccaccgtctaaggtcacgacccaaggcccaacccactcg

SEQ ID NO: 414932 - DNA, 530 bp, Homo sapiens
  misc_feature: GZ8MTXP02GN13R.3.10.A10.1.454.CMB.2.raw
  modified_base (330)..(330): a, c, t, g, unknown or other
  modified_base (354)..(354): a, c, t, g, unknown or other
  modified_base (453)..(453): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaccaacaaagccaggccaggcccctgtggtggtgatataataaagacagtgaagaggccctgagggactcccgtgagcgattcncctggctcagctcgagggacaacngtcacgttgaccatcagtggagtccgaggcaaggaggacgaggctagactagttatgtacaatcagacagaacaaacagtaaatacttatacttttaancgtttacttcggtattcgtagggaccgtagggtccaccgtacgtaaggtccacgcccaaaggccccaacccactacg

SEQ ID NO: 414933 - DNA, 547 bp, Homo sapiens
  misc_feature: GZ8MTXP02FQL2A.3.10.A10.1.454.CMB.2.raw
  modified_base (252)..(252): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaaanaaaagccagccaggcccctgtggtggtgatataataaagacagtgagaggccctcgagggactcccgtgacgcgtattctcctggcctcagctcgaagggacaacgagtacacgttgaaccatcagtggactcgagcagaggacgagctagactattagtgacaatcagacaagaaccaaagtaagtaaacttacttatactttaatcgttactttcggaattcgtagggacctacggggtaccaccggttactaagggtcacgaccccgaacggaccccaaacccgacttaccg

SEQ ID NO: 414934 - DNA, 538 bp, Homo sapiens
  misc_feature: GZ8MTXP02IRA1W.3.10.A10.1.454.CMB.2.raw
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgaccaaaagcaaatatgacttaattaggtaaccaaacaaaagccaaggccaacggccccctggtcggtggtagaatataataaaagacagtgagaggccctgagggactccctgacgcgattctctggcctcagctacgagggacaacagtcacgttgaccatcagtgactcaggcaagagacgaggctagacttaattagtgtacaatcagacaagacaaactagtaatacttatctttatgttactacggatcgtacggaactacgggtacaccgtctaaggtcaacgacccgaaagtccccaaacccgtactcg

SEQ ID NO: 414935 - DNA, 547 bp, Homo sapiens
  misc_feature: GZ8MTXP02GO3AI.3.10.A10.1.454.CMB.2.raw
  modified_base (279)..(279): a, c, t, g, unknown or other
  modified_base (457)..(457): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagcccaccctcggtgtcagtgtccccaggacagacggccaagatcacctgctctggagatgcattgaccaaagcaatatgcttaattggtaaccaaacaaaagccaggccacggcccctgnggtggtgatataataaagacagtgagacggccctgagggatcccgtgagcgattctctggctcagctcgaagggacaaacagtcacgttgaaccatcagtgagtccgagcgagaggacgaggctagacttattaattgacaatcagcaagaacaacaagtaataacttatacttttangttcttacggtatcgtgggaaccgtaggtaccgaccgttacgtaacggtacaacggaccccgaaacggaccccaaaccccgtacgtaccg

SEQ ID NO: 414936 - DNA, 511 bp, Homo sapiens
  misc_feature: GZ8MTXP02HP51M.3.10.A10.1.454.CMB.2.raw
  modified_base (251)..(251): a, c, t, g, unknown or other
  modified_base (349)..(349): a, c, t, g, unknown or other
  modified_base (416)..(416): a, c, t, g, unknown or other
  modified_base (506)..(506): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaanaaaagccaggccaggcccctgtggtggtgatatataaagacagtgagaggccctgagggatccctgagcgattctctggctcagctcgagggacaacngtcacgttgaccatcagtgatcaggcagagacgagctgactattattgactaatcgagcaagacaanagtaaatacttattactttatgttcttacggtatcgtagggacctagggtccaaccgtccgtaaggtcacgcccgaaaggcccaaacccnctacg

SEQ ID NO: 414937 - DNA, 480 bp, Homo sapiens
  misc_feature: GZ8MTXP02GP79O.3.10.A10.1.454.CMB.2.raw
  modified_base (419)..(419): a, c, t, g, unknown or other
tcagagacgcactccacgaccggtgctcgatttagcgtcgatctcaggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgccaaagcaatatgctattggtacaacaaagccagccaggcccctgtggtggtgatatataaagacagtgagaggccctcagggatccctgagcgattctcctggctcagctcagggcaacagtcacgttgaccatcagtgagtccaggcagagacgagctgactattatgtcaatcagcagacaacagtaatacttanctttaatgtcttcggatctgggacagggtcacgtcaaggtcagcccaaggccaacccatcg

SEQ ID NO: 414938 - DNA, 502 bp, Homo sapiens
  misc_feature: GZ8MTXP02HCASN.3.10.A10.1.454.CMB.2.raw
  modified_base (358)..(358): a, c, t, g, unknown or other
  modified_base (414)..(414): a, c, t, g, unknown or other
  modified_base (429)..(429): a, c, t, g, unknown or other
  modified_base (447)..(447): a, c, t, g, unknown or other
  modified_base (468)..(468): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaccaaacaaaagccaggccaggcccctggtggtggtgatataataaagacagtgagaggccctgagggactcccgtgagcgattctctggctcagctcgagggacaacngtcacgttgacccatcagtggagtccaggcaggagacgtagctgactattatgtanaatcagacagacaanagtaatactatactttangttcttcggatcgtcggaccnggtcaacgtctaggcacgaccaacgcccaacccg

SEQ ID NO: 414939 - DNA, 510 bp, Homo sapiens
  misc_feature: GZ8MTXP02HBXOK.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaaccaaacaaaagccaggccaggcccctggtggtgtgatataataaagacagtgagaggccctgagggactcccgtgacgcgtacttctctggctccagctcgagggacaacagtcacgtgaccatcagtgacgtccaggcaggaggacgaggctagactattatgtacatcgagcagacaacagtaatacttatctttatgttctcgattcgtcggactggtccaaccgtctacggtcacgtacccaacggacccaacccg

SEQ ID NO: 414940 - DNA, 588 bp, Homo sapiens
  misc_feature: GZ8MTXP02FSJGA.3.10.A10.1.454.CMB.2.raw
  modified_base (258)..(258): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgtacttagttacggtaaccaaanaaaacgccgaggccgacggcccctggtggtggtgatataataaagacagtgagacggccctgagggactcccgtgacgcgtattctccgtggcctcagtctacgaagggacaaacgagtacacgttcgaacctatacaggtggacgtccgaggcaaggacggacggaggctagaacttattagttgtacaatcgagacaagaaccaataagtaattaacttatacttttatcgttacttacggattcggtacgggaaccgtacgggttacccaccggtttacgtaacgggtccaacggtaccccgaacggacccaaccccgtacttaccg

SEQ ID NO: 414941 - DNA, 570 bp, Homo sapiens
  misc_feature: GZ8MTXP02JCPIG.3.10.A10.1.454.CMB.2.raw
  modified_base (216)..(216): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctgganatgcattgaccaaagcaatatgacttattggtaaccaaacaaaagccaggccaggcccctggtggtggtgatataataaagacagtgagaggccctgagggactcccgtgagcgattctccgtggctcagctacgagggacaacagtccagttcgaccatcagtggacgtccagggccaagggagacggagctagactattatgtacaatcagcaagacaacagtaaactacttattactttaagtcgttacgttacggtattcggtacgggtaaccgtacggggtaccctacccggttaccgtaacgggtaccaaccggacccgaaacggaccccctaaaacccacgttccgg

SEQ ID NO: 414942 - DNA, 507 bp, Homo sapiens
  misc_feature: GZ8MTXP02IH8GS.3.10.A10.1.454.CMB.2.raw
  modified_base (424)..(424): a, c, t, g, unknown or other
  modified_base (439)..(439): a, c, t, g, unknown or other
  modified_base (449)..(449): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttatggtaaccaacaaaagccaggccacggcccctgtggtggtgatataataaagacagtgagaggcctcgagggactccgtgagcgattctcctggcctcgagctcgagggacaacgatcacgttgacatcagtgagtccaggcagtaggacgtaggctgactattaattgacatcagcagacaanataatactatcttangttctcgtanctagggactacgggtcaccgtcgtaacgcacgacccaacggcccaaaccccgtatccg

SEQ ID NO: 414943 - DNA, 550 bp, Homo sapiens
  misc_feature: GZ8MTXP02INMWW.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtacaacaaaagccaggccaggcccctgtggtggtgatataataaagacagtgaagaggcccctcgagggactcccctgagcgattctctggctccagctcgagggacaaacagtcacgttgaccatcagtggagtcgaggacaggaaggacggaagggctaggaacttagtttattggtactaattcaacgcagacaaactaagtaattaacttattacttttaatgttacttcggtatcgtcgggaccgtaggtaccgtaacgttccgtacggtccacgtcccgaacggtacccaaaccccc

SEQ ID NO: 414944 - DNA, 526 bp, Homo sapiens
  misc_feature: GZ8MTXP02HVIU6.3.10.A10.1.454.CMB.2.raw
  modified_base (249)..(249): a, c, t, g, unknown or other
  modified_base (302)..(302): a, c, t, g, unknown or other
  modified_base (406)..(406): a, c, t, g, unknown or other
  modified_base (415)..(415): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttatggtacaanaaagccaggccaggcccctgtggtgtgatatataaagacagtgagaggccctnagggatccctgagcgattctctggcctcagctcgagggcaacagtcacgttgaccatcagtgagtccaggcagaggacgaggctgactattattgtacaatcancagacaaanagtaatacttatactttatagttcttcggtattcgttagggaacctacggggtacctaccgttccgaaggttacaacgtacccgaaacggaccccaaaccccgtacttccg

SEQ ID NO: 414945 - DNA, 520 bp, Homo sapiens
  misc_feature: GZ8MTXP02HU19R.3.10.A10.1.454.CMB.2.raw
  modified_base (339)..(339): a, c, t, g, unknown or other
  modified_base (349)..(349): a, c, t, g, unknown or other
  modified_base (404)..(404): a, c, t, g, unknown or other
tcagagacgcactccacgaccggtgctcgatttagcgtcgatctcaggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggacaacaaagcagcagccctgtgtggtgatatataaagacagtgagagccctcagggatcctgagcgactctctgctccagctcagggacaacngtacacgtanacatcagtgacgcgagacagaggacgaggctagattattagttgtactaatcganacgagaacaacaagtaaattaacttaattactttacttagttacgttacgtacgtacgtacggtacgtacggtacgtaaccgtacgtacgtacgacgaccgaaccgaccgaacccg

SEQ ID NO: 414946 - DNA, 244 bp, Homo sapiens
  misc_feature: GZ8MTXP02FFG0H.3.10.A10.1.454.CMB.2.raw
  modified_base (244)..(244): a, c, t, g, unknown or other
tcagagacgcactccacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccgagtgcgtctctgagcgggctggcaaggcgcatagn

SEQ ID NO: 414947 - DNA, 539 bp, Homo sapiens
  misc_feature: GZ8MTXP02I6GPM.3.10.A10.1.454.CMB.2.raw
  modified_base (257)..(257): a, c, t, g, unknown or other
  modified_base (415)..(415): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaaatatgcttattggtaaccaanaaaagccaggccaggcccctgtggtggtgatataataaagacagtgagaggccctgagggactcccgtgagcgattctctggctcagctcgaagggacaaacagtcacgttgaccatcagtggagtccaggcaggaggacgaggctgactattatganaatcagcaagacaacaagtaaattacttattactttatagtttccgtacggtaattcgtacgggaacccgtagggtcctaaccgtcctacgggtacacgaccccgaacggaccccaaaaccccg

SEQ ID NO: 414948 - DNA, 491 bp, Homo sapiens
  misc_feature: GZ8MTXP02GFIIV.3.10.A10.1.454.CMB.2.raw
  modified_base (307)..(307): a, c, t, g, unknown or other
  modified_base (352)..(352): a, c, t, g, unknown or other
tcagagacgcactccacgaccggtgctcgatttagcgtcgatctcagggggctgtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgccaaagcaatatgcttatggtaccaacaaaagccaggccaggcccctgtggtggtgatatataaagacagtgagaggccctnagggatccctgagcgattctctggctccagctcgagggacaaacngtcacgttgaccatcagtgagtccaggcagaggacgaggctgactattattgcaatcagcagacaacagtaatacttatctttaatgtcttcggatctgggaccagggtcaacgtccaggtcagcccaaggccaaaccc

SEQ ID NO: 414949 - DNA, 547 bp, Homo sapiens
  misc_feature: GZ8MTXP02FSF9M.3.10.A10.1.454.CMB.2.raw
  modified_base (250)..(250): a, c, t, g, unknown or other
  modified_base (403)..(403): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacaaagccaccctcggtgtcagtgtccccaggacagacggccaagatcacctgctctggagatgcattgaccaaagcaatatgcttatggtacaanaaagcagcagccctgtgtggtgatatataaagacagtgagaggcctcagggatccctgagcgattctctcggctccagctcgaggacacagtcacgttgaccatcagtgagtccaggacagagacgaggctgactattattgtacaatcagtnagacaacagtaatacttatctttaatcgttcttacggattcgtacgggtaccgtaggggttccgtaacccggttccgttaacgggttccgaacggacccccgtaaaacgggcccccgtaaaaccctaccgtcggtttaaccccc

SEQ ID NO: 414950 - DNA, 603 bp, Homo sapiens
  misc_feature: GZ8MTXP02H5G61.3.10.A10.1.454.CMB.2.raw
  modified_base (215)..(215): a, c, t, g, unknown or other
  modified_base (433)..(433): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctgganatgcattgaccaaagcaaatatgcttattggtaaccaacaaaagccaggccaaggcccctggtggtggtgatataataaagacagtgagaggcctcgagggctccgtgagcgattctctggctcagctacgagggacaaacagtacagttcgaccatcgagtggagtccgaggcgaagaggacgaggctagacttattagtttgtactaatcgacganaacggaaacaaacgtaagtttaaaataactttattacgttttaaattcggtttacgttacggtaaacttcggttacggggaaccgtacgggggttaccctaacccggttccgtaaacgggttccaaacggtaccccgaaaacggaccccctaaacccccgtacgttaccg

SEQ ID NO: 414951 - DNA, 508 bp, Homo sapiens
  misc_feature: GZ8MTXP02IDO4Y.3.10.A10.1.454.CMB.2.raw
  modified_base (463)..(463): a, c, t, g, unknown or other
tcagagacgcactccacgaccggtgctcgatttagcgtcgatctcagggggtgggtccaggaggcagaactctgggtgtctcaccatggcccggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaacaacaaagccaggccaggcccctgtggtggtgatatataaagacagtgagaggccctacgagggactcccgtgagcgattctctcggcctccagctcgagggacacgagtcacgttgacccatcagtgagccaggcagagacgaggctagactatatgtcaatcagcagacaacgataatacttatctttatgtcttacggattcgcggtaccgngggtaccaccgttcaggtcacgaccgacgacccacccactctacc

SEQ ID NO: 414952 - DNA, 589 bp, Homo sapiens
  misc_feature: GZ8MTXP02IG3OD.3.10.A10.1.454.CMB.2.raw
  modified_base (503)..(503): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaaagatcacctgctctggagatgcattgaccaaagcaatatgcttattggaaccaaacaaaagccaggccaggcccctgtggtggtgatataataaagacagtgaagacggccctgagggactccccgtaggagcgtacttcctcgtcggctaccagctcgaaagggaacaaacgtagtaccacggtttacgaacccattcgaaaggttcgggacgtcccggaagggcaagggaacggacgagctagacttattagttgtacaatcaagcaagaacaagtagtaaatactttaatacttttaancgtttcgtacgtaattcgtacggggacctaggggtcctaacccggttcgtacgggtcaacgaccccgaaacgaacccctaaccccg

SEQ ID NO: 414953 - DNA, 674 bp, Homo sapiens
  misc_feature: GZ8MTXP02G46LV.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggtcaagatcacctgctctggagatgcattgaccaaagcaatatgtacttattacggtaaccaaacaaaagccgacggacccacggcccctggtggtggtagaataataataaagacgagtgaaggacggccctagagggactcccgtgacgcgtacttctcgtggcctcgagtctcggaagggaaccaaacgtacgtcctaacggttcgaaccctagtccgtaaggtggacggtacccgaagggaccgaagggaacgggaccggtaagggccgttaggtaaacctttatttaaagttcggtaactaaacgttcgaagtaccgaaagaaccaaaacgtaagttaaattactttaattacttttaattcgttaccgttacggttacgttacgggtacggggtaaacccgtacgggtacctaacccggttacgtacgggtaccaccggtacccccgaaacgggaccccctaaaccccccg

SEQ ID NO: 414954 - DNA, 503 bp, Homo sapiens
  misc_feature: GZ8MTXP02JWQGW.3.10.A10.1.454.CMB.2.raw
  modified_base (421)..(421): a, c, t, g, unknown or other
tcagagacgcactccacgaccggtgctcgatttagcgtcgatctcagggggctgtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgccaaagcaatatgcttatggtaccaacaaagccaggccaggcccctgtggtggtgatatataaagacagtgagaggccctcgaggggatccctgagcgacttctctggctcagctcgagggacaacagtcacgttgaccatcagtggagtccaggcaggaggacgaggctgactattatgtcaatcagcagacaanagtaatacttatctttatgttcttcggatcgtacgggacctaggggtccaacgtctaggtcacgcccaacggacccaacccc

SEQ ID NO: 414955 - DNA, 506 bp, Homo sapiens
  misc_feature: GZ8MTXP02HX9A1.3.10.A10.1.454.CMB.2.raw
  modified_base (249)..(249): a, c, t, g, unknown or other
  modified_base (270)..(270): a, c, t, g, unknown or other
  modified_base (296)..(296): a, c, t, g, unknown or other
  modified_base (424)..(424): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttatgtacaanaaagcagcagccctgtggtgngatatataaagacagtgagaggcctnagggatcccgtgagcgattctcgtgctcagctcgagggacaacagtcacgttgaccatcagtgagtcaggcagagacgagcagactatatgtacaatcagcaagacaacagtaatacttatactttangttctacggattcgtcggggaaccacggggttccaaccggtctaaggtcaacgaccccgaaaggaccccaaccctacgtccg

SEQ ID NO: 414956 - DNA, 707 bp, Homo sapiens
  misc_feature: GZ8MTXP02HHC7F.3.10.A10.1.454.CMB.2.raw
  modified_base (255)..(255): a, c, t, g, unknown or other
  modified_base (271)..(271): a, c, t, g, unknown or other
  modified_base (276)..(276): a, c, t, g, unknown or other
  modified_base (288)..(288): a, c, t, g, unknown or other
tcagagacgcactccacgaccggtgctcgatttagcgtcgatctcagggggctgtgggtccaggaggcagaactctgggtgtctcaccatggcctggatccctctacttcctccccctcctcactctctgcacagactctgaggcctcctatgagctgacacagccaccctcggtgtcagtcgtcccaggacagacggccaagatcacctgctcgtggagatgcattgacaaagcaatatgcttattgaacaaanaaagccagcagcctgnggtgnatatataaaganagtgagaggccctcgagggactcccgagacgcgtaactttcgtctcggcttacccaggccttaccgaaggggaaccaaaccgtagtaccgtaacggtttacgaaaccctaaattccgaaaggttggaacggttacccgaaagggggcaaaggggaacgggttaacggagggttcctaggtaaaccttaagttttaaattggtttaaaccaaaacgtacgaacgtaacgaaacgaaacgtaaaacgtaaacgttaaaacgtttaaacgtttaaactttaacgttttaacgtttacgtttacggtttacggttaacggttacggttaccgggtaccggtaaccgggttaccggtaacccgttaccggtaaccggttaccggtaaccggtaacccgtaaacccggtaaacccgtaaaccccg

SEQ ID NO: 414957 - DNA, 496 bp, Homo sapiens
  misc_feature: GZ8MTXP02JLMPX.3.10.A10.1.454.CMB.2.raw
  modified_base (254)..(254): a, c, t, g, unknown or other
  modified_base (309)..(309): a, c, t, g, unknown or other
  modified_base (422)..(422): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaanaaaagccaggccaggcccctgtggtggtgatatataaagacagtgagaggccctnagggatccctgagcgattctctggctccagctcagggacaacagtcacgttgaccatcagtgagtccaggcaggaggacgaggctgactattattgtcaatcagcaagacaanagtaatacttatctttaatgtacttcggatcgtggaccaggtccaacgtcaggtcagcccaaaggccaaacccc

SEQ ID NO: 414958 - DNA, 563 bp, Homo sapiens
  misc_feature: GZ8MTXP02HT7KE.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgcttattggtaccaacaaaagccaggccaggcccctgtggtggtgatatataaagacagtgagaggccctgagggatccctagagcgtattctcgtggctcagctcgagggacaaacgagtcacgttgaccatcagtggatccgaggcaggaggacgaggctgaacttagttattgtacaatcagacaagaacaacaagttaaactaactttatacttttaagtcgtttacttacggtattacgtacggggtaaccctaaggggttccaacccggtttctaacgggttcaacggacccccgaaacggtacccccaaacccccg

SEQ ID NO: 414959 - DNA, 554 bp, Homo sapiens
  misc_feature: GZ8MTXP02HGB2C.3.10.A10.1.454.CMB.2.raw
  modified_base (251)..(251): a, c, t, g, unknown or other
  modified_base (350)..(350): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttatggtaaccaanaaagccagccaggcccctgtggtggtgatataataaagacagtgagaggccctgagggatccctgagcgattctcgtgcctcagctacgagggcaaacngtcacgttcgacatcagtggagtccgaggcaggacggacgagctagtactattagttgtacaattcagctaagaacaacagtaaacttacttattctttatgttcgttacggtatcgttacggggaaccctagggttacccaccgttacgtaacgggttccaaacggaccccgaaaacggtccccaaaacccccgttactaccg

SEQ ID NO: 414960 - DNA, 692 bp, Homo sapiens
  misc_feature: GZ8MTXP02I9GMH.3.10.A10.1.454.CMB.2.raw
  modified_base (551)..(551): a, c, t, g, unknown or other
  modified_base (562)..(562): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaaattatgtacttagttacggtaaccaaacgaaaacgccgaacggaccgaaccggcccccgttggtagggtggtagtaattaataaagtaaaagaacgtaggtaggaaggaccgggtacccctacggtaaacggggtaccttccccgtaggaaccggacggttactttccgttaccggtcggtaccctccgaacggtctaccggaagggaccaaacgtacgtaccgtacgttacgaacctactacgaaggttggacgttacccggaggacgaaggggaacggaccggtagacgtagaaacttatttacgttatactaaancgaagacgaanaaactaaacgtaagttaaacttaacttatttactttagtcgttacgttacgtacgtcggtacggtacggtacgtaccgtaccgtacgtaacgaccgaccgacccgtaaccgacccctaacctacgtaccg

SEQ ID NO: 414961 - DNA, 516 bp, Homo sapiens
  misc_feature: GZ8MTXP02GUBZ6.3.10.A10.1.454.CMB.2.raw
  modified_base (448)..(448): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgcttattggtaaccaaacaaaagccaggccacggcccctggtggtggtgatatataaagacagtgagacggccctgagggctcccgtgagcgattctcgtggctccagctcgagggcaacagtccacgttgacatcgagtggagtccaggcagaggacgaggctgacttattagttgacaatcagcaagacaacagtaatattatctttanttctcggatcgtggactacgggtaccacgttcgtaaggtcaacgcccaacggcccaacccgtactccg

SEQ ID NO: 414962 - DNA, 598 bp, Homo sapiens
  misc_feature: GZ8MTXP02GGDCD.3.10.A10.1.454.CMB.2.raw
  modified_base (282)..(282): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgcttatggtaccaacaaagccaggccaggcccctgtggtggngatataataaagacagtgagaggccctgagggactcccgtggagcgtacttctcgtggctccgagcgtcgacgggaacaaacgacgtaccgacgtttacgaccctagtccgaggtggacgtaccgagggacaaggaggacgaggctgaacttattagttgtactaatcgaagacgaagaacaacgtaaagttaattaacttattactttaagttcgttcgttaccggtattaccggtacgggtaacctaggggttaccctaacccggttccgtaacgggtaccgaaccgacccgaaaccggacccctaaacccccg

SEQ ID NO: 414963 - DNA, 506 bp, Homo sapiens
  misc_feature: GZ8MTXP02IK341.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggcgtcagtcgtccccaggacagacggccaagatcacctgctctggagatgcattgccaaagcaatatgcttattggaaccaacaaaagccaggccaggcccctgtggtggtgatataataaagacagtgagaggccctgaggactccctgagcgtattctctgctccagctcgagggacaacgagtcacgttcgaccatcagtggagtccaggcaggaggacgaggctgacttattattgtacaatcagcagaacaacaagtaatactttatctttatgttcttcggatcgtcggactaggtcaacgtctaggtcacgcccaagcccaaacccg

SEQ ID NO: 414964 - DNA, 579 bp, Homo sapiens
  misc_feature: GZ8MTXP02GJQJN.3.10.A10.1.454.CMB.2.raw
  modified_base (423)..(423): a, c, t, g, unknown or other
  modified_base (433)..(433): a, c, t, g, unknown or other
  modified_base (470)..(470): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtcccaggacagacggccaagatcacctgctctggagatgcattgaccaaagcaaatatgtcttaattggtaaccaaacaaaagccaaggccacggcccctggtcggtggtagatataataaagacagtgagacggccctgagggactcccgtgagcgtattctcgtgctcagctacgagggacaacagtcacgttcgaactatacagtgactcgaggcaggagcgagctgaactattacttganaaactcgaanacaagaaaccaataagttaaataacttattactttancgtttccttaggaacttcggtacggggtacctaggggtttacccaccggtttaccgaaggttacccaacggtaacccccaacggaccccaaaacccccgttacgtaccg

SEQ ID NO: 414965 - DNA, 503 bp, Homo sapiens
  misc_feature: GZ8MTXP02F79CK.3.10.A10.1.454.CMB.2.raw
  modified_base (328)..(328): a, c, t, g, unknown or other
  modified_base (350)..(350): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctgagggatcctgagcgattcnctggctcagctcgagggacaanagtcacgttgaccatcagtggagtccaggcaggaggacgaggctagactattatgtcaatcagcagacaacagtaatacttatctttatgtcttcggattcgtacgggacctagggtccaaccgtcgaggtcacgcccaacggcccaaacccg

SEQ ID NO: 414966 - DNA, 520 bp, Homo sapiens
  misc_feature: GZ8MTXP02GZKSU.3.10.A10.1.454.CMB.2.raw
  modified_base (434)..(434): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaaccaaacaaaagccaggcccaggcccctgtggtggtgatataataaagacagtgagaggccctgagggactccctgacgcgattctctggctccagctcgagggacaacgagtccagttgacccatcaggtgagtccgaggcaggagacgaggctgacttattattgacatcagacagaacaanagtaatacttattactttatgttcttcgattcgtcgggactacgggctaaccggtctacggtcacgcccaaggacccctaaacccg

SEQ ID NO: 414967 - DNA, 509 bp, Homo sapiens
  misc_feature: GZ8MTXP02JLCJE.3.10.A10.1.454.CMB.2.raw
  modified_base (254)..(254): a, c, t, g, unknown or other
  modified_base (308)..(308): a, c, t, g, unknown or other
  modified_base (328)..(328): a, c, t, g, unknown or other
  modified_base (397)..(397): a, c, t, g, unknown or other
  modified_base (417)..(417): a, c, t, g, unknown or other
  modified_base (420)..(420): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaaatatgcttatggtacaanaaaagccagccaggcccctgtggtgtgatatataaagacagtgagaggcccctnagggatccctgagcgattcnctggctccagctgagggacaaacagtcagttgaccatcagtgatcaggcaggaggacgaggctgaactnttaatgtacaaatcagcaanaanaacaataataataattattattattacttacgtatacgtcggtacgacggtacgtaacgtacgtacgtacgacgaccgacgaccaaccc

SEQ ID NO: 414968 - DNA, 520 bp, Homo sapiens
  misc_feature: GZ8MTXP02ICXCB.3.10.A10.1.454.CMB.2.raw
  modified_base (248)..(248): a, c, t, g, unknown or other
  modified_base (252)..(252): a, c, t, g, unknown or other
  modified_base (265)..(265): a, c, t, g, unknown or other
  modified_base (342)..(342): a, c, t, g, unknown or other
  modified_base (412)..(412): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttatgtacaanaaancagcaggccctgngtgtgatatataaagacagtgagaggccctgagggactcccgtgagcgattctctggctcagctcgagggacaacgngtcacgttgaccatcagtggagtccgaggcagaggacgaggctgactattattgtcaatcagcagacaanagtaatacttatactttatcgttacttcggattcgttacggggacctacggggtcctaaccgtccgtaagggtccacggaccccaagggccccaaaacccgtctaccg

SEQ ID NO: 414969 - DNA, 646 bp, Homo sapiens
  misc_feature: GZ8MTXP02JL4YP.3.10.A10.1.454.CMB.2.raw
  modified_base (283)..(283): a, c, t, g, unknown or other
  modified_base (360)..(360): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaaccaaacaaaagccaggccaggcccctgtggtggtnatataataaagacagtgagaggccctgagggactcccgtagagcgtattctccgtggcctcagctcgagggacaacngtctacgtgaccatcgagtggacgtcgaggcaagggagggacggggctaggtacttagtttagttaggtactaaagtcgacgagaacgaaactaaacgtaaagttaaactttaactttaactttacgttttaaagttcgttacgtttacgggtactttaccggttacggggaaacccgttacggggttaccctaacccgggtttaccgtaaccggggttaaccgaaccgggtaacccccgaaaacggggaccccctaaaacccccgtacgttcccggttaaccccg

SEQ ID NO: 414970 - DNA, 534 bp, Homo sapiens
  misc_feature: GZ8MTXP02FZRUF.3.10.A10.1.454.CMB.2.raw
  modified_base (250)..(250): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattgtaccaanaaagccaggccaggcccctgtggtggtgatatataaagacagtgagacggccctgaagggactcccgtgacgcgtattctccgtggcctccgagctcgaaggggacaaacgagtcacgttgaccatcgaagtggacgtccgaaggcaaggaggacgaggctgacttattattgtacaatcagacagaaccaatagtaattacttatctttatcgtacttcggatcgtagggacctagggtccaccgttcaaggtccaacgccccaaaggcccaacccgactacg

SEQ ID NO: 414971 - DNA, 613 bp, Homo sapiens
  misc_feature: GZ8MTXP02I6PPU.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaagccaggccaggcccctggtggtggtgatatataaagacagtgagaggccctgagggactcccgtgagcgattctctggctcagctcgagggacaacgagtcacgttcgacatcgagtggacgtaccgagggacaaggagggaccgaagggtctaggaacttatttaagttcggtacaaaacttcgaacgacgaaacggaaaccaaaacgtaaggttaaaacttaaacctttaatttaccttttaagtcgtttacgtttacgggacttcggtacgggaaccgtacggggttaccctaccggttaccctaagggtcccaacggaccccgaacgggtacccccaaacccccgtacttacccg

SEQ ID NO: 414972 - DNA, 533 bp, Homo sapiens
  misc_feature: GZ8MTXP02GCVDE.3.10.A10.1.454.CMB.2.raw
  modified_base (251)..(251): a, c, t, g, unknown or other
  modified_base (450)..(450): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaanaaaagccaggccaggcccctgtggtggtgatatataaagacagtgagaggcctcgagggactccctgagcgattctccgtgcctcagctcgagggacaacagtccacgttcgaacctatcaggtggacgtccgaaggcagaggacgaggctagactattatgtacaatcagcaagacaacagtaatacttatactttancgttcttacggtatcggtggaccgtacgggtccaaccggttcctaaggtcaaccgacccgaacggcccaaaccccgagtaccg

SEQ ID NO: 414973 - DNA, 597 bp, Homo sapiens
  misc_feature: GZ8MTXP02H5GBT.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtcccccaggacagacggccaagatcacctgctctggagatgcattgaccaaagcaatatgcttattggtacaaacaaaagccaggccaggcccctgtggtggtgatataataaagacagtgagagccctgagggatcccgtgagcgtattctctggctccagctcgagggacaaacgagtaccacgttgacccatcgagtggacgtccgaggaccagggaggaacggaggctagacttaagtttagttgtacaaatcaagacaagaacaaacgtaagtaaacttactttaattacttttaagtcgtttactttacggaacttacggtacggggtaacccgttacggggtaccctaaccccggttacgtaacgggttacccgacggtaacccccgaacggaaccccctaaacccccg

SEQ ID NO: 414974 - DNA, 491 bp, Homo sapiens
  misc_feature: GZ8MTXP02HP99O.3.10.A10.1.454.CMB.2.raw
  modified_base (256)..(256): a, c, t, g, unknown or other
  modified_base (421)..(421): a, c, t, g, unknown or other
  modified_base (423)..(423): a, c, t, g, unknown or other
  modified_base (425)..(425): a, c, t, g, unknown or other
  modified_base (427)..(427): a, c, t, g, unknown or other
  modified_base (440)..(440): a, c, t, g, unknown or other
  modified_base (445)..(445): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgcttattggaccaaanaaaagccaggccaggcccctggtggtggtgatatataaagacagtgagaggccctgagggactcccgtgagcgtacttctcgtggctcaggctcgagggacaacagtcacgttgaccatcagtgagtcagcagaggacgagctagacttattattgtacatcgananananaatataatatatnttatnttctcgatcgacgactagtcaacgtcacgcacgaccgacgacccac

SEQ ID NO: 414975 - DNA, 491 bp, Homo sapiens
  misc_feature: GZ8MTXP02IISOM.3.10.A10.1.454.CMB.2.raw
  modified_base (248)..(248): a, c, t, g, unknown or other
  modified_base (320)..(320): a, c, t, g, unknown or other
  modified_base (395)..(395): a, c, t, g, unknown or other
  modified_base (399)..(399): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgccaaagcaatatgcttatggtacaanaaagcagccaggccctgtggtggtgatatataaagacagtgagaggccctcagggactccctgagcgattcnctggctcagctcgagggacaacagtcacgttgaccatcagtgagtcagcagaggacgaggctgactattattganaatnagcagacaacagtaatacttatactttatgtcttggatctagggacctagggtccacgtcctaaggtcacgcccaaagcccaacccactacg

SEQ ID NO: 414976 - DNA, 476 bp, Homo sapiens
  misc_feature: GZ8MTXP02IL866.3.10.A10.1.454.CMB.2.raw
  modified_base (245)..(245): a, c, t, g, unknown or other
  modified_base (260)..(260): a, c, t, g, unknown or other
  modified_base (292)..(292): a, c, t, g, unknown or other
  modified_base (301)..(301): a, c, t, g, unknown or other
  modified_base (398)..(398): a, c, t, g, unknown or other
  modified_base (425)..(425): a, c, t, g, unknown or other
tcagagacgcactccacgaccggtgctcgatttagcgtcgatctcaggggtgggtccaggaggcagaactctgggtgtctcaccatggcctggatccctctacttctcccctcctcactctctgcacagactctgaggcctcctatgagctgacacagccaccctcggtgtcagtgtcccaggacagacggccaagatcacctgctctggagatgcattgccaaagcaatatgcttatgtacaanaaagcaggcagcccngtgtgtgatatataaagacagtgagaggcctnagggatccngagcgattctctggctcagctcagggacaacagtacacgttgacatcagtgatcaggcagagacgagctgactattatgtacaatcagcaagacaanagtatacttatctttatgttctacggntcgtaggactaggggtcaccgtctaaggtcacggcccaagcccaaccatcg

SEQ ID NO: 414977 - DNA, 572 bp, Homo sapiens
  misc_feature: GZ8MTXP02GP93U.3.10.A10.1.454.CMB.2.raw
  modified_base (434)..(434): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgcttattggtaaccaaacaaaagccaggcccacggcccctggtggtggtgataataataaagacagtgagacggccctgagggtactcccgtgacgcgtacttctctggcctccagctcgagggacaacgagtcacgttgaaccatcaggtgacgtccaggacgaggaggacgaggctagaacttattatgtanaatcagacaagacaaactaagttaaattactttaattctttaagtcgtttacgttcggtaattcggtacgggaaccgtacgggtacccaaccggttccgtaacggtaccaccggacccgaacggacccctaaaccccg

SEQ ID NO: 414978 - DNA, 527 bp, Homo sapiens
  misc_feature: GZ8MTXP02JZ654.3.10.A10.1.454.CMB.2.raw
  modified_base (332)..(332): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaccaacaaagccaggccaggcccctggtggtggtgatatataaagacagtgagaggccctgaggggatcccgtgagcgtattctcnggctccagctcgagggacaacagtcacgttgaccatcagtggatccgaggcagaggacgaggctgacttattattgtacaatcagcaagacaacaagtaaactacttaattcttaatgtcgttcggtatcgtgggaccaggggttacccaccggtcgtaacggtcacgacccgaaggaccccaacccctactccg

SEQ ID NO: 414979 - DNA, 531 bp, Homo sapiens
  misc_feature: GZ8MTXP02FQ42G.3.10.A10.1.454.CMB.2.raw
  modified_base (276)..(276): a, c, t, g, unknown or other
  modified_base (526)..(526): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggngtgatataataaagacagtgagaggccctcgagggactccctgacgcgattcgtctggcctcagctacgagggacaaacagtaccacgttgaacccatcaagttggacgtccaggcagaggacaggctgactagttattgtacaatcgagacaagaacgaaacaagtaaattacttatactttatcgttacttcggaattcgtagggacctagggtccaccggttcaaggtcaacgccaaggcccaaccngtacg

SEQ ID NO: 414980 - DNA, 639 bp, Homo sapiens
  misc_feature: GZ8MTXP02HXSK5.3.10.A10.1.454.CMB.2.raw
  modified_base (258)..(258): a, c, t, g, unknown or other
  modified_base (284)..(284): a, c, t, g, unknown or other
  modified_base (291)..(291): a, c, t, g, unknown or other
tcagagacgcactccacgaccggtgctcgatttagcgtcgatctcagggggctgtgggtccaggaggcagaactctgggtgtctcaccatggcctggatccctctacttcctccccctcctcactctctgcacagactctgaggcctcctatgagctgacacagcccaccctcggtgtcagtcgtccccaggacagacggccaagatcacctgctcgtggagatgcattgacaaagcaatatgcttattgaaccaaanaaagccaggccaggccctgtggtgtnatataanaaagacagtagagacggccctagagggactccgtagacgcgtacttctcgtggcctcgacgctcgaagggaacaaacgtagtaccgtaacgttacgaaaccctgtaccgaaggttcggacgtacccgaagggaccaaggggacggaccggaagggctaagactttaaatttgttacgtacaaagttccgaagaccaaagaaacctaaacgtaaagttaaactttaacctttaagtttacctttttaaaggcgttttaccgttaaggtacgttcgttacggggacctaacggggtaccaacccgttcgtaacgggtccaaccgaccccgaaacggtacccccaaacccg

SEQ ID NO: 414981 - DNA, 623 bp, Homo sapiens
  misc_feature: GZ8MTXP02FYDWV.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagcccaccctcggtgtcagtcgtccccaggacagacggccaagatcacctgctctggagatgcattcgaccaaagcaaatatgtacttattcggtaaccaaacaaaagccaggcccacggcccctggtggtggtgaatataataaagacagtagagacggccctgagggtactcccgtgacgcgtacttcctcgtggcctcgacgcctcggaacgggaaccaaacgtacgtccgtacgtttacgacccatacgtaggtggacgtccgagggacaggtaggacggaggtactagtacttaagttagttgtacaatcgagtacgaagaactaaactaagttaacttaactttattacttttaagtcgtttacgttacggtaacgttcggtacgggaaccgtacgggttaccgaacccggttacgtacggtaccgaccgacccgtaaccgacccgtaaacccccg

SEQ ID NO: 414982 - DNA, 584 bp, Homo sapiens
  misc_feature: GZ8MTXP02GK2A3.3.10.A10.1.454.CMB.2.raw
  modified_base (344)..(344): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacaggacggccaagatcacctgctctggagatgctattgaccaaagcaatatgtcttagttcggtaaccaaacaaaacgccaaggcccgacggcccctggtggtggtgatataataaagacagtgagacggccctagagggactcctgagcgattcncgtggctcagctacgagggacaacgagtaccacgttcgaaccatcgagtggacgtccgaggcaagacggacgaggctagactatttagtgtacaatcagacaagaacaactagtaaatacttattacgtttatcgttacttcggtaatcggttacgggaacctacggggtaccctaccggttaccgtaacggttccaaaccggaccccgaaacggtaccccaaacccccgtacgttaccg

SEQ ID NO: 414983 - DNA, 558 bp, Homo sapiens
  misc_feature: GZ8MTXP02JJYHB.3.10.A10.1.454.CMB.2.raw
  modified_base (383)..(383): a, c, t, g, unknown or other
  modified_base (409)..(409): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaccaacaaagccaggccaggcccctgtggtggtgatatataaagacagtgagaggcctcgagggactcccgtgagcgtattctcctggctcagctcagggacaaacgagtacacgttgaccatcagtgagtccaggnagagacgaggctagactattatgtanaatcagcaagaacaacgaagttaactatttaatactttaatggttacttagggacttacgttcggggaaccttacggggtaccacccggttaccgtaagggtcccgtaacgaccccgtaaacggaccccaaaccccgacgtttacccgg

SEQ ID NO: 414984 - DNA, 724 bp, Homo sapiens
  misc_feature: GZ8MTXP02JOUFA.3.10.A10.1.454.CMB.2.raw
  modified_base (248)..(248): a, c, t, g, unknown or other
  modified_base (264)..(264): a, c, t, g, unknown or other
tcagagacgcactccacgaccggtgctcgatttagcgtcgatctcagggggtgggtccaggaggcagaactctgggtgtctcaccatggcccggatccctctacttctccccctcctcactctctgcacagactctgaggcctcctatgagctgacacagccaccctcggtgtcagtgtccccaggacagacggccaagatcacctgctctggagatgcattgccaaagcaatatgcttatgtacaanaaagcagcagccctgnggtgtgatatataaagacagtgagaggcctcgagggactcccgtgacgcgtattctcgtcggcctccgagcctcgaacggggaccacgacgttcaacggtttcgaaccctattccgaagggttcggacgttacccgagggaccgaagggaacgggacggacgggaccgttaggtaaccttaagtttaacgtttaggtaccgtaaattcccgaaggacccaaagggtaaacccaaaacgtaaaggtttaaaatttaacccttttaattaacccgtttttaattacgggttaccttttaccggggtaactttcggtttaaccgggggaacccgttaaacgggggttcccctaaaccccgggtttacccgttaaacgggggttaaccctaaaccgggtaccccccggtaaaacggggaccccccctaaaaccccccggtaacggtttcccgtttaaacccccg

SEQ ID NO: 414985 - DNA, 545 bp, Homo sapiens
  misc_feature: GZ8MTXP02JBV81.3.10.A10.1.454.CMB.2.raw
  modified_base (461)..(461): a, c, t, g, unknown or other
  modified_base (474)..(474): a, c, t, g, unknown or other
  modified_base (491)..(491): a, c, t, g, unknown or other
  modified_base (502)..(502): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagcccaccctcggtgtcagtcgtccccaggacagacggccaagactcacctgctctggagatgcattgaccaaagcaatatgacttattggtaaccaacaaaacgccacggccaggcccctggtggtggtgatataataaagacagtgaggacggccctagagggactccgtgacgcgtacttctcgtcggcctcgaggctcgaagggacaaacagtcacgttcgacccatcaaggtggacgtccgaaggaccaggaacgggtaccgaaggctaggtaactatttaattgacaatcgaanctaagacctaaanataactattatctttangttcttacggntcgacgacgtagtactcgtcgtacgacacgaccgacgacccac

SEQ ID NO: 414986 - DNA, 572 bp, Homo sapiens
  misc_feature: GZ8MTXP02H02CT.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttatggtacaacaaaagccaggccaggcccctgtcggtggtgatataataaagacaggtagaggacggccctcgagggactcccgtgacgcgattctctggcctcgagctcgagggacaacgacgtcacgttgaccatacgagtggacgtccgaggacaggaggaccgaggctagactattaagttgtacatcagcaagacaaactagttaatactttatacgtttaatcgtttcgttacggtattcggttacgggaacctagggggttacctaacccggttacgtaacggtaccgaaccggcccgaaaacggacccctaacccgtaacttccgg

SEQ ID NO: 414987 - DNA, 568 bp, Homo sapiens
  misc_feature: GZ8MTXP02IHBBV.3.10.A10.1.454.CMB.2.raw
  modified_base (255)..(255): a, c, t, g, unknown or other
  modified_base (446)..(446): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgacaaagcaatatgcttattggtaacaanaaaagccaggccaggcccctgtggtggtgatatataaagacagtgaagaggccctgagggactccccgtgagcgatttctctggctcagctcgagggaacaacgtacgtcacgttgaaccatccaggttagggacgtccgaggacgagggaaggacgaagggctaggaacttaagtttattgtacaaattnaagcagaacaactaagtaaattacttattctttaagtgttaccttcggtaatcgttacgggggtaccgggttactacccggtcgttacggtacgaccgacccgaacggccccaaaaccctcg

SEQ ID NO: 414988 - DNA, 576 bp, Homo sapiens
  misc_feature: GZ8MTXP02JKYDZ.3.10.A10.1.454.CMB.2.raw
  modified_base (287)..(287): a, c, t, g, unknown or other
  modified_base (327)..(327): a, c, t, g, unknown or other
  modified_base (355)..(355): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgcttatggtaaccaacaaagccaggccaggcccctgtggtggtgatatanaaagacagtgagaggccctgagggatccctgagcgattcncctggcctccagctacgagggacaacgngtccacgttgaaccatcgagtgacgtccaggcaggaggacgaggctagactattagtgacaatcagcaagacaaacgtaagtaaacttactttattactttaagtcgttaccgttacgggtatacgttacgggggaaccctacgggggttaccctaacccggttacggtaacggtccgaaccgtaccccgaaacggtaccccctaaacccccagtttcccg

SEQ ID NO: 414989 - DNA, 561 bp, Homo sapiens
  misc_feature: GZ8MTXP02JCW6X.3.10.A10.1.454.CMB.2.raw
  modified_base (254)..(254): a, c, t, g, unknown or other
  modified_base (433)..(433): a, c, t, g, unknown or other
  modified_base (455)..(455): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgacttattggtaccaaanaaaagccaggccaggcccctgtggtggtgatatataaagacagtgagaggccctgagggactcccgtgagcgtattctccgtggcctcgagctcgagggcaacagtcacgttgaaccatcagtggatccgaggcaagaggacgaggctgactagttatgtacaatcagacagaacaaanagttaaatacttattactttancgttacttacggattcggttacgggacccgtagggttacccacccggttaccgtaagggtacccaacggaccccaaaacgggcccccaaaacccccgtagttcccg

SEQ ID NO: 414990 - DNA, 546 bp, Homo sapiens
  misc_feature: GZ8MTXP02JEKD4.3.10.A10.1.454.CMB.2.raw
  modified_base (339)..(339): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttatggtaacaacaaaagccaggccacggcccctggtggtggtgatataataaagacagtgagacggccctgagggtactccgtggagcgtactttcncgtcggctcgagctcgagggacaacgagtcacgtttgacccatcgagtcggatccgaggcaggaggacgagctagactattagtcgacaatcgagcaagaacaactaagtaattacttatctttaagtgttacttacggattacgtcggggaacctaggtccaaccggttcgtacggtccgacgtacccgaacggaccctaaacccg

SEQ ID NO: 414991 - DNA, 486 bp, Homo sapiens
  misc_feature: GZ8MTXP02JM2RQ.3.10.A10.1.454.CMB.2.raw
  modified_base (245)..(245): a, c, t, g, unknown or other
  modified_base (259)..(259): a, c, t, g, unknown or other
  modified_base (263)..(263): a, c, t, g, unknown or other
  modified_base (265)..(265): a, c, t, g, unknown or other
  modified_base (269)..(269): a, c, t, g, unknown or other
  modified_base (295)..(295): a, c, t, g, unknown or other
  modified_base (430)..(430): a, c, t, g, unknown or other
  modified_base (449)..(449): a, c, t, g, unknown or other
tcagagacgcactccacgaccggtgctcgatttagcgtcgatctcaggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgccaaagcaatatgcttatgacaanaaagcagcagcccngtgngnatanataaagacagtgagagccctgagggntccctggagcgattctccgtggcctccagctacaggggacaacgagtcacgttgaccatcaagtgagtccaggcagagacgaggctgactagttatgtacaatcagcaagacaaacagtaatacttatctttaangtcttcggatcgtggaccnggtccacgtcctaaggtcagcccagtccaacccgatc

SEQ ID NO: 414992 - DNA, 500 bp, Homo sapiens
  misc_feature: GZ8MTXP02FQAON.3.10.A10.1.454.CMB.2.raw
  modified_base (311)..(311): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaaacaaaagccaggccaggcccctgtggtggtgatataataaagacagtgagaggccctnagggatcccgtgagcgattctctggctcagctcagggacaacagtcacgttgaccatcagtggagtccaggcagaggacgaggctgacttattattgcaaatcagcagacaatagtaatacttatctttatgtcttcggattcgtacggaccagggtcaaccgtcacggtcagccaacgcccaaacccg

SEQ ID NO: 414993 - DNA, 583 bp, Homo sapiens
  misc_feature: GZ8MTXP02JLF14.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgctattgaccaaagcaatatgtacttattacggtaaccaacaaaacgccaggacccacggcccctaggtggtggtagatataataaagacagtgagacgccctagagggactccgtagacgtctacgtttctcgtcggctccgagctcgaagggaacaacgacgtacacgttgaaccctatcgaggtaggacgtccgaggacagggacggacgaggctagtacttattatagtacaatcaagccaagaaccaagtaagtaattactttatctttagtcgttcttacggattacggttcgggaaccctgggtaccctaaccggtcgtacggtccaacggtaccccaacggacccctaaccccg

SEQ ID NO: 414994 - DNA, 477 bp, Homo sapiens
  misc_feature: GZ8MTXP02F9VXY.3.10.A10.1.454.CMB.2.raw
  modified_base (246)..(246): a, c, t, g, unknown or other
  modified_base (262)..(262): a, c, t, g, unknown or other
  modified_base (266)..(266): a, c, t, g, unknown or other
  modified_base (293)..(293): a, c, t, g, unknown or other
  modified_base (371)..(371): a, c, t, g, unknown or other
  modified_base (381)..(381): a, c, t, g, unknown or other
  modified_base (405)..(405): a, c, t, g, unknown or other
  modified_base (430)..(430): a, c, t, g, unknown or other
  modified_base (473)..(473): a, c, t, g, unknown or other
tcagagacgcactccacgaccggtgctcgatttagcgtcgatctcaggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttatgtacanaaagcagcagccctgngtgngatatataaagacagtgagaggccctnagggatccctgagcgattctctggctcagctcagggcaacagtcacgttgaccatcagtggactcaggcagaggacgnggactgactnttagttgtcaatcagcagaccaanagtatacttatcttatgtcttcggntcgtggacagtcaccgtctaaggtcaagcccaaggccaacccntccg

SEQ ID NO: 414995 - DNA, 590 bp, Homo sapiens
  misc_feature: GZ8MTXP02HPLWC.3.10.A10.1.454.CMB.2.raw
  modified_base (308)..(308): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagcagtgagaggccctnagggatccctgagcgattcctctggctcagctcaggggacaacagtcacgttgacccatcgaggtagacgtacgacggacgaagggaacgggaacggacggtacgtacggtaaccttaaagttttagttacggttaactaacttacgagaccgaaggtaaaccaaacgtaagttaaacttactttaattactttagtacgtttcgttacgtacttcggtacgggacgtacggtaccgtaaccgttacgtacggtcaccggacccgaacggtaccccaacccg

SEQ ID NO: 414996 - DNA, 626 bp, Homo sapiens
  misc_feature: GZ8MTXP02J2FB7.3.10.A10.1.454.CMB.2.raw
  modified_base (358)..(358): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgtacttagttcggtaaccaaacaaagcccgaggaccacggtcccctggtggtggtagatataataaagactaggtagaaggaccggccctacggagggactcccgtaggacgcgtattctcgnggctccgagtcacgagggaccaacgacgtcacgttacaccgtatcgaggtggacgtaccgaggacgaggaggggaccgagggtctaacggtacttaattagtttcgacaaagttccaaggacaaacggaacaaccggtaataaactttaacttacttactttaagtcgtttaccgtacgtagttccggttacgggaccgtacggggtcctaacccggttacgtaacgggtacaccgacccgaaacggccccctaaaacccgctacccg

SEQ ID NO: 414997 - DNA, 580 bp, Homo sapiens
  misc_feature: GZ8MTXP02IQF1Q.3.10.A10.1.454.CMB.2.raw
  modified_base (434)..(434): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtcgtccccaggacagacggccaagatcacctgctctggagatgcattgccaaagcaatatgctttattggtaaccaaacaaaagccaggccaggcccctggtggtggtgatatataaagacagtgagacggccctcgagggactccctgagcgtattctctggcctccagtctcgagggaccaactacgtccgacgttcgaacctatcgagtggacgtcgaggcaggacggacgaggctagactattagttgtacaatnagacaagaacaacagttaattaactttattactttagtcgtttacgttcggtaattcggtacgggaccgttacggggtacctacccggttaccgttaaggtaccgaccggtaccccgaaacggaccccaaccccgtaacgttcccg

SEQ ID NO: 414998 - DNA, 756 bp, Homo sapiens
  misc_feature: GZ8MTXP02G45Y9.3.10.A10.1.454.CMB.2.raw
tcagagacgcactccacgaccggtgctcgatttagcgtcgatctcagggggtgggtccaggaggcagaactctgggtgtctcaccatggcccggatccctctacttcctccccctcctcactctctgcacagactctgaggcctcctatgagctgacacagccaccctcggtgtcagtcgtccccaggacagacggccaagatcacctgctctggagatgcattgaccaaagcaatatgacttattggtaaccaaacaaaagccaaggccaggcccctggtggtggtgaatataataaagacagtagagacggccctgagggactcccgtgagcgtattctcgtcggcctccagcctacgaacggggaacaacgtagtacctaaccggttacgaaccctagtaccgtagggttacgggacgtacccgaaggggaccgaaggggaaacggggaacggtaacgggccttagggtaaaacctttaatttaacgtttaggtaacctaaaagttaccctaaagggaccaaaacgggaaaaccaaaaaccgtaaagttaaaacttaacctttaaatttaaccttttaaagttcgttaccgtttaccgggaatttaccggtaacgggggtaaacccgttaacgggggtacccctaaccccgggtttaacccgtttaaacggggtaacccgtaaaaccggtaacccccggtaaaaaccgggtaaaccccccgaaaaccccctaacggtttaccgttaaaccccc

SEQ ID NO: 414999 - DNA, 581 bp, Homo sapiens
  misc_feature: GZ8MTXP02H5JJT.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgctattgaccaaagcaatatgtactttattggtaaccaaacaaaagccaaggccaggcccctggtggtggtgatataataaagacagtgaggaggccctgagggactccctgagcgtattctcgtggctcgagctcgaagggcaaacgagtccacgttcaccatcagtgagtccgagcagaggacgagctagactattattagtacaattcaagcagaaacaaacgaagttaaactactttaatactttaagttgttacgtttacggtattcgtacgggggtaacctacgggggtaccctaaccggttccgtaacggttcgaaccggaccccgaaacggaccccctaaaccccgtacgtacccg

SEQ ID NO: 415000 - DNA, 514 bp, Homo sapiens
  misc_feature: GZ8MTXP02GMIOG.3.10.A10.1.454.CMB.2.raw
  modified_base (250)..(250): a, c, t, g, unknown or other
  modified_base (304)..(304): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtacaanaaagccaggccaggcccctgtggtggtgatatataaagacagtgagaggccctnagggatccctgagcgattctcctggctccagctcgagggcaaacagtcacgttgaccatcagtggatccaggcagagacgagctgactattatgtacaatcagcagacaacagtaatacttattctttatgttcttacggattcgtagggacctaggggtaccaccgttccgtaaggtccacgaccccgaaggccccaacccgacttccg

SEQ ID NO: 415001 - DNA, 506 bp, Homo sapiens
  misc_feature: GZ8MTXP02G1BCG.3.10.A10.1.454.CMB.2.raw
  modified_base (471)..(471): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaaccaaacaaaagccaggccaggcccctgtggtggtgatataataaagacagtgagacggccctcgagggactcccgtgacgcgattctctggctcgagctcgagggacaaacgagtcacgttgaccatcagtgagtccaggcaggaggacgagctagactattatgtacaatcagctagacaacagtaatacttatctttatgtcttcggatcgtcggacnggtcaacgtctacggtcacgccaacgcctaacccg

SEQ ID NO: 415002 - DNA, 566 bp, Homo sapiens
  misc_feature: GZ8MTXP02FRCSN.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaccaacaaaagccaggccaggcccctgtggtggtgatataataaagacagtgagaggccctagagggactcccgtgacgcgtaattctcgtggctcgacgtctacgaaggggaccaaacacggtacaacgtttgaacccaagttccaaagggttggaacgtcccgaagggccaagacgggacgtaggcctagacttattaagttgacatacagacaagaccaatagtaatacttatactttatgtcttacggtatcgtagggacctaacggggtccacgttaccgtaaggtcaacgcccgaaacggcccaaccccatccg

SEQ ID NO: 415003 - DNA, 718 bp, Homo sapiens
  misc_feature: GZ8MTXP02HRIKB.3.10.A10.1.454.CMB.2.raw
  modified_base (262)..(262): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagcccaccctcggtgtcagtcgtccccaggacagacggccaagactcacctgctcgtggagatgctattcgacaaagcaatatgtacttatacggtaaccaaanaaaacgccgaggccacggcccctgtggtggtagataataagtaaagacagtagagacggcccctagacgggtactcccgtagacgtcgtattctccgtcggcctcgacgtctaccggaagggaccaaacgtagtaccgtaaccgttacgaacccctagtaccggaaagggttgggaaccgtcccgaaaggggccgaaaggggaacgggtaccggaggtaccgtagggtaaactttagttaggtttataacctaaagttacgaagaccgaaagaaaccaaacttaaaggttaaaacttacttttaattagtttttaacgtcgtttaccgtttaacggttcgtaccggttacggggtaacccgttacgggggttacccctacccggtttacggttaaaccggtcccgaaaccgggtacccccgtaaaacggtaccccccaaaacccgttactttcccg

SEQ ID NO: 415004 - DNA, 569 bp, Homo sapiens
  misc_feature: GZ8MTXP02FO1TK.3.10.A10.1.454.CMB.2.raw
  modified_base (336)..(336): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttatggtaaccaacaaagccaggccaggcccctggtggtggtgatataataaagacagtgagacggccctgagggactcccgtgacgcgacttcnctggctccagctcgagggacaaacgacgtcacgttcgacctatcgagtggacgtccgaggcaagggaggacggaggtactgaacttattagttgtacaattcgagaccgaagaacaaacgtaagtaaacttactttattctttaatcgttacttacgggtatcggtacggggaacctacggggttacaaccggttcctaagggtccacgacccgaacggacccctaaaccccg

SEQ ID NO: 415005 - DNA, 512 bp, Homo sapiens
  misc_feature: GZ8MTXP02F9AQ1.3.10.A10.1.454.CMB.2.raw
  modified_base (252)..(252): a, c, t, g, unknown or other
  modified_base (278)..(278): a, c, t, g, unknown or other
  modified_base (418)..(418): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaaagatcacctgctctggagatgcattgccaaagcaatatgctatggtacaanaaaagcagcagccctgtgtgtgatanataaaagacagtgagaggccctcagggatccctgagcgattctctggctccagctcagggacaaacagtcaacgttgaccaatcaagtggagtccaaggcagaggacgaggctgactattaattgtacaatacagcaganaaacaataaataattaatactttattagttcttcgtagtacgtcggacgacggtacgaaccgtacgtacgtacgacgaccgaacgaccgaaccc

SEQ ID NO: 415006 - DNA, 534 bp, Homo sapiens
  misc_feature: GZ8MTXP02HCN45.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtacaacaaagccaggccaggcccctgtggtggtgatataataaagacagtgagacggccctcgaggggactcccgtgagcgattctcgtggctccagctacgagggacaacgagtcacgttgaccatcagtgagtccaggcagaggacgagctagactattatgtacaatcagacaagacaacagtaatacttatactttagtcgttacgttcggattcgtagggaccgtaggggtaccaccgttccgtaaggtccacggacccaaggcccccaacccgtacgtacccg

SEQ ID NO: 415007 - DNA, 585 bp, Homo sapiens
  misc_feature: GZ8MTXP02JLVQA.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctggtgtcagtgtccccaggacagacggccaagatcacctgctctggagatgcattgaccaaagcaatatgcttattggtaccaaacaaaagccaggcccaggcccctggtggtggtgatataataaagacagtgagaggccctgagggactcctgagcgtattcctgtggctccgagctcgagggaccaaacgacgtacacgttacgaccctatacaggtggacgtcccgaagggcagggacggaacgaggctaggtaacttagtttagttgtaccaaattccgaagcaagacaaacgtaagttaacttaacttattactttatagtttacgttacggtattacgttacggggaaccctaggggtccaacccgttccgtaacggtaccgacgacccgaaacggaccctaaaccccg

SEQ ID NO: 415008 - DNA, 730 bp, Homo sapiens
  misc_feature: GZ8MTXP02GZXSI.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgcttattggtaaccaaacaaagccaggccaggcccctggtggtgtgatataataaagacagtgagacggccctgagggactcccgtgacgcgtattctccgtggcctccgagcctacgaacgggaccaaacgtacggtaccgtacgttacgacccaagttaccgaagggtcggaaccggttacccgaaggggacccgaaaggggaacggggaacccgggtaaggggtccctagggtaaacctttaagtttaagtttcggtaactaaacgttacgaaacggtaccgaaacggaaaccctaaaagtaaaacggtttaaaacttaacttttaaactttaccttttaagttacgtttaccgtttacgggtaactttccggggttacgggggtaacccggttaacggggtaccccgtaaccccggtttaccggtaacggttacccgaaacccggtaaccccgtaaacccggaccccctaaaccccgtacgtttacccg

SEQ ID NO: 415009 - DNA, 533 bp, Homo sapiens
  misc_feature: GZ8MTXP02FM1SL.3.10.A10.1.454.CMB.2.raw
  modified_base (424)..(424): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaagccaggccaggcccctgtggtggtgatatataaagacagtgagaggccctgagggactcccgtgacgcgattctcctggctccagctcagggacaacagtcacgttgaccatcagtggagtccaggcaggaggcgaggctagactattattgacaatcagacagaacaanaagtaattacttatactttatgttacttggattcgtgggacctaggggttcctaccggttcctaacggtccaacggcccctaaacggaccccaaacccccacgttaccg

SEQ ID NO: 415010 - DNA, 609 bp, Homo sapiens
  misc_feature: GZ8MTXP02G0VLU.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagcccaccctcggtgtcagtcgtccccaggacagacggccaagatcacctgctctggagatgcattgaccaaagcaatattgacttattggtaaccaaacaaagccaggccacggcccctgtggtggtgatataataaagacagtagagacggccctacgagggactcccgtggacgtcgactttctccgtcggtcctccgagctacgaagggaccaaacgagtaccgtacgttacgaaccatacgaggtaggacgtccgaggcgaggaggacgaggctagtactattatgtacaatcgagcaaagtaacaaacaagttaaacttactttaattactttatcgtttacgttacggattccggttacgggaaccgttacggggtacctaccgggttacctaacgggtacccaaccggtacccgaaacggtacccccaaaaccccgtctaccg

SEQ ID NO: 415011 - DNA, 518 bp, Homo sapiens
  misc_feature: GZ8MTXP02G3WH4.3.10.A10.1.454.CMB.2.raw
  modified_base (219)..(219): a, c, t, g, unknown or other
  modified_base (308)..(308): a, c, t, g, unknown or other
  modified_base (433)..(433): a, c, t, g, unknown or other
  modified_base (470)..(470): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctgganatgcattgaccaaagcaatatgcttatggtaccaacaaagccaggccagcccctgtggtggtgatatataaagacagtgagaggccctnagggactcccgtgacgcgtacttctcgtggctccagctcgagggacaacagtcacgttgaccatcgagtggacgtccaggcacggagacggaggctggaactattagttgtcaaatcgagacaanaacaagtaaatattatattacttagtattcgtacgtntcgcgaccgtgtaccgcgtacgtacgacacgtaccacgacccaacccg

SEQ ID NO: 415012 - DNA, 668 bp, Homo sapiens
  misc_feature: GZ8MTXP02GM89R.3.10.A10.1.454.CMB.2.raw
  modified_base (219)..(219): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctgganatgcattgaccaaagcaatatgcttatggtaaccaaacaaaagccaggccacggcccctggtggtggtgatataataaagacagtgagacgccctgagggactcccgtagacgcgtacttttcgtggtctccagcctacgaggggaaccaaacagtacacgttacgaacctatcgagttcggacgtacccgaggccgaaaggagggaacggaggtacctaggaactttaagtttacgttaggtacctaaagtcgaaggacaaacggaaaccaaacgtaaagttaaaacttaacctttaatttacttttaaacgtcgtttaccgtttacggtaacttccggttaacgggggacccgtaacgggggtaccctaaccccggggttaaccgttaacgggggtaccaacccgggaccccgaaaaccgggtacccccaaaaccccccgttaacgg

SEQ ID NO: 415013 - DNA, 563 bp, Homo sapiens
  misc_feature: GZ8MTXP02IG943.3.10.A10.1.454.CMB.2.raw
  modified_base (219)..(219): a, c, t, g, unknown or other
  modified_base (377)..(377): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctgganatgcattgaccaaagcaatatgcttattggtaaccaaacaaaagccaggccaggcccctgtggtgtgatatataaagcagtgagaggccctgagggctcccgtgacgcgtacttcctcgtcggcttccgagcctcgacgggaacacgacgtcacgttnacccatcgaagtgacgtcgagcaggaggacgagggctagacttagttatagtacatccagacaagaacaagagttaaacttacttaactatttacgtagttccgttaacgtacttcgtacggggaccttaacggggtccaaccgttacgtaacggtccgaacgacccgtaacgggtcttcccccgg

SEQ ID NO: 415014 - DNA, 502 bp, Homo sapiens
  misc_feature: GZ8MTXP02GWIFL.3.10.A10.1.454.CMB.2.raw
  modified_base (406)..(406): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgttagtgtccccaggaccagacggccaagatcacctgctctggagatgcattgaccaaagcaatatgcttatggtacaacaaagcagcaggccctgtggtgtgatatataagacagtgagaggcctcgaggatccctgagcgatctctcggctccagctcagggacacagtcacgttgaccatcagtagagtcccgaggcaggacggacgaggctgactattatatcgaatcagnagacaacagtaatactatcttatgtcttcgatctgggacctaggtcctaccgtcgtacgtcgacgaccgaacggacccaacccgtactacgtaccc

SEQ ID NO: 415015 - DNA, 533 bp, Homo sapiens
  misc_feature: GZ8MTXP02I47A1.3.10.A10.1.454.CMB.2.raw
  modified_base (438)..(438): a, c, t, g, unknown or other
  modified_base (450)..(450): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagcccaccctcggtgtcagtcgtccccaggacagacggccaagatcacctgctctggagatgcattgaccaaagcaatatgcttattggtaaccaacaaaagccaggccacggcccctggtggtggtgatataataaagacagtagagacggccctagagggactcccgtgagcgattctctcggctccagctcgagggacaacgagtcacgttgaccatcagtggagtccgaggcaggaggacgaggtctgactattatgtacaatcagcaagaacaanagttaataattnttacttatgttctgtatcgtagggacctcggggtacctaccggtcgtaagtccgacgtaccccaggaccccaaccctataccg

SEQ ID NO: 415016 - DNA, 702 bp, Homo sapiens
  misc_feature: GZ8MTXP02G9XKV.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaccaacaaaagccaggccaggccccctgtcggtggtgatatataaagacagtgagaggccctgagggatccctgagcgattctcctggccctacgacgtctacggaacggaccaaacgtacgtaccgtacgttaccgaacctacgtaacgtagggttaggacccgtacgaacgggaccgaaaggggaacgggaaccggtaacggtacgtaaccggtaactttaagtttaaagttcggttaaactaacgttacgaacgtacggaaaacgaaacctaaaagtaaacggtttaaaactttaaactttaacctttaattttaacgttacgtttacccggttaggttaaccgttacgggttaccgggtaaacgggtaccggtacccgttacccgttacggtaacggtaccgaacccggtaacccgggaaccgtaacccccaaaccccgtacggttaacccg

SEQ ID NO: 415017 - DNA, 508 bp, Homo sapiens
  misc_feature: GZ8MTXP02JMA78.3.10.A10.1.454.CMB.2.raw
  modified_base (329)..(329): a, c, t, g, unknown or other
  modified_base (433)..(433): a, c, t, g, unknown or other
  modified_base (450)..(450): a, c, t, g, unknown or other
  modified_base (460)..(460): a, c, t, g, unknown or other
  modified_base (503)..(503): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaccaaacaaagccaggccaggcccctgtggtggtgatatataaagacagtgagaggccctgagggactcccgtgagcgattcncctggcctcagctacgagggacaacgagtcacgttgacctatcgagtggacgtccgaggcaggaggacgaggctgacttattatgtacaatcaagcaagacaanagtaatcttatctttangtctgatcgnggacagggtcaccgtcgaaggtcacgtcccaagtccccaaccntaccg

SEQ ID NO: 415018 - DNA, 724 bp, Homo sapiens
  misc_feature: GZ8MTXP02IXFYO.3.10.A10.1.454.CMB.2.raw
  modified_base (216)..(216): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctgganatgctattgaccaaagctaatatgtactttagtaggtaaccaaacaaaagccgacggccacggcccctgtggtggtagatataataaagacagtgagacggccctacgagggactcccgtaggacgcgattccgtcgtggcctccgagctacgagggacaacgtagtaccgacgttacgaacctagtcgaaggttcggacgtccgaaggggaccaagggacgggaaccggaaggtccgttaagggtaactttaagtttacgtttacggtaacctaaaagttcccgaaagtaccgaaagtaaaccaaaacgttaaggtaaactttaactttaagttacctttttaaagtcgtttaccggttacggtacttacccgggttaacggggaaccccggttaacggggtttaccccgtaacccggtttaccccggttaagggttaacccgtaaaccccgggtacccccgtaaaaccggggacccccccttaaaaacccccgcgttttacccggg

SEQ ID NO: 415019 - DNA, 722 bp, Homo sapiens
  misc_feature: GZ8MTXP02GBOPU.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttcctccccctcctcactctctgcacagactctgaggcctcctatgagctgacacacgcccacccgtcggtgtcagtcgtccccgaggacaggaccggccaagactccacctgctcgtggagatgactattcgaccaaagcaattatgtactttaagttacggtaaacccaaacgaaaacgccgaacgggacccgaacggtcccccgttgggtagggtaggtagtaaattaagtaaagtaaaaggaacgtaaggtaggaacggtaccgggtacccccgttacggaacggggtaccttaccccgtaggaacggtaccggtactttccgtccgtacggtaccttaccgacgtaccgttaccgggaaacggggaaacctaaaccgtacgtaccgtacgttacgaccctagtacgtaggtacgacgtacgaggacgaggacggacggagactagtaactttagttacgttacgacaacgtacgaagaccaagaacctaaagtaaattaacttaactttattactttagtcgttacgttacggtacgtacgtacgggtaaccgtcggtaccgtaaccgtaccgttacggaccgaccgacccgaacggacccctaaacccg

SEQ ID NO: 415020 - DNA, 519 bp, Homo sapiens
  misc_feature: GZ8MTXP02J1G4M.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaaccaacaaaagccaggccaggcccctgtggtggtgatatataaagacagtgagacggccctgagggactcccgtgacgcgattctcctggctcagctcgagggacaacagtcacgttgaccatcagtgagtccaggcagaggacgaggctgactattattgtcaatcagcaagacaagagtaaatactattctttaatcgttcttacggattcgacgggtaccagggtccaaccgtccgtaaggtcacgcccaacggacccaacccctatccg

SEQ ID NO: 415021 - DNA, 517 bp, Homo sapiens
  misc_feature: GZ8MTXP02HBYW2.3.10.A10.1.454.CMB.2.raw
  modified_base (431)..(431): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgacttattaggtaaccaaacaaaagccaggcccacggcccctggtggtggtgatatataaagacagtgagaggccctgagggctccgtgacgcgactttctctggctcagctcgagggacacgagtcagttgaccatcgagtgactcgagcaggaggacgagctgactattatgtacatcagacagacaanagtatattatctttatgttcgtacgtatcgacggtactaggggtccaaccgtcgtaacggtcacgaccccaacggccctaaacccg

SEQ ID NO: 415022 - DNA, 728 bp, Homo sapiens
  misc_feature: GZ8MTXP02IO9HQ.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgtacttagttacggtaaccaaacgaaaacgccgaacggccgacggtccccctggtgggtggtagaataataataaagacgaagtgaaggacggccctacgagggtactcccgtaggacgtcgtattcctccgtcggtcctaccagtcctacgaacgggaccaaacgtagtaccgtacgttacgaaccctagtaccgaagggttacggaacgttacccgaaggggaccgaagggacgggaacggagggtaccttagtaaaccgttatttaagttcgttaaccaaagtttccgaacgtacgaaacgaaactaaaccgtaaagtttaaacttaacttttaactttaccgtttttaagttacggtttaccggtttacgggacgtttccggtaaccgggggtaaccggtacgggttacccgtacccggttacccgttaacggtacccgtaaccggaccccgtaacggaccccctaaacccggttaccttaacccgg

SEQ ID NO: 415023 - DNA, 581 bp, Homo sapiens
  misc_feature: GZ8MTXP02JLF2F.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaccaaacaaaagccaggccaggcccctgtggtggtgatataataaagacagtgagaggccctgagggactcccgtgagcgattctccgtggcctccagtctacgagggacaacgagtctaccgttgacctatcagtggacgtccgaggcaaggagacgaggctagacttattaagttgtacaatcgaagcaagacaacgtaattaactactttaattcttttaatcgtttacgttacggtattaccggttaggggaaccgtacgggggttaccaacccggtttacaacgggttcgaacggacccgaaaccggaccccaaaaccccggtctacccg

SEQ ID NO: 415024 - DNA, 510 bp, Homo sapiens
  misc_feature: GZ8MTXP02IILKL.3.10.A10.1.454.CMB.2.raw
  modified_base (308)..(308): a, c, t, g, unknown or other
  modified_base (313)..(313): a, c, t, g, unknown or other
  modified_base (360)..(360): a, c, t, g, unknown or other
  modified_base (406)..(406): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacgaccaagatcacctgctctggagatgcattgaccaaagcaatatgcttattggtaaccaacaaaagccaggccaggcccctggtggtggtgatatataaagacagtgagagccctnagggntcctgagcgattctctggctccagctcgacgggcaacagtcacgttnaccatcagtgatcagcagaggacgagctgactattattgtacaatnagcaagacaaacaagtaatacttattctttatagttctacggtatcgttgggacctagggtccaccgtcgtaacgtcacgacccgaacggcccaaccctatccg

SEQ ID NO: 415025 - DNA, 498 bp, Homo sapiens
  misc_feature: GZ8MTXP02G86U8.3.10.A10.1.454.CMB.2.raw
  modified_base (328)..(328): a, c, t, g, unknown or other
tcagagacgcactccacgaccggtgctcgatttagcgtcgatctcaggggctgtgggtccaggaggcagaactctgggtgtctcaccatggactggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctgagggatccctgagcgattcnctggctccagctcgagggacaacagtcacgttgaccatcagtgagtcagcagagacgagctgactattatgtcaatcagcagacaacgagtaaatacttatctttatgttacttcggatcgtagggacctagggtcaacgtctaggtcagacccaacggcccaaaccccg

SEQ ID NO: 415026 - DNA, 528 bp, Homo sapiens
  misc_feature: GZ8MTXP02ICE01.3.10.A10.1.454.CMB.2.raw
  modified_base (454)..(454): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaaccaacaaaagccaggccaggcccctgtggtggtgatataataaagacagtgagaggccctgagggactcccgtgagcgacttctctggctccgagctcgagggacaaacagtcacgttgacccatcagtggactcgagcaggaggacgtaggctgacttattatgtacaatcagcaagacaacagtaatacttatctttagtnttacgttcgtactcgtacgggacctagggtacctaaccggtctaacggtcgacgtcccaaaggccccaaacccg

SEQ ID NO: 415027 - DNA, 820 bp, Homo sapiens
  misc_feature: GZ8MTXP02JWARU.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaaagactcacctgctctggagatgcattgaccaaagcaaatatgtacttaattaggtaacctaaacgaaaagccaaggcccaaggccccctgtggtcggtgaatataataaagacagtgagaggccctagagggactccctgagcgtattctaccgtggcctccaggctacgacggggtacaaacgacgttccgtaccgttgaaccctattacccgaaggttacgggaaccgttacccgaagggacccgaaagggaaagggaacccggaaagggtcccgtaggtaaaacccgtttaagttttaaacgtttacggttaaacccaaaagtttaccgtaaacggtacccgtaaaagggaaaacccttaaaaacccggggtaaagtttaaaaacgttttaaaccccgttttaaatttttaacccgtttttaaagttaacgggttttacccgttttaaccgggggtaaacgtttacccgggtttaacgggggaaacccccggtttaacgggggttaaccccgttaacccccggggtttaaccgttaaccgggggttaaccccgaaaccgggttaccccccaaaacgggggttacccccccaaaaaccccgttcccggtttaaaccccgg

SEQ ID NO: 415028 - DNA, 505 bp, Homo sapiens
  misc_feature: GZ8MTXP02IOYWL.3.10.A10.1.454.CMB.2.raw
  modified_base (402)..(402): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaaccaacaaaagccaggccaggcccctggtcggtggtgatataataaagacagtgagacggccctgaggggactccgtgagcgtattctctggctcagctcgagggacaacagtcacgttagaccatcagtggacgtcaggcagaggacgagcngactattatgacaatcaagcagacacaagtatactatctttatgttactcgtaatcgtggacctaggtccaacgtctaggtccacgacctaacggccaaaccc

SEQ ID NO: 415029 - DNA, 623 bp, Homo sapiens
  misc_feature: GZ8MTXP02H4P8N.3.10.A10.1.454.CMB.2.raw
  modified_base (251)..(251): a, c, t, g, unknown or other
  modified_base (377)..(377): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctgagatgcattgaccaaagcaatatgcttatgacaaanaaagccaggccagccctgtggtgtgatataataaagcagtgagacggccctgagggatcccgtgagcgtacttcgtctcggctccagccctgaacggggaacaaacgtagttaccgaaccggtttnaaacccaaagttccgaaggttacgggacgtacccgaggggacctaaagggaacggtaacgaagggtccttaagaactttatttagttagttacaaataacgagacgaacgaacaaactaaacgtaaacttaactttaacttactttacgttacgttacgttacgtacgttacggtacggtacggtacggtaccgtaacccgtaccgtaacggtaccgtaccgacccgaacccgaacccgtaacccg

SEQ ID NO: 415030 - DNA, 517 bp, Homo sapiens
  misc_feature: GZ8MTXP02JX6X1.3.10.A10.1.454.CMB.2.raw
  modified_base (424)..(424): a, c, t, g, unknown or other
  modified_base (439)..(439): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttatggtaaccaaacaaaagccaggccaggcccctggtggtggtgatatataaagacagtgagacggccctgagggactccccgtgacgcgtacttctcgtggcctccagctcgagggaacaacagtcacgtagaccatcagtgagtccgagcgaggaggacgaggctagacttattatgtanaatcagacagacaanagtaatacttatctttatgttctcggatcgtacggacctagggtcaaccgtcgtaggtcacgccaacgccccaacccg

SEQ ID NO: 415031 - DNA, 622 bp, Homo sapiens
  misc_feature: GZ8MTXP02FJYJR.3.10.A10.1.454.CMB.2.raw
  modified_base (261)..(261): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgacttagttaggtaaccaaanaaaacgccaaggccacggcccctggtggtggtgatataataaagacagtagaggaggccctagagggactcccgtagacgcgtacttctcgtggcctccgagctacgaggggaacaaacgtacgtacacgttcgacctatcgagtggaacgtccgaggcacggaggacgaggtacagtaacttagttattgtactaatcgagaccaagacctaaagagttaaactactttaacttacgtttaattagttccttacgggaacttccgggtacggggtaaccgtaacggggttaccctaacccggttaccggtaacggttacccgaacggtacccccggaaaacggacccctaaaacccccgg

SEQ ID NO: 415032 - DNA, 709 bp, Homo sapiens
  misc_feature: GZ8MTXP02JBK1T.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaattatgtacttagttacggtaaccaaacgaaaagccaaggaccacgggccccctggtacggtggtgaatataataaagacagtgacggaggcccctagaaggggactcccgtagacgcgtattcctccgtcggccttaccgacgtaccgtacgaacggggtaccaaacgtacggtaccgtacgtttacgaaccctagtcgaaggttcggggaactaccggagggaccaaggggaacgggaccggaggtaccgtagtaacttaagtttacgttagtactaaacttacgagacgtaacgaaacaaacgttaagttaaactttaacttttaattacttttaacgtacggttttaccgttacgggtaagttacccggtttaacggggacccgttacgggggtacccctaccggggttacccgtaacgggttacccgaacggaccccggaaccggtacccccgaaccctaaccggttcccg

SEQ ID NO: 415033 - DNA, 521 bp, Homo sapiens
  misc_feature: GZ8MTXP02ICDB9.3.10.A10.1.454.CMB.2.raw
  modified_base (304)..(304): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttatggtaccaacaaaagccaggccaggcccctgtggtggtgatatataaagacagtgagagcctnagggactccgtgacgcgtattctcctggctccagctcgagggcaacagtcagttgacatcagtggatccaggcagaggacgaggctagactattattgactaaatcagcagacaaagtagtaatacttattctttatgttctaggattcgttcgggaacctaggggtcctaaccgttcgtaaggtcacgacccgaaacggccccaaccctacgtccg

SEQ ID NO: 415034 - DNA, 628 bp, Homo sapiens
  misc_feature: GZ8MTXP02IS03B.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctggtgtcagtgtccccaggacagacggccaagatcacctgctctggagatgcattgaccaaagcaatatgacttatggtaaccaacaaaagccagccagccctgtggtgtgataataataaagacaagtgaagacggcccctacgaaggggactcccgtaggaacgcgtaatttcctccgtcgggcctaccaggctacgaagggacaaacgagtaccacgttacgaacctatcgaagtcggaagtacccgaagggccaaggggaaacgggaccggtaaggccttaggaaacttaagttttagtagtaccaaattcgaaggacaaagaaccaaataagttaaataactttattactttagtcgttacttcgggaactttcgacgggtaaccctagggtcccgtaaccgtaccgttaagggccaacgggaccccaaacgggcccccaaaacccctcgttaaccg

SEQ ID NO: 415035 - DNA, 617 bp, Homo sapiens
  misc_feature: GZ8MTXP02I2W59.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattcgaccaaagcaatatgcttattggtaaccaaacaaaagccaggcccacggcccctgtcggtggtgatataataaagacagtgagaggccctgagggactcccgtgagcgacttctcgtggccttccagctcgaggggaaccaaacacgtcacgtttacgaccctaatccgaggttggaacgtccaagggcaagggaggacggtaggctagtacttaatttattcgtactatcgagacaagacaaagtaagtaattaacttattactttaagtcgttacgtttcggaacttcggtacggggtaaccgtacggggttacctaacccggttcccgttaacggggtacccgaaaccggaaccccgtaaaaccgggtaaaccccctaaaacccccg

SEQ ID NO: 415036 - DNA, 632 bp, Homo sapiens
  misc_feature: GZ8MTXP02GUM2T.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgcttattaggaaccaaacaaaagccaaggcccaacggccccgtaggtggtaggtagataataaagtaaaagacaaggtgaagacggccctgagggactcccgtgacgctattctcgtcggctcgagctcgagggaacaacgagtcctaacgttcgaaccctagtaccgaggttggacgtccgaagggaccgaaggagggacgagggtactacggtaacttaatttagttcggttaacaataccgagacgtaaacggaaactaaaacctaagttaaacttacgtttaattacttttaaagcgttttacgtacggtattccggtacgggaacccgtaggtcctaacccgtcggtacgttaccgaacgtaccccgaaacgaccccctaaaccccg

SEQ ID NO: 415037 - DNA, 696 bp, Homo sapiens
  misc_feature: GZ8MTXP02F22IH.3.10.A10.1.454.CMB.2.raw
  modified_base (253)..(253): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaccaaanaaacgccaggccacggcccctggtggtggtgatataataaagacagtgagacgccctagagggactcccgtgagcgtattctcgtggcctcgagctacgaagggaccaacgacgtcacgttcgaacctagtcgaggtggactacccgagggacaagggaagggaccggaagggccttaggaaccttagtttaagttacgtacaaaagttccaaagaccgaaagaaaccctaaagtaaacggtttaaaacttaaccttttaattaacctttttagtacggttttaccgtttacgggtaaacgtttccgggtaaccgggggtaaccggttaaccgggggttaccctaacccccgggtttaccggtttaaacgggtaccccgtaacccgggtaaaccccccggaaaacgggaccccccctaaaaacccccgtcgtttaaccccggg

SEQ ID NO: 415038 - DNA, 750 bp, Homo sapiens
  misc_feature: GZ8MTXP02JMLK3.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttatgtaccaacaaagccaggccagcccctgtggtggtgatatataaagacagtgagacggccctcgagggactcccgtagacgcgtattccgtcgtcggcctccaagtctcgaacgggggacaaaccgtaggtcaacggtttcgaacccaaagtcccgtaaaggtgggaaacgtcccgaaaggggaccaaggggtaacggggaaccggaaggggacccttagggtaaaaccgttaagtttttaaatttcgggtttaaccctaaaatttacccgaaagggtacccaaaagggtaaaacccaaaaacctaaagggtttaaaaactttaacctttttaaaagtttacccgtttttttaaaacttggttttaccgttttacccgggggtaattttaccggtttacggggggaaaccccctaaggggggtttacccaaaccccgggttccccgttaaagggggttacccaaccggttacccccggaaaaccgggtaccccctaaaaccccccgg

SEQ ID NO: 415039 - DNA, 510 bp, Homo sapiens
  misc_feature: GZ8MTXP02I6XCJ.3.10.A10.1.454.CMB.2.raw
  modified_base (248)..(248): a, c, t, g, unknown or other
  modified_base (336)..(336): a, c, t, g, unknown or other
  modified_base (395)..(395): a, c, t, g, unknown or other
  modified_base (400)..(400): a, c, t, g, unknown or other
  modified_base (403)..(403): a, c, t, g, unknown or other
tcagagacgcactccacgaccggtgctcgatttagcgtcgatctcagggggtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgccaaagcaatatgcttatggtacaanaaagccaggccaggcccctgtggtggtgatatataaagacagtgagaggccctgagggatccctgagcgattctcctggcctcagctnagggcaacagtcacgttgaccatcagtgagtccagcagaggcgaggctgactattatgnaagtnagnaagacaacagtaatactattacttatgtcgttacgatccgtaggacctacgggtacaaccgtccgtaaggtaccacggacccaaacggcccaaaacccccgtctacg

SEQ ID NO: 415040 - DNA, 247 bp, Homo sapiens
  misc_feature: GZ8MTXP02GFKE8.3.10.A10.1.454.CMB.2.raw
  modified_base (245)..(247): a, c, t, g, unknown or other
tcagagacgcactccacgaccggtgctcgatttagcgtcgatctcagggtcttcgtggctcacgtccaccaccacgcatgtgacctcaggggtccgggagatcatgagggtgtccgttgggttttgggggaagaggaagactgacggtcccccaggagttcaggtgctgggcacagcggccctgggctgcctggtcaaggactacttccgagtgcgtctctgagcgggctggcaaggcgcatagnnn

SEQ ID NO: 415041 - DNA, 696 bp, Homo sapiens
  misc_feature: GZ8MTXP02G0RPM.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggactcctatgagctgacacagccaccctcggtgtcagtcgtccccaggacaggacggccaaagatcacctgctcgtggagatgcattcgaccaaagcaatatgtcttatcggtaaaccaaacaaaacgccaaggccacggcccctggtggtaggtgaataataataaaagacaaggtagaagacggccctacggagggtactcccgtaggacgcgtacgtttcctcgtgggcctccgaagtccgtacgaacggggtacaaaacgtacgtaccgaacgtttcgaaaccctagtaccgaagggttcgggaaccgtacgaagggacgaagggaaacgggaaccgaggcgttaggtaaacctttaatttaacgtttacgtaaccgaaattccgaaggacccaaagaaaccgtaaaactagttaaacttaactttattccgtttaattcgttactttacgggatttaccggtacggggtaaacccgtaggggttacctaaccccggttccggtaacggtacccgacggaaccccctaaacgggaccccaaaacccccgg

SEQ ID NO: 415042 - DNA, 571 bp, Homo sapiens
  misc_feature: GZ8MTXP02IEJRH.3.10.A10.1.454.CMB.2.raw
  modified_base (318)..(318): a, c, t, g, unknown or other
  modified_base (329)..(329): a, c, t, g, unknown or other
  modified_base (335)..(335): a, c, t, g, unknown or other
  modified_base (338)..(338): a, c, t, g, unknown or other
  modified_base (341)..(341): a, c, t, g, unknown or other
  modified_base (352)..(352): a, c, t, g, unknown or other
  modified_base (409)..(409): a, c, t, g, unknown or other
  modified_base (448)..(448): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaaccaaacaaaagccaggccaggcccctgtggtggtgatatataaagacagtgagacgcctgagggatcccgngagcgattccngtcgcncgntcncgaagcaacgntacgtacgttacgactatacgagtaggaccgtacgaggacgagaacgggacggacgngtaacgattaattagttagtaacaatcaagacgaaacanaaaacgtaattaaacttaacttaatttcttaagtccgtttagtacgtacgttcggaacggtaccggtacggtacctaccgtacgtaacgtacaccggtaccgaccgacccaacctacgtaccg

SEQ ID NO: 415043 - DNA, 530 bp, Homo sapiens
  misc_feature: GZ8MTXP02F5UZO.3.10.A10.1.454.CMB.2.raw
tcagagacgcactccacgaccggtgctcgatttagcgtcgatctcaggggctgtgggtccaggaggcagaactctgggtgtctcaccatggcctggatccctctacttctcccctcctcactctctgcacagactctgaggcctcctatgagctgacacagcccaccctcggtgtcagtgtccccaggacagacggccaagatcacctgctctggagatgcattgccaaagcaatatgcttattggtaccaacaaaagccaggccaggcccctgtggtggtgatataataaagacagtgagaggccctcagggactccctgagcgacttctcgtggctccagctcgagggacacagtcacgttgaccatcagtggagtccgaggcaggaggacgaggctgacttattattgtacaatacagcaagacaaactagtaataacttatactttaatgttacttacggattcgtacgggtaccaggggtccaaccggttcctaggtaccacgacccaacggacccaaacccccg

SEQ ID NO: 415044 - DNA, 581 bp, Homo sapiens
  misc_feature: GZ8MTXP02G37NM.3.10.A10.1.454.CMB.2.raw
  modified_base (215)..(215): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgttagtgtccccaggacagacggccaagatcacctgctctgganatgctattgaccaaagcaatatgtcttagttaggtaaccaaacaaaagccaggccacggcccctgtggtgtgatatataaagacagtgagacggcctacgagggactccctaggacgcgtattctcgtcggcctccagctcgacggacacagtacacgttcgaccagacaggtaggacgtaccgagcgaggaggacggacggcgtagtacttattagttagtactaatcagacagaacaactaagttaactaactttattctttatcgttcgttacgactttcgtacgggtaaccggtacggttccgaacccgttcgtaacgtaacgaccgaccgaccggaccctaaccccgacttacggtaaccc

SEQ ID NO: 415045 - DNA, 583 bp, Homo sapiens
  misc_feature: GZ8MTXP02HVR8O.3.10.A10.1.454.CMB.2.raw
  modified_base (254)..(254): a, c, t, g, unknown or other
  modified_base (336)..(336): a, c, t, g, unknown or other
  modified_base (508)..(508): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctggtgtcagtcgtcccaggacagacggccaagatcacctgctctggagatgcattcgaccaaagcaatatgtcttatggtaaccaaanaaagccaggccaggcccctgtggtggtagatataagtaaagacagtagagaggcctagaggactccgtgacgcgtatctcgngctcagctacgagggacacgagtctacgttacgaccattcgagtggaacgtccgagggacaagggacggacggaggtactaggtaacttagtttacgttggtaactaagttcagtacaagacaaacgtagttaaacttactttattacttttagtacgtttcgtttacggtnttaccggtacgggttacacgggttcctaccgtcgtaacggtacacgtacccgaaacgaccccaacctacgttccg

SEQ ID NO: 415046 - DNA, 623 bp, Homo sapiens
  misc_feature: GZ8MTXP02JR61E.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgcttatggtacaacaaagcaggccaggccctgtgtggtgatatataaagacagtgagaggccctgagggactcccgtagacgcacttctctcggctccgaggctcgaaggggacaacgtagtcctacggtttacgaccctaattccgaaaggttcgggtaagtacccgagggaccgaggaaggggacgtaacgggcgttacgtaatatttaggtacgtactaaatcgaacgaacgaaacgaaactaaactaaagttaaacttaactttaattaacttttacgttcgttaccgttacggtacgttacggttaccgggtaaccgtacgggtaccctaaccggttaccgtacggtaccgaccgacccgtaaccggacccctaaccg

SEQ ID NO: 415047 - DNA, 681 bp, Homo sapiens
  misc_feature: GZ8MTXP02JE959.3.10.A10.1.454.CMB.2.raw
  modified_base (255)..(255): a, c, t, g, unknown or other
  modified_base (328)..(328): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgtcttattggtaaccaaanaaacgccaggccacggcccctggtggtggtagattataataaagacagtgagacggccctagagggactcccngacgcgtattctcgtcgcctcgagtctacgaagggacaacgtagtacctacgttacgaacctagtacgaggtacggaacggtaccgaagggaccaaggggacggacgagggctaaggtactttaagttaacgttgtaactaagtaccaggactaaacggaacctaaaaccggttaaattaaaactttacttttaaacgtttacgttttaatacggtttaccgtttacgggacttaccggggttacgggggtaaacccttacgggggtaaccctacccggtttaccgtaacgggtaaccgaaccgggtacccccggtaaccggaaccccctaaacccccggtactttaacccgg

SEQ ID NO: 415048 - DNA, 603 bp, Homo sapiens
  misc_feature: GZ8MTXP02FVN4I.3.10.A10.1.454.CMB.2.raw
  modified_base (219)..(219): a, c, t, g, unknown or other
  modified_base (466)..(466): a, c, t, g, unknown or other
  modified_base (474)..(474): a, c, t, g, unknown or other
  modified_base (478)..(478): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctgganatgcattgaccaaagcaatatgtcttatggtaaccaaacaaaagccaacggcccaggcccctggtaggtggtagatataataaagcaggtagaggacggccctgacgggactcccgtggaacgcgtacttccgtcgtggctccgacgttcgccgaggggaaccaacgagtcctacgtttacgacccaattccgaggttggacgacccgaggcaacggtaggaacgaggactggaacttattaagttnacctaaancganacaagaactaataagttaacttactttacttacgtttacgtcgttacgtcgtacgtacggtacggtaaccgtacggtaccgtaacccggttacgtacgtacgacgaccgaaaccgaccctaaccg

SEQ ID NO: 415049 - DNA, 553 bp, Homo sapiens
  misc_feature: GZ8MTXP02JAW73.3.10.A10.1.454.CMB.2.raw
  modified_base (252)..(252): a, c, t, g, unknown or other
  modified_base (286)..(286): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgacaaagcaatatgcttattggtaaccaanaaaagccaggccaggcccctgtggtgtgatatanaaagcagtagagacggccctgagggctccctggagcgtattctccgtgcctccagctacgagggacaacgagtccacgttcgaccatcaggtggacgtccaggcagaggacgagctagactagttattgacaagtcagcaagaacaacgtataatacttattcttagtacgttcttcggaattcgttaggggaacctaggggttccctaacccggttcgtaaggtaccacggaccccgtaaacggacccctaaccccgaatttcccg

SEQ ID NO: 415050 - DNA, 666 bp, Homo sapiens
  misc_feature: GZ8MTXP02JHMDZ.3.10.A10.1.454.CMB.2.raw
  modified_base (655)..(655): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatccacctgctcgtggagatgactattcgaccaaagctaaatatgtactttaagttacggtaaacccaaacaaaacgccgaacggccaacgggtcccctggtggtaggtagaattaagtaagtaaagggacggtagaaggacggccctagagggtactcccgtaggacgcgtattcgtctcggcctccgagctacgaacgggacacgacgtacgtacggttacgaaccctagtacggaagtgggaaccgtaccgagggacaagggacgggacgacggactaggtaacttattacgtttacggactaaatcgaacgtacaaacgaaacctaaagtaagttaaactttaactttacttacttttaagtcgtttacgttaccggtagttcgggttacggacgtacgggtaccctaccgttcgtaacggcaaccgaccgaaccggaccctaaccccggnttacgtacccg

SEQ ID NO: 415051 - DNA, 599 bp, Homo sapiens
  misc_feature: GZ8MTXP02IMIK8.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttcctccccctcctcactctctgcacagactctgaggcctcctatgagctgacacagccaccctcggtgtcagtcgtccccaggacagacggccaagatcacctgctctggagatgcattgaccaaagcaaatatgacttattacggtaaccaaacaaaaacgccaaggcccaacggccccgtggtggtggtgtatataataaagacagtgagcgccctgagggatcccgtgacgcgtattctctgctcagctcgagggacaacgagtccacgttacgaccagtcaagtgagtccgagcaaggaggacgaggctagaacttattactgtcaaatcaagcaagaacaactaataattaacttattacttttaagtcgtttacttacggtaacgttcgttaacggggaacccgttaggggttaaccctaacccggttaccgttaacgggttacccgaacggtaacccccgaaaccggtaccccctaaacccccg

SEQ ID NO: 415052 - DNA, 572 bp, Homo sapiens
  misc_feature: GZ8MTXP02HL6KV.3.10.A10.1.454.CMB.2.raw
  modified_base (250)..(250): a, c, t, g, unknown or other
  modified_base (264)..(264): a, c, t, g, unknown or other
  modified_base (331)..(331): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgctattgaccaaagcaatatgcttatgtacaanaaagcagcagcccngtggtgtgatatataaagacagtgagaggcctcgagggactcccgtgacgcgtattctcctggctcngctcgagggaccaaacgagtacacgttacgacatcgagtggacgtaccgaggcgaaggaggacggaggctaggacttattaagttgtacaattacaggacaagaacaaacgtaagtaaacttactttaattacttttaatcgtttacttacgggtattacggtacgggtacccgtacgggttaccctaccggttccgtaacggtacacgacccgaaacggccccaaaccccgtacttaccg

SEQ ID NO: 415053 - DNA, 640 bp, Homo sapiens
  misc_feature: GZ8MTXP02J28G9.3.10.A10.1.454.CMB.2.raw
  modified_base (215)..(215): a, c, t, g, unknown or other
  modified_base (325)..(325): a, c, t, g, unknown or other
  modified_base (331)..(331): a, c, t, g, unknown or other
  modified_base (499)..(499): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctggtgtcagtcgtccccaggacagacggccaagatcacctgctctgganatgcattgaccaaagcaatatgtacttaattggtaaccaaacgaaaacgccaaggccgacggtcccctggtggtggtagataataataaagcagtgagacgcctgagggntcccgngacgcgtacttctccgtcggcctccgaacgtctaccggaaggggaccaacgtaacggtcctacgttacgaaccctagtccgaagggttcgggaacgtcccggaaggaccgaagggtacggggaccgagggcttaggtaactttattacgtttgacctaagcagacganaaccaagtaactaacttactttattactttacgtgttaccgttacgacgtcggtacggtaccggtacggtaccctaaccggtcccgttaacgggtccaaccggtaccccgaaaccggacccccaaaaccccgtacttcccg

SEQ ID NO: 415054 - DNA, 542 bp, Homo sapiens
  misc_feature: GZ8MTXP02GCMYX.3.10.A10.1.454.CMB.2.raw
  modified_base (258)..(258): a, c, t, g, unknown or other
  modified_base (338)..(338): a, c, t, g, unknown or other
  modified_base (471)..(471): a, c, t, g, unknown or other
  modified_base (538)..(538): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaaagatcacctgctctggagatgcattgaccaaagcaaatatgtcttattggtaaccaaanaaagccaaggccacggccctgtggtggtgaatataataaagacagtgagaggcccctagagggactccgtgagcgattcnctgcctcagctacgaagggacaacgtagtcaacgttcgaacctatcaggtggtaacgttcgaaggcaaggaagggcgtaggctagactatttatgacaatcagacagaacaataataaattacttatctttancgtcttagactcgtacggaaccgacggacccacgtctaaggtcaacggaccccaaggcccaaacccnctcg

SEQ ID NO: 415055 - DNA, 707 bp, Homo sapiens
  misc_feature: GZ8MTXP02GQ20N.3.10.A10.1.454.CMB.2.raw
  modified_base (219)..(219): a, c, t, g, unknown or other
  modified_base (241)..(241): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctgganatgctattcgaccaaagcaatntgcttatggtaaccaaacaaagccaggccacggtccccgtggtcggtggtagatataagtaaagacagtgagacggccctagagggactcccgtgacgcgtacttcgtcgtggcctcgagtctcggaacgggaacaaacgtgtacctaacggtttcgaacctagtccgtaaagggtcggtaacggtcccgaagggacgaacgggaacgggacggacggtcgtaggtaacctttaagttacgttcggtaactaacgtacgaacgaccgaaacggtaaccctaaacggtaagttaaaactttaacttttaacgtttaacctttttaaagttccggttttaccggtttacgggttaaacgttccgggttaccggggtaacccggttaacggggttccctaacccgggttaccgtaacggggttacctaacccggaaccccgtaaccggggaacccccttaaacccccgg

SEQ ID NO: 415056 - DNA, 561 bp, Homo sapiens
  misc_feature: GZ8MTXP02HDSMS.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaaccaaacaaagccaggccaggcccctggtggtggtgatataataaagacagtgagacggccctcgagggactcccgtgagcgacttctcgtggctcagctcgagggacaacgagtctacgtcgaaccatcgagtgacgtccgaggcaggaggacgaggctagaacttatttagtgtacaatcgaagacaagacaaacgtagtaaattactttaattactttatgttcgttacggattcgtacgggaaccgtggggtacctaaccggttaccgtacggtaccgacgaccccgaacggtacccctaaaccccg

SEQ ID NO: 415057 - DNA, 897 bp, Homo sapiens
  misc_feature: GZ8MTXP02ISR1O.3.10.A10.1.454.CMB.2.raw
  modified_base (208)..(208): a, c, t, g, unknown or other
  modified_base (223)..(223): a, c, t, g, unknown or other
tcagagacgcactccacgaccggtgctcgatttagcgtcgatctcagggggctgtgggtccaggaggcagaactctgggtgtctcaccatggcctggatccctctacttcctccccctcctcactctctgcacagactctgaggcctcctatgagctgacacacgcccaccctcggtgtcagtcgtcctcgaggacagacggccaagntcacctgctgtgganatgcagttgaccaaagctaatagtcgtactttagttacggtaaacccaaaacgaaaacggcccgaacggacccgaaccgggtccccccgttagggttcggggttagggttaagtaaagttaaagttaaaacgtaaaaacggaaccgtaagggttaaggaaacgggtacccgggtacccccgttaacggaaacgggggtacccttacccccggtaagggtaccgtaccccggttaactttccgttaccggtcgggtacccttacccgaagtccgttaccgggaaacggggtaaaccctaaaaccggtacgttaacccgaaaccggtttaccgaaaccctaaagttacccggtaagggttacgggacccgtaaaccggacgggtaccggaaagggaagggggaaacccgagggtacgttaacggttaaaccggttttaattaagttttacgggtaaaccaaagtttacccggaaataccggaaataaacccgtaaaacggtaaagtttaaacctttaatttaaacgtttttaccctttaaagtttcgttaaaccccggtttagtaaccgtttacgggtaaaccggggttaaccgttaccggggtaaccttaccccggtttacggttaccggggaacctaacccggggtaaccccctaaaaccggggtaaacccccc

SEQ ID NO: 415058 - DNA, 659 bp, Homo sapiens
  misc_feature: GZ8MTXP02H1JCF.3.10.A10.1.454.CMB.2.raw
  modified_base (253)..(253): a, c, t, g, unknown or other
  modified_base (319)..(319): a, c, t, g, unknown or other
  modified_base (356)..(356): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctcgtaggagatgcattgaccaaagcaatatgcttatcgtaacaanaaagcagcacgccctgtggtgtgatataataaagacagtagagacgcctagagggactcccgtagngacgtattctcgtcgcctcagctacgagggacaacgngtcctacgttcgaccataccgagttacggacgtcccgagggacaagggaagggacggaagggtcctaggtactttaattacgttcggtaactaagttacgaaggtacgaaacgaaacctaaactaaaggtttaaaacttaacgttttaaaccgttatttttaaacgttcggtttacgtttacgggttaaattcccgggttacggggtaaaccgttacggggttaccctaacccggtttccggtttaaggtcccgaaccggaacccccgtaaccgggaccccctaaaaccccggttcttacccg

SEQ ID NO: 415059 - DNA, 628 bp, Homo sapiens
  misc_feature: GZ8MTXP02FM0L6.3.10.A10.1.454.CMB.2.raw
  modified_base (355)..(355): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgacaaagcaatatgtcttagttaggtaaccaaacaaaacgccaacggcccaacggccccctggtcggtggtagatataataaagacagtgagacggcctgagggactccgtgagcgatttctcgtgctcganctcgaggacaacacgtacacgttcgacctagttaccgagtacggacgtcgaagggcaaggacggacgaggccgtagtaacttatttagtagttactaacgtcgaaacgcgaaagtaaaaccgtaaactaaagttaaactttaactttactttacgttttaagttcggtttacgttaggtacgtttcggtacgggtaccgtacgggttaccaccggtttaccggtaacggtcctaaccgacccgtaaccggaaccccaacccgtacttacccgg

SEQ ID NO: 415060 - DNA, 522 bp, Homo sapiens
  misc_feature: GZ8MTXP02JTADA.3.10.A10.1.454.CMB.2.raw
  modified_base (158)..(158): a, c, t, g, unknown or other
  modified_base (306)..(306): a, c, t, g, unknown or other
  modified_base (404)..(404): a, c, t, g, unknown or other
  modified_base (407)..(407): a, c, t, g, unknown or other
tcagagacgcactccacgaccggtgctcgatttagcgtcgatctcagggggtgggtccaggaggcagaactctgggtgtctcaccatggcctggatccctctacttcctccccctcctcactctctgcacagactctgaggcctcctatgagctgacncagcccaccctcggtgtcagtgtccccaggacaggacggccaagatcacctgctctggagatgcattgccaaagcaatatgcttatggtacaacaaagcaggccaggcccctgtggtggtgatatataaagacagtgagaggcccctnagggatcccgtgagcgattctctggctccagctcagggcaaacagtcacgttgacatcagtggagtccaggcagagacgaggctgactattattgtanatnagcagacaacagtaatacttattcgtttatggttacttcggatcgtacggggaccaggggtccaccggttcctaagggtccaacgcccaaacggcccctaaacccccgacttacg

SEQ ID NO: 415061 - DNA, 730 bp, Homo sapiens
  misc_feature: GZ8MTXP02I81O1.3.10.A10.1.454.CMB.2.raw
  modified_base (245)..(245): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagcccacctcggtgtcagtcgtccccaggacagacggccaagactcacctgcttctggagatgctagttcgaaccaaagcaatntgtcttattggtaaccaaactaaaacgccacggacccaaggtaccccctggtcggtggtagatataataaagacagtagaggacggccctgacgggtactcccgtggacgcgtacgttacctcgtcgggtcctccgaacgcttacggaacggggaaacaacgtacgtacctaacggttacggaaccctaatccgaaggtacggacgttacccgaaggaccgaagggaacgggaacggaacgggtacctaggtaaaccgttaagtttaacgttacggttaacctaaagttccgaaacggacctaaacggaaactaaaaccggtaagtttaaaacgtttaaccttttaaactttacgtttttaacgttaccgtttacgttaccggtacgttaccgggttacgggaacccgtacggggttaccctaaccccggtttacgtaacggttcccgaaccgtaccccgaaaccggttacccctaaacccccgg

SEQ ID NO: 415062 - DNA, 585 bp, Homo sapiens
  misc_feature: GZ8MTXP02I5M2W.3.10.A10.1.454.CMB.2.raw
  modified_base (314)..(314): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaaccaacaaagccaggccacggcccctggtggtggtgatataataaagacagtgaggaggccctnaggggactcccgtgacgcgtattcctcgtggccttccagctcgagggacaacagtcacgttgacctatcgagtcggagtccgaggcaaggacggacggagctgaacgttatttagtgtacaatcgacgacaagacaaacaagttaacttacgttatttactttaatcgtttacgttacggtaattcggttacggggaacctcggggttacctaacccggtcgttaacggttaccgaaccggtacccgaaaccggtacccctaaaacccccg

SEQ ID NO: 415063 - DNA, 541 bp, Homo sapiens
  misc_feature: GZ8MTXP02IDCTC.3.10.A10.1.454.CMB.2.raw
  modified_base (420)..(420): a, c, t, g, unknown or other
  modified_base (438)..(438): a, c, t, g, unknown or other
  modified_base (506)..(506): a, c, t, g, unknown or other
tcagagacgcactccacgaccggtgctcgatttagcgtcgatctcagggggctgtgggtccaggaggcagaactctgggtgtctcaccatggcctggatccctctacttctcccccctcctcactctctgcacagactctgaggcctcctatgagctgacacagccaccctcggtgtcagtgtccccaggacagacggccaagatcacctgctctggagatgcattgaccaaagcaatatgcttattggtaaccaaacaaaagccaggccacggcccctggtggtggtgatataataaagacagtgaggacggccctagagggactccccgtgacgcgtactttctcgtggctccgagctcgaggggacaaacgacgtcacgttgaccatcgagtggagtccgagcgaggaggacgaggntagacttagtttatgtanatcagcaagaacacgtaattaatacttattactttatgttcttcgtatcgttacgggacctggtaccnccgttactaggtcacgccccaaggcccctaaaccc

SEQ ID NO: 415064 - DNA, 560 bp, Homo sapiens
  misc_feature: GZ8MTXP02HRU4L.3.10.A10.1.454.CMB.2.raw
  modified_base (256)..(256): a, c, t, g, unknown or other
  modified_base (325)..(325): a, c, t, g, unknown or other
  modified_base (399)..(399): a, c, t, g, unknown or other
tcagagacgcactccacgaccggtgctcgatttagcgtcgatctcagggggctgtgggtccaggaggcagaactctgggtgtctcaccatggcctggatccctctacttctcccccctcctcactctctgcacagactctgaggcctcctatgagctgacacagccaccctcggtgtcagtcgtccccaggacagacggccaagatcacctgctcgtggagatgctattgaccaaagcaatatgcttatgtacaanaaagcagcagccctgtgtgtgatatataaagacagtgagacggcctgaggatcccgtgagcgtacttcncgtggctcgacgtctcgaagggacaacacgtcaacgttgaacccatcaggtgacgtcaggacaggaggaaccgnggactgacttattattgacctagtacagacgaagaacaaactagttaaatacttattacgtttaatcgttctacggtacttacggttacggaccgttacggtacctaaccggttcccgtaggttacccacggaaccccgtaacggtacccctaaaaccccg

SEQ ID NO: 415065 - DNA, 581 bp, Homo sapiens
  misc_feature: GZ8MTXP02FJRRC.3.10.A10.1.454.CMB.2.raw
  modified_base (339)..(339): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgtcttattggtaaccaaacaaaagccaaggccacggccccctggtggtggtgatataataaagacagtgagaggccctgagggactcccgtgacgcgtattcncgtggcctcagctacgaaggggacaaacagtcacgttgaacatcagtggacgtccgaggcaaggaggacgaggctgaactattatgtacaaatcaagacaagaaccaaataagttaaacttactttatactttaagtcgttacttacgggattcggttacggggaacctacggggtacccaccggttacctaacgggtccaacggaccccgaaaacggacccccaaaacccgtcgttaaccg

SEQ ID NO: 415066 - DNA, 603 bp, Homo sapiens
  misc_feature: GZ8MTXP02JI8W7.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgcaaagcaatatgcttatggtaaccaacaaaagccaggccaggcccctgtggtggtgatataagtaaagacagtgagacggccctacgagggactcccgtgagcgtacttcctctggcctccagctcgagggacaacgacgtcacgttcgacatcgaggtggacgtaccgaggacaggacggacgagggtctaggtaacttagtttagttacgtacaaagttacaagtacaacggaacaaacgtaagttaaacttaactttattactttagtacttcgttaccggtagttaccgttcgggtaacccgtacggggtacctaacccggttccgttaacgggtaccctacggaccccgtaaacggacccccaaaacccccg

SEQ ID NO: 415067 - DNA, 491 bp, Homo sapiens
  misc_feature: GZ8MTXP02FPXU4.3.10.A10.1.454.CMB.2.raw
tcagagacgcactccacgaccggtgctcgatttagcgtcgatctcaggggctgtgggtccaggaggcagaactctgggtgtctcaccatggcctggatccctctacttctcccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctgagggatcccgtgagcgattctctggctccagctcagggacaacagtcacgttgaccatcagtggatccagcagagacgaggctagactattatgacaatcagcagacaacagtaatactatctttaatgtcttacggatctgggaccagggtcaaccggttcaggtcagcccaaggccaacccg

SEQ ID NO: 415068 - DNA, 559 bp, Homo sapiens
  misc_feature: GZ8MTXP02J2EBF.3.10.A10.1.454.CMB.2.raw
  modified_base (254)..(254): a, c, t, g, unknown or other
tcagagacgcactccacgaccggtgctcgatttagcgtcgatctcagggggtgggtccaggaggcagaacgtctgggtgtctcaccatggcctggatccctctacttctccccctcctcactctctgcacagactctgaggcctcctatgagctgacacagccaccctcggtgtcagtgtccccaggacagacggccaagatcacctgctctggagatgctattgaccaaagcaatatgacttatggtaccaanaaagccaggccaggcccctggtggtggtgatatataaagactagtgagacggccctcgagggactcccgtgacgcgtattctccgtggctccgagctacgaggggacaacgtagtcagttcgacatcgagtcggacgtccgaaggcgagaggacgaggctaggtacttattacgttgacaatcagacaagacaacgtagtaatacttattactttaatgttactacggatcggtacggaccgtagggtccctacggtaccgtaagggtaccacgacccgaaacggcccaaaaccccgtgtacccg

SEQ ID NO: 415069 - DNA, 591 bp, Homo sapiens
  misc_feature: GZ8MTXP02IYFKW.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagcccaccctcggtgtcagtgtccccaggacagacggccaagatcacctgctctggagatgcattgaccaaagcaatatgtcttattaggtaaccaaacaaaagccaggccacggcccctggtggtggtgatataataaagacagtgagacgccctgagggactccctgagcgtacttctcgtggcctcgacgctcgagggacaacacgtcctacgttgacctatcgagtggacgtcgaggacaggaggacgaggctagtacttatttagttgtataatcgagacgaagaactaaacgtaaagttaaacttatttaagtttcttttaacttaggtttaccgtttcggtaattccggttacggggtaccgtacgggtacctaaccggttccgtacggtaccaccgtacccgaacggaccccctaaaccccg

SEQ ID NO: 415070 - DNA, 699 bp, Homo sapiens
  misc_feature: GZ8MTXP02FNAU9.3.10.A10.1.454.CMB.2.raw
  modified_base (325)..(325): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaatatgcttatggtaaccaaacaaaagccaaggccacggcccctggtggtggtgatatataaagacagtgagacgccctgagggactccnggagcgtacttcctctacgactcagctcgagggaacaaacgagtacctacgttacgaaccctatcgaaggtgggaacgttcccgaagggcaagggacgggaaccggtagggtacctagggtaaaccttaagtttaagtttcggtaactaaacgttacgaacgtacccgaaaggaaaccctaaacggtaaaacgtttaaacttaaacttttaactttaccgtttttaaaagtcggttttaccgtttacggggtaactttccgggttaacgggggtaaccccgtagggggtttacccgtaaacccggtttcccggttaaggggtaccccgtaacgggacccccgtaaaaccggggtaccccctaaaaaccccccgg

SEQ ID NO: 415071 - DNA, 704 bp, Homo sapiens
  misc_feature: GZ8MTXP02JOUG6.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctggtgtcagtcgtccccaggacaggacggccaagatcacctgctctggagatgctattgaccaaagctaaatatgtacttattacggtaaccaaacaaaacgccaaggccacggcccctaggtggtggtagataataataaagacaggtagagacggcccctagacgggtactccccgtaggacgtccgtaagtttccgtaccgtcggtcctaccgaacggtcctacggaacggggaccaaacgtacgtaccgtacgttacgaacctagtacgtaaggtggaacggtccgaagggacgaagggtagggaccggaggtccgtaaggtacttagtttaagttcgtaacgtaactacgagacgaaacgaactaaaccggtaatttaaacttaacctttatttacgttttaaagtcggtttacgttacggtaacttccgggtaacggggttaaccgtaccggggttacccgtacccgttacccggttaacggtacccgtaaccggacccccgaacggaccccctaaacccgtacgttacccg

SEQ ID NO: 415072 - DNA, 495 bp, Homo sapiens
  misc_feature: GZ8MTXP02IDK9O.3.10.A10.1.454.CMB.2.raw
  modified_base (255)..(255): a, c, t, g, unknown or other
  modified_base (273)..(273): a, c, t, g, unknown or other
  modified_base (282)..(282): a, c, t, g, unknown or other
  modified_base (425)..(425): a, c, t, g, unknown or other
  modified_base (427)..(427): a, c, t, g, unknown or other
  modified_base (429)..(429): a, c, t, g, unknown or other
  modified_base (432)..(432): a, c, t, g, unknown or other
  modified_base (494)..(494): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaaatatgcttaatggtaaccaaanaaagcaggccagccctgngtgtgatanataaagacagtgaagacggccctagagggacttcccgagagcgatctcctaggctccagctacgagggacaaacgagtcacgttagacccaatcgaagtggatccaggcaagaggacgaggcagactatattgacaatcaganananaanaataatatatatatatctgatcgtgacgacgacgtacgcgtaagcacgacacgaccaccacnc

SEQ ID NO: 415073 - DNA, 713 bp, Homo sapiens
  misc_feature: GZ8MTXP02IUMA8.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagcccaccctggtgtcagtcgtccccaggacagacggccaagatcacctgctctggagatgctattcgaccaaagcaaatatgcttattggtaaccaaacaaaaagccacggccaaggcccctaggtcggtgtgaatataataaaagacagtagagacggtaccctgagggactcccgtggagtcgacttctcgtcggctaccgaggcctcgaggggaaaccaaacgacgtcctaacggttacgaaccctagttaccgaaggttacggaacgtccccgaaaggggaccaggggaacgggacgaacgggtaccttggaaaccttaagttttaaaccgttgttaaccgaaattcgaagaccgaaagaacgtaaaactaaaggtaaactttaaccttaaagtttacctttttaaagtcggttactttaccggggtaaactttcccgggtacggggtaaaacccgttagggggttacccctaacccccgggttaccgttaagggttaccccgaaccggtaaccccccgaaaacgggaccccccttaaaacccccgg

SEQ ID NO: 415074 - DNA, 641 bp, Homo sapiens
  misc_feature: GZ8MTXP02JBK4O.3.10.A10.1.454.CMB.2.raw
  modified_base (447)..(447): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgctattgaccaaagcaatatgtcttaagtcggtaaccaaacaaaagccaggccacggcccctggtggtggtgaattagtaataaagacagtgagacgcctagagggtactcccgtgacgtcgtaattctccgtcgtcctccgacgtctacgaagggaccaaagcgtaccacgttcgaacctagtcgagtggacgtccgaaggcaaggacggacgagctagactagtttntagataaagtcaaaggcaaacgaactaaacgttaagtaaacttaactttacttacgttttatcggtttcccgttagggttacgttccgggttaacgggaaccggttacgggttaccctaaaccccggtttcgtaacggggtacccaacccgggacccgaaccgggtaccccctaaaaccccggtcgtttacccg

SEQ ID NO: 415075 - DNA, 686 bp, Homo sapiens
  misc_feature: GZ8MTXP02G97HL.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctcgtggagatgcattcgaccaaagcaatatgtcttattacggtaaccaaacaaaacgccaggccacggacccctggtggtggtgtaatataaagtaaaagacaggtggaacgacggccctacggtaacgggactcccgtagacgtcgtactttcgtcgtcggcctacgacgctcggacgggaaaccaacgtacgtacgtacggttacaacccgtatacgtaggtacggacggtacccggaagggacgacgggtaacgggaacggtagggtaccttacgtaaagtttagtttaacgggttctaaacgtacttacgaaacgaacaaacgtaaactaaacggttaattaaactttaacgttttacgttacttttagtacggtttcgttaaacggtcttacgggtacggtaccggttacggtaccgtaacccgttcggtaacgtaccaccgggaccctaaccggaccctaaaccccgg

SEQ ID NO: 415076 - DNA, 717 bp, Homo sapiens
  misc_feature: GZ8MTXP02JLMTV.3.10.A10.1.454.CMB.2.raw
  modified_base (217)..(217): a, c, t, g, unknown or other
  modified_base (293)..(293): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaaagatcacctgctctgganatgcattcgaccaaagcaaatatgactttagtaggtaaccaaacaaaagccaaggccacggcccctggtggtggtnaatataataaagacagtgaagaggcccctagagggactcccgtggagcgtattctacgtcggcctccagcctacgaagggaccaaacgagtcaaccgttgaacctatacgaggtcggaacgtcccgaggacgaaggaaggaccggtaggtaccgtaggaacctttaagtttacgttagtaactaattaccgaaggacaaaaggtaaacccaaaagtaacggtttaaaaacttaacctttttaagttaaccctttttaagtaccggtttttacgtttaccgggttacgtttacccgggttaagggggtaaccccgtaacgggggttacccctaaaccccggggtttaccgtaaacgggttacccgaaaccggttaacccccgtaaaacgggacccccctaaaaaccccccggtttcgttaacccg

SEQ ID NO: 415077 - DNA, 537 bp, Homo sapiens
  misc_feature: GZ8MTXP02F24MH.3.10.A10.1.454.CMB.2.raw
  modified_base (413)..(413): a, c, t, g, unknown or other
  modified_base (417)..(417): a, c, t, g, unknown or other
  modified_base (430)..(430): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtacaaacaaaagccaggccaggcccctgtggtggtgatatataaagacagtgagaggccctgaggggatccccgtgagcgattctcctggctccagctcgaggggcaacagtacacgttagaccatcgaagtggactccgaggcagagacgagctgactattattganaatnagacagaacaaanagtaaattacttattactttatcgttacttcggaattccgtaggggacctacgggtccaccgtaccgtaaggtcccaggtaccccaaaggacccaaccccgataccg

SEQ ID NO: 415078 - DNA, 582 bp, Homo sapiens
  misc_feature: GZ8MTXP02IHLE4.3.10.A10.1.454.CMB.2.raw
  modified_base (446)..(446): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgtcttaattggtaccaaacgaaagccaaggccaggcccctgtggtggtgatataataaagacgagtggaagacggccctagaagggctcccgtggacgctacttctccgtcggacctccgagccttacgacgggtacaacagttaccacgttcgacctatacgaaggtgacgtccgaggcaaggacggacgaggctagacttatattganaatcagtacaagacaactagtaatacttattacttaagtcgttacttaggacttacggtagggtaaccgtcggggtacctacccggttacgtaagtaccgacgaccccgaacggaccccctaaacccgatttcccg

SEQ ID NO: 415079 - DNA, 587 bp, Homo sapiens
  misc_feature: GZ8MTXP02JKVXU.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgtacttattaggtaaccaaacaaaagccaggccacggcccctggtggtggtgatataataaagacagtgagacggccctagagggactcccgtgacgcgattctccgtggcctccagctacgagggacaacgtagtcacgttcgacatcgagtgacgtccgaggcaaggaggacgagactagacttattagtgtacaatcgaagcaagtaacaaagtaagtaattaactttattactttaatcgttacgttacggattccggtacgggtaaccgtacgggttacctaacccggttaccgtaaggtacccgaaccggaccccgaaacggaccccctaacccgactttacccg

SEQ ID NO: 415080 - DNA, 738 bp, Homo sapiens
  misc_feature: GZ8MTXP02IPXQQ.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagcccaccctcggtgtcagtcgtccccaggacagacggccaagactcacctgcctcgtggagatgctattcgaccaaagctaatatgtacttattaggtaaaccaaacaaaacgccaggccacggcccctgtggtggtgatataataaagacagtgagacgccctacgagggactccgtgacgtcgtacttcgtctacggctccgagcctcgaagggaccaaacgtacgtccgtaacggtttacgaacctagtacgacggttagggacgttacccgaaaggggaccgaagggaacggggaacggaagggtacgtacgggttaaactttaagtttaactttacggtaactaaacttcgaaagtaccgaaacggaaacgtaaacttaaagttaaacctttaaactttaactttaccgtttttaaagttacggtttaaccgtttcgggttaaaacgttccggggtttaccggggtaaaacccggttcggggtttaccccgtaaccgggtttacccgttaacggggtttaccccgaaaccggtaacccccggtaaaaccgggaccccccttaaaacccccg

SEQ ID NO: 415081 - DNA, 649 bp, Homo sapiens
  misc_feature: GZ8MTXP02JXR1D.3.10.A10.1.454.CMB.2.raw
  modified_base (253)..(253): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttatggtaaccaaanaaagccaggccacggcccctggtggtggtgattataataaagacaggtgaggacggccctcgagggtactcccgtggacgcgtattctccgtaggcctccgagtctacggaagggtaccaacgtagtacctacgttacgaccctagtccgaggtcggacgtcccgaaggacgaagggacggacggaggtctaggtacttatttagttcgtaactaatccgagacaaacgaactaaaaccgtaagttaaacttaactttaacgtttaccttttaagtacggtttacgtttacggtagtttaccgggtaacgggtaaccgtacgggttacccgtacccgttacgtaacggtaccgaaccggtacccgaaaccggacccctaaaccccgtcgttacccg

SEQ ID NO: 415082 - DNA, 481 bp, Homo sapiens
  misc_feature: GZ8MTXP02IWTMI.3.10.A10.1.454.CMB.2.raw
  modified_base (255)..(255): a, c, t, g, unknown or other
  modified_base (280)..(280): a, c, t, g, unknown or other
  modified_base (325)..(325): a, c, t, g, unknown or other
  modified_base (332)..(332): a, c, t, g, unknown or other
  modified_base (408)..(408): a, c, t, g, unknown or other
  modified_base (410)..(410): a, c, t, g, unknown or other
  modified_base (412)..(412): a, c, t, g, unknown or other
  modified_base (414)..(414): a, c, t, g, unknown or other
  modified_base (416)..(416): a, c, t, g, unknown or other
  modified_base (419)..(419): a, c, t, g, unknown or other
  modified_base (434)..(434): a, c, t, g, unknown or other
  modified_base (439)..(439): a, c, t, g, unknown or other
  modified_base (480)..(480): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaaagatcacctgctctggagatgcattgccaaaagcaaatatgcttattggtaccaaanaaaagccaagccaggcccctgtggnggtgatataataaagacagtgagaggccctcaggggatccctgancgattcnctggctccagctcagggcaacagtcagttgacgatcaagtgatccaggcagagcgaggctgactatatgtcaaatnananananaanaataatatatatatntctgntctgacgacgcgacgtactaagtcacgacacgaccaccacnc

SEQ ID NO: 415083 - DNA, 660 bp, Homo sapiens
  misc_feature: GZ8MTXP02GWRR9.3.10.A10.1.454.CMB.2.raw
  modified_base (200)..(200): a, c, t, g, unknown or other
  modified_base (255)..(255): a, c, t, g, unknown or other
  modified_base (290)..(290): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctggtgtcagtcgtccccaggacagacggccaagntcacctgctctggagatgcattgaccaaagcaatatgtacttatcggtaaccaanaaagccaggccacggccctggtggtgtgatataanaaagacagtgagaggccctagagggactccgtagagcgtattctccgtgcctcagtctacgagggacaacgacgtactacgttagacctagtcgaggtcggacgtccgaagggcgaaagggacgggacgggacgtacgttacggtaacttaagtttaagttcggttaactaaagttacgagaaccgtaagaaaaccctaaagtaaacgtttaaattaactttacgtttacttttagttacggtttaccgttacgggtacttaccgggttaacgggaacccggttacgggttacccgtaaccggtttaccgttaacgggtaccgaaaccggtacccgaaaccgggaacccctaaccccggtaactttcccg

SEQ ID NO: 415084 - DNA, 545 bp, Homo sapiens
  misc_feature: GZ8MTXP02FOMVN.3.10.A10.1.454.CMB.2.raw
  modified_base (255)..(255): a, c, t, g, unknown or other
  modified_base (406)..(406): a, c, t, g, unknown or other
  modified_base (422)..(422): a, c, t, g, unknown or other
  modified_base (425)..(425): a, c, t, g, unknown or other
  modified_base (427)..(427): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttatggtaccaaanaaaagccaggccaggcccctgtggtggtgatataataaagacagtgagaggcccctgaggggatcccgtgacgtcgacttcctcgtggctccaggctcgagggacaacgagtcaagttcgacctatcgagtggactcgaggcagaggacgngactgacttatatganatnancagacaatagtaatacttatactttatgttacgttcggaattcgtacgggaaccgtacgggttacctaaccggtaccgtacggtaccaacggacccgaaacggcccctaaaacccccg

SEQ ID NO: 415085 - DNA, 741 bp, Homo sapiens
  misc_feature: GZ8MTXP02HQO3F.3.10.A10.1.454.CMB.2.raw
  modified_base (218)..(218): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacacgccacctcggtgtcagtcgtcccaggacagacggacaagatcacctgctctggantgcattcgaccaaagcaatatgtacttattaggtaaccaaacaaaacgccacggccacggtccccgtggtggtggtacgattaataagtaaagacagtaggaagacggcccgtgaagggactcccgtagacgtctacttcgtcgtcggccttacgaggtcctacgggaacgggaaccaaacgtacgttaccgtaacgtttacgaaccctaagtcgtaaacgggttcgggaacgttacccggaaggggaccgaaggggttaacgggaacggacgggtacgtaacgtaagtttaacgtttaactttggttaacctaaagttcgaaacggtacaaaacgggactaaaaggtttaacttaaatttaacgtttactttaacctttttaagtttccggggtttacctttacggttaacggttccggtaaacggggtacccggttaaacgggttcccttaaaccccgggtaccgtttaacggtaacccgtaccggaaacccccgtaacggtaacccccgtaaaacccccg

SEQ ID NO: 415086 - DNA, 800 bp, Homo sapiens
  misc_feature: GZ8MTXP02GXWKV.3.10.A10.1.454.CMB.2.raw
  modified_base (220)..(220): a, c, t, g, unknown or other
  modified_base (376)..(376): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacacgccaccctcggtgtcagtcgtccccaggacagacgccaagatcacctgctcgtgganatgctattcgaccaaagctaaatatgtacttagttacggtaacccaaacgaaaacgccgacggacccgacggtccccgttaggtcggtaggtagtaataacgttaaataaaaggacaaggtagaacggacggacccctagaacgggtactccccgngacggtcgtaccgtttcgtacgtggtcctcgacgcgtcgaacggggaacaacgacgtaccgtaacgttcgaaccctagttcgaggtaggtacgacgacggagacgggaggaacggacggtcgtacgttaacttaagtttacgtttacgtaactaacgttacgaagaccgtaacgaaaacgtaaaacgttaaacgtttaaaccgtttaaactttaactttaaaccgtttttaacgttacggttttacccggtttacggttaaacggttttaaccggggttaacccggggtaacccccggtttaaacgggggtttacccccgtaaaccgggggtttacccccgtttaaaccgggggttaaccccgaaccccgggggtaaaccccccgtaaaacccgggggttaaccccccctaaaaacccccccgg

SEQ ID NO: 415087 - DNA, 780 bp, Homo sapiens
  misc_feature: GZ8MTXP02GS4WH.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctcgtggagatgcattgaccaaagcaatatgtacttaagttacggtaaaccaaacaaaacgccgaacggacccgaacgggtcccccgtggtgggttgggtagtaaagttaagttaaagtaaaaggaaccgaaggttaggaaaggaccgggacccccgttaacggaacggggtacctccccgtaggaaccggtcgtaacgtttcctccccgtcgggcccttacgacgtcctacggaacgggaccaaccgtagtaccgtacggttaccgaactaatacgaaggttacgggaacgtcccggaaaggacggaaagggaacgggaaccggaagggtacgtacgtaacgttaatttaaaggttcgtaactaaaacgttcgaacgaacgtaaacgaaaacctaaacgtaaagtttaaaacttacctttaagttaccttttaagtaacggttttcgttacggtacgtttacggtaacggggtaacccgttacggggtaccctaacccgggtcggttaacggtacccgtaacccggacccccgaaaccggtaaccccctaaaccccgtacggtttaacccg

SEQ ID NO: 415088 - DNA, 716 bp, Homo sapiens
  misc_feature: GZ8MTXP02GI6IL.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctcgtggagatgctattcgaccaaagctaatatgtactttagttacggtaaaccaaacgaaaacgccgacggccgacggtcccctggtggtggtagtaataataaataaagacaggtaggaagacggtccctacggaaggggtactcccgtaggacgtcgtaatttcgtccgtcggcctcgacgtccgtacgaacggggtaccaaacgtacggtaccgtaacggttacgaaacctacgtacgtaaggggtacggtaccgttacccgaaggggaccgaaaggggaacgggaacgggtacggtaccgttaagtaccgtttaatttagtttacgtaaactaacgtacgaagacgtaaagaaacctaaacggtaatttaaacttactttaattactttaagtcgttcgttacggtattacggtacggtaccgtacgggtaccctaccggttccgtaacggtacccgaacccggtaccccgaaaacggtaccccaacccgttacttaacccgg

SEQ ID NO: 415089 - DNA, 671 bp, Homo sapiens
  misc_feature: GZ8MTXP02JL1Z0.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagcccaccctcggtgtcagtcgtccccaggacagacggccaagatcacctgctcgtggagatgcattgaccaaagcaattatgtacttagttacggtaaccaaacgaaaacgccgacggaccacggtccccgtggtaggtggtagaattaagtaataaaggacaggtagaaggacggtcccctaggagggtacctcccgtaggacgtcgtatttcctccgtcggtcctaccgacgtctacggaacgggaccaacgtagtaccgtacgttacgaacctataccgtaggtcgaacggtccgaaggcgaaaggggaacgaccggaggactagaacttagtttaacgtgtaacaattccgaagtacaacgtaactaacgaagtttaaactacttagtttactttagcgtttacgttacggagttacggttacggggaccgttacgggtaccctaaccgttacgtaacggtccgaacccgacccggaaaccgtccccaaaaccccgtgtttaaccccg

SEQ ID NO: 415090 - DNA, 602 bp, Homo sapiens
  misc_feature: GZ8MTXP02IES6D.3.10.A10.1.454.CMB.2.raw
  modified_base (434)..(434): a, c, t, g, unknown or other
  modified_base (453)..(453): a, c, t, g, unknown or other
  modified_base (463)..(463): a, c, t, g, unknown or other
  modified_base (488)..(488): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttatggtaaccaacgaaaaagccaggcccaaggcccctggtcggtggtgaagtaataataaaagacaggtgaagacggtcccgtacgagggatccccgtgagcgactttctcgtgcctcaaggctcgaacgggaacaacgagtcacgttgacccatcgagtgaatccgagcgtagaggcgaggctgaaacttnttattgtacaaagtcaagnacgaaacaanacgtaaatactttatacgtttaacngtttactacgtaacgttacgtcggggtaaccgtaacgggggtaccaaccccggtttaccgaacggggttacccaaccggtacccccgaaaacgggtaaccccctaaaacccccg

SEQ ID NO: 415091 - DNA, 580 bp, Homo sapiens
  misc_feature: GZ8MTXP02I94WM.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctggtgtcagtcgtccccaggacagacggcaagatcacctgctctggagatgcattgaccaaagcaatatgtcttattgtacaaacaaagccagccaggcccctgtggtggtgatataataaagacaggtgaagacggccctcgagggactcccgtgagcgatttctccgtgggcctccaggctacgacgggaccaacgagtaccgtacgttacgaccaagttccgagttggaacgtcgaaggcaaggacggacgaggcgtagaacgttattattagtactaaagtcaagacaagaacaacgtataacttaaattatactttatgttacctaggtactcgttacgggacctacggtaccgtaaccgttcgtaaggtccgaacgacccaacggaccccaaaccccgtacgttaccg

SEQ ID NO: 415092 - DNA, 647 bp, Homo sapiens
  misc_feature: GZ8MTXP02HN5CY.3.10.A10.1.454.CMB.2.raw
  modified_base (259)..(259): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtctccccaggacaggacggccaagatcacctgctctggagatgcattgaccaaagcaatatgtcttattggtaaccaaanaaacgccaggccacggcccctgtggtgtagatataataaagacagtgaggacgccctagaggactccctaggacgtcgtacttctcgtcggcctcgagcctcgaacgggtaacaaacgtacgtaccgtacgtttgaaccctagtcgtaaggtggacgtccgaaggacgaaggacgggacgacggctacgaacttagtttattagtacaagtcgaacgtacgaacaaaccaaagtaaacgttaaactttaacttacttacgttttaagtacgtttacgttacggttacgtaccggttacgggacccgttaacgggttccgtaaccggttacccgtaacgggtaccctaacggtaacccccgaaaacgggtaaaccccctaaaacccccg

SEQ ID NO: 415093 - DNA, 659 bp, Homo sapiens
  misc_feature: GZ8MTXP02HM3RX.3.10.A10.1.454.CMB.2.raw
  modified_base (353)..(353): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtccagtgtccccaggacagacggccaagatcacctgctctggagatgcattgaccaaagcaatatgcttattggtacaacaaagccagccacggcccctgtcggtgtgatatataaagacagtgagaggccctgagggctcctgagcgtattctcgtggctccagctacgagggacaacgngtcacgttcgaccatccgtaagtggaacgtcgacgggacaaggacggaggacggctacggacttaatttaagttgttacctaaagttacgaagaccgaaagaaacaaccgtaaagttaaactttaaactttaacgttaacctttaaagttcgtttaaacgtttcccgggttaaagtttccggttaacggggtaaacccggttacggggttaaccccgtaacccggtttacccggtaacgggtttacccgaaaccggtacccccggttaaaacgacccccgtaaacccccggttactttaaccccgg

SEQ ID NO: 415094 - DNA, 642 bp, Homo sapiens
  misc_feature: GZ8MTXP02GPBAH.3.10.A10.1.454.CMB.2.raw
  modified_base (217)..(217): a, c, t, g, unknown or other
  modified_base (255)..(255): a, c, t, g, unknown or other
  modified_base (278)..(278): a, c, t, g, unknown or other
  modified_base (281)..(281): a, c, t, g, unknown or other
  modified_base (361)..(361): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaaagatcacctgctctgganatgcattgaccaaagcaatatgcttattggtaaccaanaaaagccagccaggccctgtggngtnatatataaagacagtgagagcctagagggatccctgacgtcgtattctcgtcggcctcgagctacgaagggaccaaacgngtaccaacgttcaacccgtatcgaggtggacgtacccgaggcaagggtacggaccggaggacgtggaaccttatttaaagttcgtaacaaagttccgaagacaagaaacctaaacgtaaagttaaactttaactttaattaccttttaaatcgttttacgttaccgggtaattccgggtaacggggtaaccttaacgggggtcccttaacccggttacgtttaacggggaccaaccggttaccccaaacggggtacccccttaaaacccccgcgtttaccg

SEQ ID NO: 415095 - DNA, 555 bp, Homo sapiens
  misc_feature: GZ8MTXP02ICXHS.3.10.A10.1.454.CMB.2.raw
  modified_base (249)..(249): a, c, t, g, unknown or other
  modified_base (263)..(263): a, c, t, g, unknown or other
  modified_base (265)..(265): a, c, t, g, unknown or other
  modified_base (271)..(271): a, c, t, g, unknown or other
  modified_base (290)..(290): a, c, t, g, unknown or other
  modified_base (316)..(316): a, c, t, g, unknown or other
  modified_base (343)..(343): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttatggtacaanaaagcagcagcccngnggtggngatatataaagcagtgagnggcctgagggatccgtgagcgtatcncctggctcagctacgagggacaaacgngtcgacgttacgacctatccaagtggagtcccgaagggccaaggagggacggaggactggtacttaagttattcgtacaacttacgagcaagaaccaaagtagtaaactactttatactttagtcgttacttggtaatcgttaggaccgtacgggacctacgtaccgtaaggtaccacgacccgaaaacggcccctaaaaccctcgtacccg

SEQ ID NO: 415096 - DNA, 738 bp, Homo sapiens
  misc_feature: GZ8MTXP02I45UO.3.10.A10.1.454.CMB.2.raw
  modified_base (310)..(310): a, c, t, g, unknown or other
  modified_base (358)..(358): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctggtgtcagtcgtccccaggacagacggaccaagactcacctgctcgtggagatgcattcgaccaaagcaatatgtacttagttaggtaaccaaacaaaagccaaggaccacggcccctggtggtcggtagataataagtaaanacagtagaggagtccctacgagggtactcccgtggaagtcgtatttcnccgtacggctaccagtctacgaacgggacaactgtaccgtacgttgaaccctagtaccgagtacgggacgtcccgaaagggcaagggacggaaccgggagtacgtacgtaacttaagtttagttacggtactaaaagttccgaaacggttcaaaacggaacccgtaaaacttaaacggttaaatttaaaccgtttaaacttttaaggttttaaacttcggtttacggtttaaacggttacgttacccggttaaacgggggtacccttaaacgggggtttacccgtaacccggtttacccgtaaaacgggggttcccccaaaccggtaacccccggtaaaaacccggggaccccctaaaccccggtaactttaaccccggg

SEQ ID NO: 415097 - DNA, 660 bp, Homo sapiens
  misc_feature: GZ8MTXP02GAJW1.3.10.A10.1.454.CMB.2.raw
  modified_base (198)..(198): a, c, t, g, unknown or other
  modified_base (236)..(236): a, c, t, g, unknown or other
  modified_base (297)..(297): a, c, t, g, unknown or other
  modified_base (359)..(359): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctctatgagctgacacagccacctcggtgtcagtcgtcccaggacagacggccaagntcacctgctcgtggagatgctattgaccaaagctaatntgtcttagtacggtaaccaaacgaaacgcacggccacggcccctgtggtagtagatataanaaagacagtgaagcggtccctagagggtctcccgtagacgctattcctcgtacggcctcganccgtacgaacggggtacaacgtagtacccgtaccgttacgaaccctagtccggtaaggtaggtaaccgtccgaaggacgaaagggacgggacggttacgggctacgaaattagtttagtggtaaccaagtccagtacgaacgtaaaccaagttaaacgttaaattacctttattacgttttaatcgtttactggttaacgttcgggtacgggtaacccacgggggttaccaaccccggttacgaacggttaccgaacggtaaacccccgaaggtaccccccaaaacccgtctttaacccgg

SEQ ID NO: 415098 - DNA, 667 bp, Homo sapiens
  misc_feature: GZ8MTXP02F5I1O.3.10.A10.1.454.CMB.2.raw
  modified_base (218)..(218): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagcccaccctcggtgtcagtcgtccccaggacagacggccaagatcacctgctcgtgganatgcattgaaccaaagcaatatcgtacttagttacggtaacccaaaacaaaacgccgaaggccgacggtcccctggtcggtggtagaataataaataaagacaggtagacgacggcccctaggacgggtactccgtagacgcgtattctcgtcgcctaccgagtcctacgaagggacctaacgacggtaccgtacgttacgaaaccgtagttccgaaggggttcggaactccggaacggggacaaggggaaacgggacgtacgggtccttaaggaaactttaggtttattcggtaacaaacttccgagaaccgaaagaaacctaaagtaaatttaaacttactttagttaccttttaagacgtttaccggtgtaaacgttccgtaggggaccgtacgggtacctaccggtccgtaaggaccacgacccgacgacccctaccgacttccg

SEQ ID NO: 415099 - DNA, 600 bp, Homo sapiens
  misc_feature: GZ8MTXP02IBA1O.3.10.A10.1.454.CMB.2.raw
  modified_base (296)..(296): a, c, t, g, unknown or other
tcagagacgcactccacgaccggtgctcgatttagcgtcgatctcagggggctgtgggtccaggaggcagaactctgggtgtctcaccatggcctggatccctctacttcctccccctcctcactctctgcacagactctgaggcctcctatgagctgacacagccaccctggtgtcagtcgtccccaggacagacggccaagatcacctgctgtggagatgcattgacaaagcaatatgcttattaggtaaccaaacaaaagccaaggccacggccctggtggtgtgataataanaaagacagtagagacggccctagaggctcccgtgaggctacttctcgtgcctcagctacgaagggaacaacgtagtactacgtacaccctaatcgaaggtaggacgtaccgaggacaagggacggaaagacggcgtagtacttaagtttatgttaacaattcgaatcgaaagaacaaacgtaggttaaaacttactttaacttacttttagtagtttcccgttaacggtacttacggttacgggaccgttacgggtacctaaccgtacgtcgtaccgacgaaccccgacggtaaccccaacccg

SEQ ID NO: 415100 - DNA, 632 bp, Homo sapiens
  misc_feature: GZ8MTXP02H29TD.3.10.A10.1.454.CMB.2.raw
  modified_base (286)..(286): a, c, t, g, unknown or other
  modified_base (456)..(456): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctggtgtcagtgtccccaggacagacggccaagatcacctgctctggagatgcattgaccaaagcaatatgtcttaatggtaaccaaacaaaacgccaggccacggcccctgtggtaggtnatataataaagcagtgaagcggaccctgaagggtactcccgtagaacgtcggaacttccgtaccgtggcctcgacgtccgtacgaacggggacaaacgtacggtaccacgtttagacccaattacccaagggttcggaacgttcccgaaggtccaagggagggaaaccgngggtactacgtaacttatttagttagtaacgtaataccgaagtacgaaagtaacgtaaagtaagttaaactacttacttattagtcgttacgttacggtatacggtacgggaactacggtaccctaccgtacgtaacggtacgaaccgtacccaacggacccctaaccgtacgtcg

SEQ ID NO: 415101 - DNA, 693 bp, Homo sapiens
  misc_feature: GZ8MTXP02JWWUU.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagcccaccctcggtgtcagtcgtcccccaggacagacggaccaagactccacctgctcgtggagatgactattgaccaaagacaatatgtactttattacggtaaccaaacaaaacgccaacgggcccaccggtcccccgttgggtcgggtaggtagtaattaagtaaagtaaaaggaactaaggtagaggacggccccgtacgacgggtactccccgtaggacggccgtacgttccgtcgtcgggcctacccgagtccgtaccgaggggaaacctaacgacgtaccacggtttacaccctagtcgaaggttcgggacgtaccggagggacgaggacgggacgaggacgtagtaacttagttagttagtacaagtaccgaagacaaacgtaacgaaacttaacgttaaattacctttaattacttttaagtcgtttacgttacggtattaccgggtacggaccgtaccgggtaaccgtaacccggttaccgtacggtaccgtaaccgacccgaacggtaccccctaaacccg

SEQ ID NO: 415102 - DNA, 628 bp, Homo sapiens
  misc_feature: GZ8MTXP02IUF64.3.10.A10.1.454.CMB.2.raw
  modified_base (172)..(172): a, c, t, g, unknown or other
  modified_base (489)..(489): a, c, t, g, unknown or other
  modified_base (496)..(496): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtntcagtcgtccccaggacagacggccaagatcacctgctcgtggagatgctattcgacctaaagctaaatatgtacttagttacggtaaaccaaacaaaacgccgaaggccacggtccccgtggtcggtggtagaatataataaagacaggtagaaggacggtcccgtagacgggtactcccgtagacgtcgtacttctccgtgcctacgagtcgtacgaggacacgtagtactacgtcgactagtacgagtgacgtacgacgggactaagggacggtaccgagtacgtagtaacttagttatcgtaacaattcgaancgtaaanaaactaacgtaattaaacttatttaacttcgtttaatacgtttacgttacggtattcggtaacggacgtaccggtaccgaccgttacgtaaccggtacgaccgtacccgaacgaccccaacccgtattcccg

SEQ ID NO: 415103 - DNA, 815 bp, Homo sapiens
  misc_feature: GZ8MTXP02HO53J.3.10.A10.1.454.CMB.2.raw
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagcccacctcggtgtcagtcgtcccaggacagacggccaagactcacctgctcgtggagatgcattcgaccaaagctaaatatcgtctttagttacggtaaaccaaacgaaaacgccgacggcccacggtcccctggtggtggtagtattaactaataaaaggacgtaaggtaggaacggaaccggtcccgtacggaacggggtacttccccgtaggacggaccgttaccgtttccgtacgttcgggtacctcccggaggtctaccggggaaacggggtaaactaaaccggtacgttaacccgttacgggtaccgtaacccacgttacccgaaggggttacgggtacgaccggtaagggacgagggaaacggggacggtacggcgtaacgtacgtttaacgtttagtacggtttaacaagttacccggagtaaccgaaacgtaaaccgtaaacggttaacgttaaaattttaccttttaaaactttccgtttttaaaagtttcggtttaccggttttaacggtacgggtttaaccgggttaccggggaaccccgtttaaccgggggttacccgtaacccccgggtttaacgttaaccggggtaccgaaaaccccgggtacccccggaaaaccggtaaccccccgtaaacccccg

SEQ ID NO: 415104 - DNA, 724 bp, Homo sapiens
  misc_feature: GZ8MTXP02GZIRM.3.10.A10.1.454.CMB.2.raw
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctggagatgcattgaccaaagcaaatatgtactttagttacggtaaccaaacgaaaagccaaggccacggtcccctggtcggtggtagaatataaagtaaaggactagtgaagacggcccctagagggactccccgtaggacgtcgtaacgtttctccgtcgggcctaccgtaaggcctacgaacggggaccaaacggtacggtcaacgttcgaaccagtcctaagggtggactccgaagggccgaggaggtaaccggaggtcctaggtaacctaagttacttagtacctaaatcgaactcggaaaagtaaccgtaaaataacgtttaaagttaaaactttacgtaacgtttttaatccggttacgttttaaaccggggatttaccccgggtttaggggaaacccggttaacggggttaccccgtaacccgttaaccggtttaacggggtacccctaaaacggaccccccggaaaaacggttccccccgaaaaaccccccgtagtttaccccgg

SEQ ID NO: 415105 - DNA, 776 bp, Homo sapiens
  misc_feature: GZ8MTXP02FMEHF.3.10.A10.1.454.CMB.2.raw
  modified_base (219)..(219): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctctgganatgcattcgaccaaagcaatatgtacttattcggtaaccaaacaaaacgccgaggccaacggcccccgtaggtcggtaggtgaataagtaataaagacaaggtgaggacgtccctagacgggtactcccgtagacgctacttacgtcgtcggcctaccgacggtctacggacgggtaaacaaacgtacgtaccgtaaccggtttacggaaccctagtaccgtagggtacgggtaaccggttacccgaaggggtaccgaaagggggtaacggggaacggggtaacggtacgttaacgggtaaacctttaacgtttaagtttacggtaacgtaaaactttacgaaacggaccaaacgggtaaactaaaacggtaaaacgtttaaatttaacccgtttaaatttaccgtttttaaacgtgttttaccgtttacggtaacgtttacgggttaccggggttaaacccggtacggggttaaccccgttaaccggttacccggtttaacgggacccggttaaccggtaaccccggaaaacccggtaccccggtaaaaccccccg

SEQ ID NO: 415106 - DNA, 507 bp, Homo sapiens
  misc_feature: GZ8MTXP02HB6WQ.3.10.A10.1.454.CMB.2.raw
  modified_base (278)..(278): a, c, t, g, unknown or other
  modified_base (320)..(320): a, c, t, g, unknown or other
  modified_base (364)..(364): a, c, t, g, unknown or other
  modified_base (371)..(371): a, c, t, g, unknown or other
  modified_base (374)..(374): a, c, t, g, unknown or other
  modified_base (394)..(394): a, c, t, g, unknown or other
  modified_base (396)..(396): a, c, t, g, unknown or other
  modified_base (406)..(406): a, c, t, g, unknown or other
  modified_base (408)..(408): a, c, t, g, unknown or other
  modified_base (410)..(410): a, c, t, g, unknown or other
  modified_base (412)..(412): a, c, t, g, unknown or other
  modified_base (414)..(414): a, c, t, g, unknown or other
  modified_base (416)..(416): a, c, t, g, unknown or other
tcagagacgcactccacgaccggtgctcgatttagcgtcgatctcagggggctgtgggtccaggaggcagaactctgggtgtctcaccatggcctggatccctctacttcctccccctcctcactctctgcacagactctgaggcctctatgagctgacacagccaccctggtgtcagtcgtccccaggacagacggccaagactcactgctctggagatgcattgaccaaagcaaatatgcttattagacaacaaaagcaggccaggcccctagtgngtagatagtataaagacagtagagaggccctgagggatcccngagcgattctctggctcagctcgagggacaaagagtcacggtanaacatanagngagacgagagagagagagananatatatgtananananananacaacaataataattattacttattagtcttacgtactacgtacgacgtacggacgtaacgtacgtacgtacacgaccgaacgaccaaccc

SEQ ID NO: 415107 - DNA, 828 bp, Homo sapiens
  misc_feature: GZ8MTXP02FM4XP.3.10.A10.1.454.CMB.2.raw
  modified_base (200)..(200): a, c, t, g, unknown or other
  modified_base (216)..(216): a, c, t, g, unknown or other
tcagagacgcactccacgaccggtgctcgatttagcgtcgatctcagggggtgggtccaggaggcagaactctgggtgtctcaccatggcctggatccctctacttcctccccctcctcactctctgcacagactctgaggcctcctatgagctgacacagcccaccctggtgtcagtcgtccccaggacagacgcaagntcacctgctcgtgganatgcattagaccaaaagcaatatgtacttaagttaggtaaccaaacaaaacgcccgaaggcccgaacggtcccccgtggttacggttggggtagtaaattaataaagttaaaaacggaaccgtaaggtacggaaaggtaaccgggaccccgttacggaaacgggggtacttaccccggtaggaacgtacgtaacttttccgtccccgtacgggtccctacccgtaaagtccctaacggaacggggaccaaaacgtacggttacctaaaccggttttacggaaacctaacgttaccgaaaggggttacggtaaccgttacccggaaggggaccaaacgggggtaaaggggaacccggggttaaagggacccttagggtaaaccgtttaattttaaagttacggttaaacaaacggttacctaaagggaacccaaaagtaaacccaaaacggttaaaagttaaatttaaaccctttaaggtttaccttttaagtaacgtttccgttacggtatttacccgggttagggaaccggttacggggaccctaacccgtttacgaacgggttacaaaccgtaccccgaaacggaccccctaaaaccccggtacgtaccg

SEQ ID NO: 415108 - DNA, 762 bp, Homo sapiens
  misc_feature: GZ8MTXP02IXXDL.3.10.A10.1.454.CMB.2.raw
  modified_base (224)..(224): a, c, t, g, unknown or other
  modified_base (250)..(250): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacacgcccaccctcggtgtcagtcgtccccaggacagacggccaagatcacctgactcgtggganatgactagttcgaccaaagcaaagtntagtacttattcggtaaaccaaacgaaaacgccgaacggcccgacggtacccccgttggtacgggtaggtgtaattaagttaaagtaaacgaaccgtaggttaggaacggtaccgggacccccgttacggaagggtacccgttaccccgttaggacggtcggttaaccttttcccgtccggttcggtcccgtaccgtaacgtccgtccggaaaggggtaaccctaaacgtacgttacccgtacggtttacgaaccctaacgttcgtaacggttacgggacggttaccgacggtacgagggacggtaacggacgggtcctagtaaacgtttacgtttacgttaggtactaacttacgacgaacgtaacggaacctaaacggtaaagtttaaactttaacgtttactttaaccgttttaagttccgtttacggtttaccggtagttaccggtcggtaccgtacggtacgtaacccgtacgtacgtacgaccgacccgacggtaccctaaacccg

SEQ ID NO: 415109 - DNA, 690 bp, Homo sapiens
  misc_feature: GZ8MTXP02F2E2B.3.10.A10.1.454.CMB.2.raw
  modified_base (537)..(537): a, c, t, g, unknown or other
tcagagacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtcgtccccaggacagacggccaagatcacctgctcgtggagatgactattcgaccaaagcaatatgtcttagttacggtaaccaaacaaaacgccgaacggacccgacggtccccctaggtaggtgggtagaattaataaagtaaagacgaaggttagaacggacggaccccgtacgaaggggtacttcccctaggacgtacgtaactttcctccgtcggtccctaccgtacggcctacgaacgggaccaaaccgacggtctaacgttcgacgtacttccgaaggttcggacgtacccgagggcaagggaggacggaggactagtaacgttatttagttatacgtaactcaacgacgaaanaacccaaataagtaacttaacttagttactttagtcgttaccgttacggtacgtaccgtcggggtaaccgcgggttaacccgaccgtttaccggtaacggtccgaaccggttaaccccaaacgggtaccccctaaaaccccgtcgtttacccg

SEQ ID NO: 415110 - DNA, 724 bp, Homo sapiens
  misc_feature: GZ8MTXP02IBCPQ.3.10.A10.1.454.CMB.2.raw
  modified_base (215)..(215): a, c, t, g, unknown or other
tcagagacgcactccacgaccggtgctcgatttagcgtcgatctcagggggctgtgggtccaggaggcagaactctgggtgtctcaccatggcctggatccctctacttctccccctcctcactctctgcacagactctgagcctcctatgagctgacacagccaccctcggtgtcagtcgtcccaggacagacggcaagatcactgctctgganagtgcattcgaccaaagcaaatatgtcttattcggtaaccaaacgaaaacgccaaggcccaacggtccccgtaggtcggtaggtaggaattaaataagtaaagaactaggtggacggaggtccctacgaagggtactccccgtaggacgtacgtagttcccgtcgttcggaccttcccagggtcctacgtaacggggaaactaaaccgtcgttaacaccgtttagacccaaagtccgtagttacgggacgtacccgaaggcgaacgggtaacggggaaccgaggggtaccgtaagtaaccctttagtttaaccggttagttacgaaacgttaccgacggctaaaacgaactaacgtaaaggtttaaactttaacttaacgttttacttttaacggtttacgtttaccgtttacggttacgttaacggtacgggtaccggttaacggttacccgtaaccggtttaccgttacggtacgtacccgaaccgtaaaccgtaccccgaaacccg

SEQ ID NO: 415111 - DNA, 496 bp, Homo sapiens
  misc_feature: GZ8MTXP01ASO0O.17.36.D03.1.454.CMB.2.raw
  modified_base (204)..(204): a, c, t, g, unknown or other
  modified_base (471)..(471): a, c, t, g, unknown or other
  modified_base (492)..(492): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagagtgttagcagctacttagcctggtaccaacagaaacctggccagtctcccaggctcctcatctatgatgcatccaacagggccactggcatcccagccaggttccagtggcaggtgggtctggggcagacttcattctcaccatcagcagcctagagcctgaagtatttgctagtttattactggtcagcagcgtagcaactggctcatcaccttcggcaagggacacgacgtggagnttgaaacgactgtagcttgcnctaa

SEQ ID NO: 415112 - DNA, 509 bp, Homo sapiens
  misc_feature: GZ8MTXP01BRJX4.17.36.D03.1.454.CMB.2.raw
  modified_base (204)..(204): a, c, t, g, unknown or other
  modified_base (306)..(306): a, c, t, g, unknown or other
  modified_base (477)..(477): a, c, t, g, unknown or other
  modified_base (509)..(509): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccacctctcctgcagggccagtcagagtgtagcagctattagcctggtaccaacagaaacctggccagtctcccagctctcatctatgatgcatccaacngggccactggcatcccagccaggttccaggtggcaggtgggtctggggcagactttcattcctcacatcagcagcctagagcctgaagtatttgctagtttattactggtcagtcagcgtagcaacgtggctcacttccaccttcggccaaggggacacggactgggaagnttacggaaacacgtgtggacttgccaaccgtn

SEQ ID NO: 415113 - DNA, 526 bp, Homo sapiens
  misc_feature: GZ8MTXP01CD4RI.17.36.D03.1.454.CMB.2.raw
  modified_base (204)..(204): a, c, t, g, unknown or other
  modified_base (370)..(370): a, c, t, g, unknown or other
  modified_base (489)..(489): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaangccaccctctcctgcagggccagtcagagtgttagcagctacttagcctggtaccaacagaaacctggccagtctcccaggctcctcatctatgatgcatccaacagggcccatggcatcccagccaggttccaggtggcagtgggtactgggcagacttcattcncaccatcagcagcctagagcctagaagtatttgctagtttattacgtggtacagtcagcgtacgctaactcggctcgatccaaccgttcggaccaaggggtacacggacgtgggaacgnttacggaaacgacgtggtacggcttacgcaaccgtaa

SEQ ID NO: 415114 - DNA, 559 bp, Homo sapiens
  misc_feature: GZ8MTXP01CGQ99.17.36.D03.1.454.CMB.2.raw
  modified_base (378)..(378): a, c, t, g, unknown or other
tcagcgtagactagcacgaccggtgctcgatttagctgcgtcacgatctctcttggggctcagagaggtgccttagccctggattccaaggcatttccacttggtgatcagcactgaacacagaggactcaccatggagttggggctgtgctgggttttcctgttgctattttagaggtgtccagtgtgaggtgcagctgggtggagtcgtgggggaggcttggtaccgccgtggggggtccctgagactctcctgtagagcctcgtggatcgccttcacgtacctacagcatgaacgtcggggtccgccgagggttccgagggggaagggtcgtgggaggtgggttgcatacattagtagtagtgtatagtccaatntactacgctagactcgtgtagaaacgccgtaattcacctatcctacaagacgacagtcaccaagactcactgtactcctagactaaagtgaaacacgtccgtaagacgaacgaacgacacgggtcttggtacgttagttacgttggttcgaacggagaacgtactcccgagtcgcgtaagg

SEQ ID NO: 415115 - DNA, 615 bp, Homo sapiens
  misc_feature: GZ8MTXP01EPYGX.17.36.D03.1.454.CMB.2.raw
  modified_base (204)..(204): a, c, t, g, unknown or other
  modified_base (403)..(403): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtcttgtcgtccgggggaaanagccacctctcctgcagggccagtcagagtgtagcagctactagcctggtaccaacagaaacctggccagtctcccaggctcctcatctatgatgcatccaacagggccactggcatcccagccagttcccagtggctaggtgggtctgggaacagtacttcattcctcacactcagcagcctagagtcctagtaagtntttgcgtagttttaattacttggggtactagactacggacgttaacgactaaaccggttggccctacgaacttccccgtaacccggtttccggggaacccgttaaacggggggtaccaaccgggtaaaccgtcggggttaaaacgttagttaacggtaaaacccgggtaagttcggggtcggggtccttacgggcccttaaacccggttccg

SEQ ID NO: 415116 - DNA, 540 bp, Homo sapiens
  misc_feature: GZ8MTXP01ALXW5.17.36.D03.1.454.CMB.2.raw
  modified_base (203)..(203): a, c, t, g, unknown or other
  modified_base (212)..(212): a, c, t, g, unknown or other
  modified_base (407)..(407): a, c, t, g, unknown or other
tcagcgtagactagcacgaccggtgctcgatttagctgcgtcacgatctctcttgggggaggaactgctcagttaggacccagagggaactatggaagccccagctcagcttctcttcctcctgctactctggctcccagataccaccggagaaattgtgttgacacagtctccagccaccctgtctttgctccgggggaaangccacctcnctgcagggccagtcagagtgttagcagctacttagcctggtaccaacagaaacctggccagtctcccaggctcctcatctatgatgcactccaacacgggccactcgtccatccccagccaggttccaggtggcaggtcgggtctggggaacagtacttcattctcaccatcagcagcctagagcctagaagttnttgacttagtttatacgtggtcagcagtacgtgactacgtcgtctcactccgtaccgtcggaccgaagggaccacggtacgtaggacgacgttacggaaacgtgtcgggtcgccttcgaaccgttaacgtccg

SEQ ID NO: 415117 - DNA, 524 bp, Homo sapiens
  misc_feature: GZ8MTXP01A83CJ.17.36.D03.1.454.CMB.2.raw
  modified_base (324)..(324): a, c, t, g, unknown or other
  modified_base (335)..(335): a, c, t, g, unknown or other
  modified_base (364)..(364): a, c, t, g, unknown or other
  modified_base (402)..(402): a, c, t, g, unknown or other
  modified_base (444)..(444): a, c, t, g, unknown or other
  modified_base (504)..(504): a, c, t, g, unknown or other
tcagcgtagactagcacgaccggtgctcgatttagctgcgtcacgatctctcttggggctcagagaggtgccttagccctggattccaaggcatttccacttggtgatcagcactgaacacagaggactcaccatggagttggggctgtgctgggttttccttgttgctattttagaaggtgtccagtgtgaggtgcagctgggtggagtcgtgggggagcttggtaccgccgtggggggtccctgagactctcctgtagagcctctggattcgccttcagtacctacagcatgaactgggtccgccaggttccagggaggtcngggagtgggtncatacagttagagtagtgatagttccatntactacgcagactctgtagaagcgattcacatctacanagacagtgaccaagaactcgactgtactctgacaaatgaacngtaccttaagacgacgaacgaacgacgggtacttgtagttattacgttggttcggcgagngaacgtccgcgtgcgtaagg

SEQ ID NO: 415118 - DNA, 513 bp, Homo sapiens
  misc_feature: GZ8MTXP01EY9G7.17.36.D03.1.454.CMB.2.raw
  modified_base (204)..(204): a, c, t, g, unknown or other
  modified_base (308)..(308): a, c, t, g, unknown or other
  modified_base (416)..(416): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagcccaccctgtctttgctccgggggaaangccaccctctcctgcagggccagtcaggagtgtagcagctacttagcctggtaccaacagaaacctggccagtctcccaggctcctcatcatgatgcatccaangggccacgtggcatcccagccaggttccaggtgcagtgggtctgggaacagcttcattctcacatcagcagcctagcgctagagtatttgctagtttatactgtcagnagcgtagcaatggctgactcgacctcggacgaaacgggacacgtactggacgagttacgaaagtaaccgtggttcgggcttacggccgaacctaacg

SEQ ID NO: 415119 - DNA, 566 bp, Homo sapiens
  misc_feature: GZ8MTXP01BOQJO.17.36.D03.1.454.CMB.2.raw
  modified_base (259)..(259): a, c, t, g, unknown or other
  modified_base (264)..(264): a, c, t, g, unknown or other
  modified_base (340)..(340): a, c, t, g, unknown or other
  modified_base (531)..(531): a, c, t, g, unknown or other
tcagcgtagactagcacgaccggtgctcgatttagctgcgtcacgatctctcttggggctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggagcgttggtaccgccgtgggggtccctgagctctcctgtagngcctntggatcgccttcagtacctacagcatgaacgtgggtcccgcgaggttccgaggggaagggtcgtgggagtgggttncatactattagtagtagtgatagttaccataatactacgcagtactcgtgtacgaaacggtccgtattcaacctatccgtaccagagacagtacgacaaacgactcacttgtactactagaccaaagtgaaacagtacccgttaaggaacgacccggaaacgtaacgacggtcgttgtagttactttacgnggttcgaacgagtaagtacgtccgctcgcgtaagg

SEQ ID NO: 415120 - DNA, 674 bp, Homo sapiens
  misc_feature: GZ8MTXP02J37O0.17.36.D03.1.454.CMB.2.raw
  modified_base (200)..(200): a, c, t, g, unknown or other
  modified_base (202)..(202): a, c, t, g, unknown or other
tcagcgtagactagcacgaccggtgctcgatttagctgcgtcacgatctctcttggggaggaactgctcagttaggacccagagggaaccatggaagccccagctcagcttctcttcctcctgctactctggctcccagataccaccggagaaattgtgttgacacagtctccagccaccctgtcttgctccggggaaancnccacctctcctgcgacggccagtcagtagtgtagcagtctactacgcctagtaaccaacacgaacctggaccacgtcctccgagcctcctacatctatgatcgacaactacccgaacgacgggcccacgtcggaccactcccgacgccgtaggttcccgagggtcggacgtagggttcgggtacgtacggggacctacgtaccttctactttccaccaacctacgtaccaacgaccaacgtaccgtaaggacgtaccgttaagtaaagtttacgttttacggtactttaagttttacttacgtcgtacgtacgtacgtacggtacgtacgtaccgtaacgtacgtaccgtacctaccgtaccgtacccgttaccggtaaccggaaaccggaaccgaaccgtaacggtacggaacgtaacgtaaacggtaaacggtaaacgtacggtacggtacgtaccgtaccgtacctacg

SEQ ID NO: 415121 - DNA, 497 bp, Homo sapiens
  misc_feature: GZ8MTXP02FH0LD.17.36.D03.1.454.CMB.2.raw
  modified_base (204)..(204): a, c, t, g, unknown or other
  modified_base (366)..(366): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagagtgttagcagctacttagcctggtaccaacagaaacctggccagtctcccaggctcctcatctatgatgcatccaacagggccactggcatcccagccaggttccagtggcagtgggtctggggacagacttnattctcaccatcagcagcctagagcctgaagtattttgctagtttattactgtcagcagcgtagcaactggctcatcaccttcggaccaagggacacgactggagatagaaacgaactgtggctgcactac

SEQ ID NO: 415122 - DNA, 558 bp, Homo sapiens
  misc_feature: GZ8MTXP02FV8AC.17.36.D03.1.454.CMB.2.raw
  modified_base (204)..(204): a, c, t, g, unknown or other
  modified_base (311)..(311): a, c, t, g, unknown or other
  modified_base (353)..(353): a, c, t, g, unknown or other
  modified_base (364)..(364): a, c, t, g, unknown or other
  modified_base (369)..(369): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagagtgttagcagctacttagcctggtaccaacagaaacctggccagtctcccagctcctcatctatgatgcatccaaacngggccacgtggcatcccagccaggttccagtgcagtgggtcngggcagacttnattcncaccatcagcagcctagagcctgaagtattttgactagtttattactgtacagtcagcgtagctaacgtggacttcaactccgtaaccgtttaccgggaccgaaacgggggaccaaaccggtaacgttacgggaaagtacgttaacggaaaacggtaaaccgtggtacgggctacggacctaaccgtac

SEQ ID NO: 415123 - DNA, 724 bp, Homo sapiens
  misc_feature: GZ8MTXP02G5FNQ.17.36.D03.1.454.CMB.2.raw
  modified_base (201)..(201): a, c, t, g, unknown or other
  modified_base (257)..(257): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccacctgtctttgctccggggaaangccaccctctcctgcagggccagtcagagtgtagcagctattagcctggtaccaanagaacctggccagtctccagctcctcatctatgatgcataccaacgacgggaccacgtcggaccacgtaccccaggccccgtaggttaccccagggttcggccgtaaggggttcggggtaccgtagggggacctaggttaaccgtttccaacgtttccctaccaaccctattaccgaacggacctacggacccgttaaggaccgtacccttaagggtaaacgttagtttttacggaccgtttaaaggtttttaaactttacgtttacggtaccgtaacggtaccgaacgggtacccggttaagaccgtaaacggttcgggaccttaccgtacgttaccctaacccggtttaccgggaacccgtaaacgggggaaccctaaccggaaccggtacgggggtaaaacgtaacggtaaacggtaaaaccggtacggttacggtaccggtacgtaccgtaccgtaacctacg

SEQ ID NO: 415124 - DNA, 510 bp, Homo sapiens
  misc_feature: GZ8MTXP02JRHG0.17.36.D03.1.454.CMB.2.raw
  modified_base (203)..(203): a, c, t, g, unknown or other
  modified_base (308)..(308): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccggggaaangccaccctctcctgcagggccagtcagagtgttagcagctacttagcctggtaccaacagaaacctggccagtctcccaggctcctcatctatgatgcatccaanagggccatggcatcccagccaggttccagtgcaggtgggtctggggcagacttcattctacaccatcagcacgcctagagcctagaagtatttgctagtttatactgtcagtcagcgtagcgaacgtggctcactcacccgttcggaccgaagggaccacgacgtaggacgatacgaaacgactggtcgactcgacactacg

SEQ ID NO: 415125 - DNA, 518 bp, Homo sapiens
  misc_feature: GZ8MTXP02GAM6N.17.36.D03.1.454.CMB.2.raw
  modified_base (204)..(204): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaangccaccctctcctgcagggccagtcagagtgttagcagctacttagcctggtaccaacagaaacctggccagtctcccaggctcctcatctatgatgcatccaacagggccatggcatcccagccaggttcccagtggcaggtgggtctggggcaggacttcattcctcaccatcagcagcctagagcctgaagtattttgctagtttattactgtactagcagcgtagcaactggctcactcaacccttcggacccgaaagggaccaacgacgtaggaacgagtagaaacgaactgtcggctcggacacgtac

SEQ ID NO: 415126 - DNA, 515 bp, Homo sapiens
  misc_feature: GZ8MTXP02H851G.17.36.D03.1.454.CMB.2.raw
  modified_base (203)..(203): a, c, t, g, unknown or other
  modified_base (307)..(307): a, c, t, g, unknown or other
  modified_base (359)..(359): a, c, t, g, unknown or other
  modified_base (388)..(388): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccacctgtctttgtctccgggggaaangccacctctcctgcagggccagtcagagtgttagcagctacttagcctggtaccaacagaaacctggccagtctcccaggctcctcatctatgatgcatccaanagggccatgcatcccagcaggtccagtgcagtggtctgggcagcttcattcncaccatcagcagcctagacgctagaagtntttgctagtttattactgtcagtcagcgtagacaacgtgactcatcaaccgttcggaccgaaagggacacggactacggagtaagtacggaaaacgtacgtaggtacggactacggaccaacctacg

SEQ ID NO: 415127 - DNA, 520 bp, Homo sapiens
  misc_feature: GZ8MTXP02HD00G.17.36.D03.1.454.CMB.2.raw
  modified_base (262)..(262): a, c, t, g, unknown or other
  modified_base (310)..(310): a, c, t, g, unknown or other
  modified_base (374)..(374): a, c, t, g, unknown or other
  modified_base (380)..(380): a, c, t, g, unknown or other
  modified_base (443)..(443): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccggggaaagagccaccctctcctgcagggccagtcagagtgttagcagctacttagcctggtaccaanagaaacctggccagtctcccaggctcctcatctatgatgcatccaaangggccacgtggcactcccagccaggttcccagtgcaggtgggtctggggacagacttcatttcncaaccntcagcagcctagacgcctagaacgtattttgactagtttattactgttacgagcaaggcgtancgaactggcttcatcaaccttcggaccgaagggactacgactggagatagaaaacgacgtgtacggctgaccactag

SEQ ID NO: 415128 - DNA, 544 bp, Homo sapiens
  misc_feature: GZ8MTXP02H9QZ5.17.36.D03.1.454.CMB.2.raw
  modified_base (202)..(202): a, c, t, g, unknown or other
  modified_base (210)..(210): a, c, t, g, unknown or other
  modified_base (285)..(285): a, c, t, g, unknown or other
  modified_base (291)..(291): a, c, t, g, unknown or other
  modified_base (303)..(303): a, c, t, g, unknown or other
  modified_base (373)..(373): a, c, t, g, unknown or other
  modified_base (497)..(497): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccacctgtctttgctccgggggaaangccacctntcctgcagggccagtcagagtgttagcagcttacttagcctggtaccaacagaacctggccagtctcccagctcnatctangatgcatccaangggccactggcactccccagccaggttccaggtggcagggtgggtctggggacaggtacttcgatttccncaacatccagcagcctaaggacgtctagaagtattttgacttagtttattacgtgtactagcagacgtagaccaagtgctacatccaccgttcggaccgtaaggacctacggactacggggaanacgtaacggaaaacgtaacgttggacggtactacggacctacctacg

SEQ ID NO: 415129 - DNA, 512 bp, Homo sapiens
  misc_feature: GZ8MTXP02GDVTG.17.36.D03.1.454.CMB.2.raw
  modified_base (202)..(202): a, c, t, g, unknown or other
  modified_base (288)..(288): a, c, t, g, unknown or other
  modified_base (369)..(369): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgctccggggaaangccaccctctcctgcagggccagtcagagtgttagcagctacttagcctggtaccaacagaaacctggccagtctcccaggctccncatctatgatgcatccaacagggccactggcatcccagccaggttccagtggcaggtgggtctggggcagacttcattccncaccatcagcagcctagagcctgaagtatttgactagtttatactgtcagcagctagcaactggctacatcctaccgttcggaccgaaagggaccacgacgtcggacgatacggaaacgacttaggacggctacgacacctag

SEQ ID NO: 415130 - DNA, 601 bp, Homo sapiens
  misc_feature: GZ8MTXP02H13HH.17.36.D03.1.454.CMB.2.raw
  modified_base (206)..(206): a, c, t, g, unknown or other
  modified_base (264)..(264): a, c, t, g, unknown or other
  modified_base (297)..(297): a, c, t, g, unknown or other
tcagcgtagactagcacgaccggtgctcgatttagctgcgtcacgatctctcttgggggaggaactgctcagttaggacccagagggaaccatggaagcccccagctcagcttctcttcctcctgctactctggctcccagataccaccggagaaattgtgttgacacagtctccagcccaccctgtctttgtctccgggggaaanacgccaccctctcctgcagggccagtcagagtgtagcagctacttgcctggtaccaanagaacctggccagtcctccgagctctcatctangatgcataccaacgagggcccagtcggcatccccgagcccgaggttcccaggtcggacgtagggtcggggtctaggggaccaggtaccttctacttcctacacctatccagacagcctaggacgtctaggaattactttgacttaaggtttattacgtgttacagtacacgggccgtagaacctaagtcggaccttacaacttccgtaacccgttcggaaacccggtaaagggaccaacgggacgtaggggaactaacgaacggaaaaccggacgtttagggtacgctaccggacctaaccgtg

SEQ ID NO: 415131 - DNA, 531 bp, Homo sapiens
  misc_feature: GZ8MTXP02H2ZK2.17.36.D03.1.454.CMB.2.raw
  modified_base (375)..(375): a, c, t, g, unknown or other
  modified_base (414)..(414): a, c, t, g, unknown or other
tcagcgtagactagcacgaccggtgctcgatttagctgcgtcacgatctctcttggggctcagagaggtgccttagccctggattccaaggcatttccacttggtgatcagcactgaacacagaggactcaccatggagttggggctgtgctgggttttccttgttgctattttagaggtgtccagtgtgaggtgcagctggtggagtcgtgggggaggcttggtaccgccgtgggggtccctggagactctcctgtagagcctctggattcgccttcacgtacctacagcatgaactgggtcccgcgaggttccgaggggaagggtcgtgggaggtgggttgactatacattagtagtagtgattagttccatntactagcagactcgagtagaaagcatcactatctcaganacagtgacaagaactcacttgtatctagacaaatgaaacagtccttaaggacgaacgacgacgacggtctaggtagttactacgtgtacgaacgagacgtactccgctcgacgtagg

SEQ ID NO: 415132 - DNA, 549 bp, Homo sapiens
  misc_feature: GZ8MTXP02JOG8T.17.36.D03.1.454.CMB.2.raw
  modified_base (203)..(203): a, c, t, g, unknown or other
  modified_base (212)..(212): a, c, t, g, unknown or other
  modified_base (258)..(258): a, c, t, g, unknown or other
  modified_base (273)..(273): a, c, t, g, unknown or other
  modified_base (283)..(283): a, c, t, g, unknown or other
  modified_base (357)..(357): a, c, t, g, unknown or other
  modified_base (376)..(376): a, c, t, g, unknown or other
  modified_base (417)..(417): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccggggaaangccaccctntcctgcagggccagtcagagtgttagcagctactagcctgtacaanagaacctggcagtcnccagctcctnatctatgatgcatccaagacgggccactggcatcccagcaggtccagtgcaggtggctgggcagtcttcattcncaccatcagcagctagacnctagaagtactttgacttagtttattacgtgttacacgtanaggtacgtacacgtaacgttggacctacgacttccgacccgtttaccggaccgaaacgggaccgaccgtacgtaggaacgaagttaacggaaaacgtaaacgtggtacggtaccgtcgaccgtaccgtaacg

SEQ ID NO: 415133 - DNA, 535 bp, Homo sapiens
  misc_feature: GZ8MTXP02I3S78.17.36.D03.1.454.CMB.2.raw
  modified_base (201)..(201): a, c, t, g, unknown or other
  modified_base (287)..(287): a, c, t, g, unknown or other
  modified_base (305)..(305): a, c, t, g, unknown or other
  modified_base (357)..(357): a, c, t, g, unknown or other
  modified_base (372)..(372): a, c, t, g, unknown or other
  modified_base (385)..(385): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtcttgtctccggggaangccacctctcctgcagggccagtcagagtgttagcagctacttagcctggtaccaacagaaacctggccagtctcccaggctcctnatctatgatgcatccaangggcccactggcatccccagccaggttccagtggcaggtgggtctggggacngacttcattctcacntcagcagcctagngcctagaagtatttgactagtttattactgtctagcagcgtagctaacgtcggctctactctacccgttcggaccgtaaaacggggccaacggacgtgggaacgagttaacggaaaacgtaacgttggtacggctacggacctaacctac

SEQ ID NO: 415134 - DNA, 523 bp, Homo sapiens
  misc_feature: GZ8MTXP02F2XEY.17.36.D03.1.454.CMB.2.raw
  modified_base (204)..(204): a, c, t, g, unknown or other
  modified_base (393)..(393): a, c, t, g, unknown or other
  modified_base (403)..(403): a, c, t, g, unknown or other
  modified_base (429)..(429): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaangccaccctctcctgcagggccagtcagagtgttagcagctacttagcctggtaccaacagaaacctggccagtctcccagctcctcatctatgatgcatccaacagggccactggcactcccagccaggttcccagtggcaggtgggtctggggacagacttcattcctacacctatcagcagcctagngcctagagtntttgactagtttatactgtcagcagngtacgcacgtgactcatccaccgttcggaccgtaaagggacctacgacgtaggaagtagtaacggaaacgaacgttggacggctcgacaccgta

SEQ ID NO: 415135 - DNA, 656 bp, Homo sapiens
  misc_feature: GZ8MTXP02HQ16N.17.36.D03.1.454.CMB.2.raw
  modified_base (210)..(210): a, c, t, g, unknown or other
  modified_base (271)..(271): a, c, t, g, unknown or other
  modified_base (283)..(283): a, c, t, g, unknown or other
  modified_base (291)..(291): a, c, t, g, unknown or other
  modified_base (297)..(298): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagcccacccttgttctttgtccgtaccgggggaaanacgccaccctctccgtgcgagggccagtcagagtgttagcagctactagcctaggaccaanagaactgcatcnccagctcnatctannatcgcataccaagacgggccagtcggcactacccgagccgtaggttcccagtacggctagggtggtctaggggactacggtaccttcgtacctttccgtaccgaaccttagtaccgagaccacgtaccgtaacggtacgtacccgtaaggtaaacgtttagtttacgacgttaaaggtttttaaacttccgttaagtacgttaaggccttaaggggtactaaacggtacctaaacggtggtaccttacaacgtttcccgaaacccggtttcgaacccggttaaagggaccgttacgaggtacggaacgtagtaaccgaaaacgtacgtacgttggaccttacggaccttaacgtaccg

SEQ ID NO: 415136 - DNA, 564 bp, Homo sapiens
  misc_feature: GZ8MTXP02FU80U.17.36.D03.1.454.CMB.2.raw
  modified_base (205)..(205): a, c, t, g, unknown or other
  modified_base (281)..(281): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaancgccaccctctcctgcagggccagtcagagtgttagcagctacttagcctggtaccaacagaaacctggccagtcncccagctcctcatctatgatgcatcccaaagcgggccacgtggcactccccagccaggttccagtcggacaggtggggtctggggacagtacttcgacttctacaccatcacgcagacctagacgcctagaagtatttgacttagttttacttacgtgtactagcgagtcgtaacgcaacgtcggtactacgactccgtaccgttacggacccgaaagggaccaacggacgtacgggaatacgtaacggaaaaccgtacgtggtacggctacgacctactacg

SEQ ID NO: 415137 - DNA, 543 bp, Homo sapiens
  misc_feature: GZ8MTXP02H4FVY.17.36.D03.1.454.CMB.2.raw
  modified_base (205)..(205): a, c, t, g, unknown or other
  modified_base (279)..(279): a, c, t, g, unknown or other
  modified_base (291)..(291): a, c, t, g, unknown or other
  modified_base (309)..(309): a, c, t, g, unknown or other
  modified_base (353)..(353): a, c, t, g, unknown or other
  modified_base (364)..(364): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagcccaccctgtctttgtctccgggggaaanagccaccctctcctgcagggccagtcagagtgttagcagctacttagcctggtacaacagaaacctgccagtcncccaggctcctnatctatgatgcatccaangggccactggcatcccagccaggttccagtgcagtggctgggcngacttcattcncacatcagcagcctagagacctgaagtattttagctagttttattacttgtactagctagtcgtacgcgaaactcggactcgattccgtaacccgtttcgggaccctaaacggggaccaaccggtaactcgggaagaagtaacggaaaacgaacgtaggtcgacgtacggaccacgtac

SEQ ID NO: 415138 - DNA, 564 bp, Homo sapiens
  misc_feature: GZ8MTXP02JECKH.17.36.D03.1.454.CMB.2.raw
  modified_base (205)..(205): a, c, t, g, unknown or other
  modified_base (295)..(295): a, c, t, g, unknown or other
  modified_base (475)..(475): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaanagccaccctctcctgcagggccagtcagagtgttagcagctacttagcctggtaccaacagaaacctggccagtcctcccaggcctcctnatctatgatgcatccaacgagggccactggcactcccagccgaggttccaggtcggcaggtgggtccgtggggaccaggtacctttcgactttcctacaacccattacacgaccaacgtccgtaaggacgaccctaggaaagttacttttgacttagttttatactgtcagcagacgtancaacttgctacatcaccgttacgacgaagggaccacggactcgggaaagactaaggaaaacgtacgttggacggctacggaccacgtac

SEQ ID NO: 415139 - DNA, 689 bp, Homo sapiens
  misc_feature: GZ8MTXP02GHFBO.17.36.D03.1.454.CMB.2.raw
  modified_base (207)..(207): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagcccaccctgtctttgtccgtccgggggaaancgcccaccctctcctgcagggccagtcagagtgttagcagctacttagcctggtaccaacagaaacctggccagtcctcccgaggcctcctcatctatgatgacactaccaacgacgggcccacgtcggacctactccccgagcccgtaaggttcccaggtcggcgtaaggggttcggggttccgtgggggacctaggtacctttacgtaactttccctaccacctatacccgaagtaccaacggtacccgtaaaggacgtaccctaaggtaaagttaacgtttttcggactttaaacggtttttaacttaccgttgttaaccgtaggtacccgtaagggtcgttaaacggaccgtaacgtcgggtaccttctacgtaccccgtaccgtttacccgggacccgaaaggggtaccctaaacgggacgttagggaacgtaacgtaacgaaaacgtcgtaggtacggctacggacctacccgtag

SEQ ID NO: 415140 - DNA, 578 bp, Homo sapiens
  misc_feature: GZ8MTXP02F2CUZ.17.36.D03.1.454.CMB.2.raw
  modified_base (206)..(206): a, c, t, g, unknown or other
  modified_base (291)..(291): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtaccgggggaaanagccaccctctcctgcagggccagtcagagtgttagcagctactagcctggtaccaacagaaacctggccagtctcccagctccnatctatgatgcatccaagcggccagtggcatcccagccaggttccagtcgcaggttggctaggggacagtacttcatttccacaccatcagcacgcctagagcctagtaacgtattttgacttagtttattactagtacgagtcgtacggtacgtacgtaccgaacgtcggtctactactacccgtaccggtttaccgggaaccgaaaacgggtaccaaacggtacgtacgggaaacgtaacgtaaacggaaaacgtacgtacggtacggactacggaccaactacg

SEQ ID NO: 415141 - DNA, 540 bp, Homo sapiens
  misc_feature: GZ8MTXP02JU09A.17.36.D03.1.454.CMB.2.raw
  modified_base (203)..(203): a, c, t, g, unknown or other
  modified_base (263)..(263): a, c, t, g, unknown or other
  modified_base (376)..(376): a, c, t, g, unknown or other
  modified_base (400)..(400): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccggggaaanagccaccctctcctgcagggccagtcagagtgtagcagctacttagcctaggtacccaanagaaacctggcccagtcctcccaggctcctcatctatgatgcatccaacgacgggccagtggcactccccgagcctaggttccaggtggctaggtgggtctggggcagtactnattctccactatcagcagcctagngcctagaagtatttagcttaagtttacttactggtacagtcagtacgtagcgtaacgtggtctacatcctaccgttacggaccgaaagggacctacgacggtggaacgtataggaaacgacgtgtacgcgtcgacacctg

SEQ ID NO: 415142 - DNA, 718 bp, Homo sapiens
  misc_feature: GZ8MTXP02JP1IM.17.36.D03.1.454.CMB.2.raw
  modified_base (206)..(206): a, c, t, g, unknown or other
  modified_base (292)..(292): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgttctttgtcgtccgggggaaancgccaccctctcctgcagggccagtcagagtgttagcagctacttagcctaggtaccaacagaacctggccagtctcccagctccncatctatgatcgacatacccgaaacgcgggcccacgtcggaccacgtaccccgagccgtaggttcccagggttcggaccgtaagggttcggggtacgttacggggacctacggtaacctttacgaactttcccgaacctaaccctaattcccgaacggcctaacggtacccgttaaaggacccgtacctaaggtaaacgtttacgtttttacgaccgtttaaggtttttaacttaacgtcggttaaccgacggtaccgtaacgggtaccgttaaacgaccgtaaacggttcgggtacctttaccggaacttcccggtaaccccgttaccgggtaacccggaaaacggggcctaaacggaccggttaggaaacgtaacgtaaacggaaaaccgtacgtagggtacgactacggtaccctaacttcgg

SEQ ID NO: 415143 - DNA, 652 bp, Homo sapiens
  misc_feature: GZ8MTXP02JYQHR.17.36.D03.1.454.CMB.2.raw
  modified_base (205)..(205): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagcccaccctgtctttgtctccgggggaaancgccaccctctcctgcagggccagtcagagtgttagcagctacttagcctggtaacccaacgacgaaacccgtggaccaggtcctacccgaggcctcctacacttctaatgatcgcactcccaaacgcggggacccacgtcggacctactccccgagtcccgtaaggtttcccaagggtcggacgtaggggttcgggtaccgttacggggactacgtacttctattccctacacctatccgagctacgcctagacgtaccgtagtaagttagtttcgacttaagttttactacgtgtacgagtacgaggtaccgagtaccacgtgaccttaccgtactaccgtacccggttaccgggacccgaaacggggtaccaaccggttacgtagggaaacgtacggtaacggaaaaccgtcggtagtacgggacctacggacctacgttaacg

SEQ ID NO: 415144 - DNA, 626 bp, Homo sapiens
  misc_feature: GZ8MTXP02IFXXB.17.36.D03.1.454.CMB.2.raw
  modified_base (205)..(205): a, c, t, g, unknown or other
  modified_base (375)..(375): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgttctttgtctccgggggaaangccacctctcctgcagggccagtcagagtgttagcagctacttagccctaggtaacccaacagaaaccctggacccagtcctcccaggcctcctcatctatgatgcactaccaacgcgggccacgtggccactcccgagccgtaggttcccaggtggctaggtgggtcgnggggacagtaccttcatttccgacaccgatcgagccacgcctaagcgtactgtaaagttcttttagacttagttttattaccgtgtacagtacgtagtaccgttaagacctaacggttcggaccttctaaccttcccaaccccgggtttccggaaacccggaacggggtaaccgtaaacggaacgtaggggaaactacgttaacgggaaaaccgtacgttcgggtacggactaccggtacaacccgtttag

SEQ ID NO: 415145 - DNA, 519 bp, Homo sapiens
  misc_feature: GZ8MTXP02HQED8.17.36.D03.1.454.CMB.2.raw
  modified_base (261)..(261): a, c, t, g, unknown or other
  modified_base (306)..(306): a, c, t, g, unknown or other
  modified_base (368)..(368): a, c, t, g, unknown or other
  modified_base (404)..(404): a, c, t, g, unknown or other
  modified_base (452)..(452): a, c, t, g, unknown or other
tcagcgtagactagcacgaccggtgctcgatttagctgcgtcacgatctctcttggggctcagagaggtgccttagccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtaccgccgtggggggtccctgagactctcctgtagngcctctggattcgccttcagtacctacagcatgaactggggtccnccaggttccaggggaagggtctgggagtgggttgcatacattagtagtagtgatagtccatntactacgcagactctgtgaaagccgattcaccatcnccagagacagtagaccaaagacctcacttgatccgtgacaaatgaacngccttagacgacgacgacgacggctggtagttacttcgtgtgaacgtagacgactccgctcgctagg

SEQ ID NO: 415146 - DNA, 709 bp, Homo sapiens
  misc_feature: GZ8MTXP02FVDTM.17.36.D03.1.454.CMB.2.raw
  modified_base (206)..(206): a, c, t, g, unknown or other
  modified_base (285)..(285): a, c, t, g, unknown or other
  modified_base (302)..(302): a, c, t, g, unknown or other
  modified_base (643)..(643): a, c, t, g, unknown or other
tcagcgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtcgtaccgggggaaanagccaccctctcctggcgagggccagtcagagtgttagcagctacttagcctggtaaccaacagaaacctggccagtcnccagctcctcatctatnatgccatccgaacgacgggccagtcggcacgtaccccagtaccccgtaggttccgagtcggacgtaacggttcggggttccgttaaggggacctaaggttacctttacgaacgttttcccgacctaaaccgtacgttaccgaacggttaccaaacggttacccttacgggaacgttacccgtaggtaaacgttagttttcgacgttagtttttaactacgttagtacgtagaccgtaaggcgtacgtacgaaccggttggtccctactaagtcccgaaccccggtttacggaaacccggaaacggggttaaacctaccgggtaacgttaccgggggaaaancggtttaaaaacggaaaccggttaacgttcggttacgggacgtaccggaacctacccgtttaacgg

SEQ ID NO: 415147 - DNA, 703 bp, Homo sapiens
  misc_feature: GZ8MTXP02HEVL8.17.36.D03.1.454.CMB.2.raw
  modified_base (207)..(207): a, c, t, g, unknown or other
tcagcgtagactagcacgaccggtgctcgatttagctgcgtcacgatctctcttggggggaggaactgctcagttaggacccagagggaaccatggaagccccagctcagcttctcttcctcctgctactctggctcccagataccaccggagaaattgtgttgacacagtctccagcccacctgtctttgtcgtaccgggggaaanacgccaccctctcctgcagggccagtcagagtgttagcagctacttagcctaggtaccaacagaaacctggccagtctcccgaggctcctcatctatgatgcataccaacgagggcccacgtggcactcccagtccctaggttccaggtcggctagggtacgggtcgtcggggactacggtaccttcgaacttcctaccaacccgtactaccgaagtccgaacgtacccgttaaggacgtacccgttaaggggaaatttacgtttttacggacctttaggtttttaaacttaccgtttaggtaccctaaggacgtacggttaccggttaacgacccgtaaacgttcgggtaccttaccgtaacttacccgtaaccccggtttaccggaacccggaaaacgggggtacccaacgggtaccggtaggggaaacgtaaacgttaaacggaaaacccggtaattacggggcgtaaccgttacggaacctacccggttacg

SEQ ID NO: 415148 - DNA, 262 bp, Homo sapiens
  misc_feature: GZ8MTXP02JCN0J.11.41.D08.1.454.CMB.2.raw
  modified_base (261)..(262): a, c, t, g, unknown or other
tcagcgagagataccacgaccggtgctcgatttagtcacgcgagaaagggaagggatatagtggctacaataggccctactacggtatggacgtctgggccaagggaccacggtcaccgtctcctcagcctccaccaagggcccatcggtcttcccctggcaccctcctccaagagcacctctggggcacagcggccctgggctgcctggtcaaggactacttccgtatctctcgctgagcgggctggcaaggcgcatagnn

SEQ ID NO: 415149 - DNA, 265 bp, Homo sapiens
  misc_feature: GZ8MTXP02FV2WU.11.41.D08.1.454.CMB.2.raw
  modified_base (265)..(265): a, c, t, g, unknown or other
tcagcgagagataccacgaccggtgctcgatttagtcacgcgagaaagggaaaggggatatagtggctacaatcggcgctactacggtatggacgtctggggccaagggaccacggtcaccgtctcctcagcctccaccaagggcccatcggtcttccccctggcaccctcctccaagagcacctctggggcacagcggccctgggctgcctggtcaaggactacttccgtatctctcgctgagcgggctggcaaggcgcatagn

SEQ ID NO: 415150 - DNA, 266 bp, Homo sapiens
  misc_feature: GZ8MTXP02HVUAE.11.41.D08.1.454.CMB.2.raw
  modified_base (265)..(266): a, c, t, g, unknown or other
tcagcgagagataccacgaccggtgctcgatttagtcacgcgagaaagggaaaggggatatagtggctacaatcggccctactacggtatggacgtctggggccaagggaccacggtcaccgtctcctcagcctccaccaagggcccatcggtcttccccctggcaccctcctccaagagcacctctggggcacagcggccctgggctgcctggtcaaggactacttccgtatctctcgctgagcgggctggcaaggcgcatagnn

SEQ ID NO: 415151 - DNA, 270 bp, Homo sapiens
  misc_feature: GZ8MTXP02HIH86.11.41.D08.1.454.CMB.2.raw
  modified_base (260)..(260): a, c, t, g, unknown or other
  modified_base (265)..(270): a, c, t, g, unknown or other
tcagcgagagataccacgaccggtgctcgatttagtcacgcgagaaagggaaaggggatatagtggctacaatcggccctactacggtatggacgtctggggccaagggaccacggtcaccgtctcctcagcctccaccaagggcccatcggtcttcccctggcaccctcctccaagagcacctctggggcacagcggcctgggctgcctggtcaaggactacttccgtatctctcgctgagcgggctggcaaaggcganatagnnnnnn

SEQ ID NO: 415152 - DNA, 488 bp, Homo sapiens
  misc_feature: GZ8MTXP01D9UT7.9.76.G10.1.454.CMB.2.raw
  modified_base (427)..(427): a, c, t, g, unknown or other
tcagtgatacgtctcacgaccggtgctcgatttagtcactcatacagggggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataaatggtgtaaaactggtatcagcagctcccgggaaaggctcccaaactcctcatctattatgatgatctgctgccctcagggggttctctgaccgattctctggctccaaaagtctggcacctcagcctcctggccatcagtgggctccagtctgagatgagctgattagttactgtgagcagtgggatgacngcctgaatgcttggattgtcggcggagggccaagctgaaccgtctggttcaagcccgaagg

SEQ ID NO: 415153 - DNA, 529 bp, Homo sapiens
  misc_feature: GZ8MTXP01EEUMY.9.76.G10.1.454.CMB.2.raw
  modified_base (330)..(330): a, c, t, g, unknown or other
  modified_base (364)..(364): a, c, t, g, unknown or other
  modified_base (436)..(436): a, c, t, g, unknown or other
  modified_base (443)..(443): a, c, t, g, unknown or other
  modified_base (470)..(470): a, c, t, g, unknown or other
  modified_base (484)..(484): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtctgggggaggcgtggtccagcctgggaagtccctgagactctcctgtgcagcctctggattcaccttcagtaaccatggcctgcactgggtccgccaggctccaggcagggggctggagtgggtgcacttanatcatatgactggaaattaaaaatactatagacngactccgtgaacgggccgattcacatctccagagacaactaccaagacacgctgttctagcaaagtgaacancctgagngctggaggacacggctgtgttatttcngttgcttacgaagngttagggtgggtacttcgtattcgttgggtaacgttgggttaacc

SEQ ID NO: 415154 - DNA, 553 bp, Homo sapiens
  misc_feature: GZ8MTXP01E0HOM.9.76.G10.1.454.CMB.2.raw
  modified_base (402)..(402): a, c, t, g, unknown or other
  modified_base (438)..(438): a, c, t, g, unknown or other
tcagtgatacgtctcacgaccggtgctcgatttagtcactcatacaggggggtagagaagacaggactcaggacaatctccagcatggcctggtcccctctcttcctcaccctcatcactcactgtgcagggtcctgggcccagtctgtgctgactcagccaccctcggtgtctggagccccccaggcagaggtcaccatctcctgttctggaagcagctccaacatcggacataatggtagtaaactggtatcagcagctcccgggaaaggcctacccaaactcctcatctattatgatgatctgctgcccctcgagggggtctctcgaccgtattcctctggcctccaaagtctggccaccctcacgccctccctggcccatcgagtcgggctccagtcngaggatgaggctgtatttagttacgttggtgggagnagtggggatgacagcctggaatgcgtttgggagtttcgggttcggggcgggacggggaccaagggtccgtacggtaacccgttcgtacgggttactaaccggccccgtaaccggg

SEQ ID NO: 415155 - DNA, 555 bp, Homo sapiens
  misc_feature: GZ8MTXP01D9DH4.9.76.G10.1.454.CMB.2.raw
  modified_base (433)..(433): a, c, t, g, unknown or other
  modified_base (502)..(502): a, c, t, g, unknown or other
  modified_base (511)..(511): a, c, t, g, unknown or other
  modified_base (517)..(517): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtcgtgggggaggcgtggtccagcctgggaagtccctgagactctcctgtgcagcctctggattcaccttcagtaaccatggcctgcactgggtcccgccaggctccaggcagggggactgggagtggggtggcacttatatcatatgaataggaaattaaaaatctaatgacaagactcccggagaacggggccgtattcacctatcctaccgagagaccaactaccaaagaaccncgcttgtttctagacaaagtcgaactagacctgagagctaggacgacgacggcttgtaagttatttcgngttgcctanaagttnttagggtggacttgtattcgttaggaagttcggtaacc

SEQ ID NO: 415156 - DNA, 624 bp, Homo sapiens
  misc_feature: GZ8MTXP01ET8DN.9.76.G10.1.454.CMB.2.raw
  modified_base (227)..(227): a, c, t, g, unknown or other
tcagtgatacgtctcacgaccggtgctcgatttagtcactcatacagggggggtagagaagacaggactcaggacaatctccagcatggcctggtcccctctcttcctcaccctcatcactcactgtgcagggtcctgggcccagtctgtgctgactcagccaccctcggtgtctggacgccccccaggcagaggtcaccatctcctgttctggaagcagctccaanatcggaacataatggtagtaaactggtatcagcagcgtacccgggaaagcctacccaaactcctcatctattatgatgatctgctcgccctgagggttctcgtgaccgtcttctctggcctccaaagtctggccacctcacgtccctcccgtcgccatcgaggtcgggctccgagtcgtaggagagtggaggtctagtatttagttacgtggtaggagtacgtaggtggggtatacggacgtacggtacccgttaggaaagttcggttcggttagggtaagtttcgggggttacggggaacgggggaacggggttacccgaaacgggtcccggttaccggtaaccccgggttaccggtaacggggttcccgtaaccgggaacccccggtaaccgggg

SEQ ID NO: 415157 - DNA, 561 bp, Homo sapiens
  misc_feature: GZ8MTXP01C5VBP.9.76.G10.1.454.CMB.2.raw
  modified_base (488)..(488): a, c, t, g, unknown or other
  modified_base (495)..(495): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtcgtgggggagcgtggtccagcctgggaagtccctgagactctcctgtgcagcctctggattcaccttcagtaaccatcggcctgcacgtgggtcccgccaggcctccgagggcagggggactgggagtgggtgctacttatatcatatgaataggtaaaattaaaatactatagacaagtactccgtagaacgggccattcaccatcctaccgagacgacaactaccaaagaacacgcttgttactagacaaagtcgaaacagcctagagagcgtaggacggacacggtnttggttnttagtttctgttgtctagaagttgttagggtgggtacttgtagtttcgttaggtaacgttcggttc

SEQ ID NO: 415158 - DNA, 549 bp, Homo sapiens
  misc_feature: GZ8MTXP01CN9S8.9.76.G10.1.454.CMB.2.raw
  modified_base (421)..(421): a, c, t, g, unknown or other
  modified_base (449)..(449): a, c, t, g, unknown or other
  modified_base (464)..(464): a, c, t, g, unknown or other
  modified_base (497)..(497): a, c, t, g, unknown or other
tcagtgatacgtctcacgaccggtgctcgatttagtcactcatacagggggggtagagaagacaggactcaggacaatctccagcatggcctggtcccctctcttcctcaccctcatcactcactgtgcagggtcctgggcccagtctgtgctgactcagccaccctcggtgtctggacgcccccaggcagaggtcaccatctcctgttctggaagcagctaccaacatcggacataatggtagtaaactggtatcagcagcgtacccgggaaagcctacccaaactcctacatctattatgatgatctgctcgccctgagggtctcgtcgaccgtacttctcgtggcctaccgaaagttctcggcctacctcaccgtccctccctggccctatcgaggtcggcctccgagtctggagtanggagctagtatttagtacgtggtcggangtagtgggatgacgngtccgtagagtgtagttggtattcggtacgggnggaacggacagtcgtacggtccgtcggtacggttcgaaccggccgtaaccgg

SEQ ID NO: 415159 - DNA, 752 bp, Homo sapiens
  misc_feature: GZ8MTXP01AEG6S.9.76.G10.1.454.CMB.2.raw
  modified_base (214)..(214): a, c, t, g, unknown or other
  modified_base (279)..(279): a, c, t, g, unknown or other
tcagtgatacgtctcacgaccggtgctcgatttagtcactcatacaggggggtagagaagacaggactcaggacaatctccagcatggcctggtcccctctcttcctcaccctcatcactcactgtgcagggtcctgggcccagtctgtgctgactcagccaccctcggtgtctggagcccccaggcagaggtcaccatctcctgttctggaancagctccaacatcggacataatggtataaactggtatcagcagctccgggaagctccaaactccncatctattatgatgatctgctgccctcgagggggtctcgtgaccgtattcctcgtcgggtcctccgtaaaacgttccgttgggacctaaccccgttcgaaccgtcccccgttcccccgttgggacccctaacgttccgtaacgggtttcggggcccttcccggaacggttcccgttagggaacgggtacgtttagggaacggggttccttacgggttaatttaacgggtttaaaccgttcggggtttacggggaaggtacccggtaaagtttcggggggaactttaggtaaacccgagggtaccccgttacgggtaaacgttgggtacccggttttggggtaaacggtttccggggttttaccgggggtaccgggggttaacggggttaacccgaaacgggtcccgtacggtaaccccgggttcccggtaaacggggttcccggaaccggttaaccccgggtaaaccccgggg

SEQ ID NO: 415160 - DNA, 569 bp, Homo sapiens
  misc_feature: GZ8MTXP01A2QKG.9.76.G10.1.454.CMB.2.raw
  modified_base (293)..(293): a, c, t, g, unknown or other
  modified_base (469)..(469): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtcgtgggggaggcgtggtccagcctgggaagtccctgagactctcctgtgcagcctctggattcaccttcagtaaccatggcctgcactgggtccnccaggctccaggcaggggactggagtgggtggctacttagtatcatatgataggtaaattaaaaaatactaatagacaagacgtccgtaggaacgggccgagttacaccactctacagagaaccaactaccaaagaacacgcttacgttcagaccaaagtgaaacagacctgagancgtagacggacgacggtctgttgttatttccgtgttcgtcgtacgaagttgttagggtgggtacttcggtagttccgttagggtaacgttcggttaaccg

SEQ ID NO: 415161 - DNA, 640 bp, Homo sapiens
  misc_feature: GZ8MTXP01BGBB7.9.76.G10.1.454.CMB.2.raw
tcagtgatacgtctcacgaccggtgctcgatttagtcactcatacagggggggtagagaagacaggactcaggacaatctccagcatggcctggtcccctctcttcctcaccctcatcactcactgtgcagggtcctgggcccagtctgtgctgactcagccaccctcggtgtctggagccccccaggcagaggtcaccatctcctgttctggaagcagctccaacatcggacataatggtagtaaactggtatcagcagctacccgggaaagcctacccaaactcctcatctattatgatgatctgctcgccctcgaggggttcctcgtcgacccgtattcctcgtcggtcctacccgaaaagttccgtcgggaccctacccttccgacgtcccctcccgtcgggccccaatccgtaggtcggggcctcccgaggttccgtggagggtagtggaggcttagtaactttagttacgtggttaggagactaggttggggattacggacctaggtcccttaggtaaagttcggtcgtttaggggacgtttcggggttaccggggacggggaacgggttacccaagggtccgttacggaacccgtttccggtacggttaccgtaaccggccccgtaaccgggg

SEQ ID NO: 415162 - DNA, 631 bp, Homo sapiens
  misc_feature: GZ8MTXP01BU6T7.9.76.G10.1.454.CMB.2.raw
  modified_base (253)..(253): a, c, t, g, unknown or other
  modified_base (266)..(266): a, c, t, g, unknown or other
  modified_base (291)..(291): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgcttcttttaagaggtgtccagtgtcaggtgcagctggtggagtcgtgggggagcgtggtccagcctgggaatccctgagactctcctgtgcagcctntggattcaccttnagtaaccatggctgcactgggtccncaggctccaggcagggggactggagtgggtggcacttatatcatatgaataggaaaattaaaaaaatactataagacaaggaccttacccggagaaaggggcccaattacaaccctaattcctacccaaggaaacaaacaaacctaaccaaacgaaacaacgtacgttacgttacgtacgtaacaaacgtaacgaaacgaacgacgtacgaacgacgacgtacggacggtaacgacggtacgtgttaagttagtttcgttgttcgtacgtacgttaaggttaaggttagggttaagggtacgttaacgttacgttacgttacggtaacggttcggtaacg

SEQ ID NO: 415163 - DNA, 674 bp, Homo sapiens
  misc_feature: GZ8MTXP01CP8VD.9.76.G10.1.454.CMB.2.raw
tcagtgatacgtctcacgaccggtgctcgatttagtcactcatacaggggggagaggagcccagcactagaagtcggcggtgtttccattcggtgatcagcactgaacacaaaggactcaccatggagtttgggctgaacttgggttttcctcgttgcttcttttaagaggtgtccagtgtcaggtgcagctggtggagtcgtgggggaggcgtggtccagccgtgggaacgtccctgagactctcctgtgcacgcctctggacttccaccttcagtaacccagtcggcctgcacgtcgggtcccgccgaggcctccgaggcgagggggacgtggaggtgggtgactattatatcaattatagtaagttaaggtaaaatttaaaaaatactaagaacgacaaggtaccctacgggtagggaacgggtcccattacccgactacttaccgaccaagacgaaccctaaactaccgaaaacgacctaacggtctttagttaccttagaactaaagtcgaaaacgtcgtaccgagaagacgacgtacgggaaacggtacgacgggttcttaggtcgtttaagttcgttgggactaccgtagttaacggttggttaacgggttcggggtacgttttcggtacggtttcggtttagggtaacggtttcggggtttaaccc

SEQ ID NO: 415164 - DNA, 646 bp, Homo sapiens
  misc_feature: GZ8MTXP01E102I.9.76.G10.1.454.CMB.2.raw
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgcttcttttaagaggtgtccagtgtcaggtgcagctggtggagtcgtgggggagcgtgtccagcctgggaatccctgagactctctgtgcagcctctggacttcaccttcagtaacccagcggcctgcacgtcgggtccaccgtaggcctccgaggcgagggggactgggagtggggtgctacgttatatcaatatgaagtaaggtaaaattaaaaaatctaataagacaagtacctccggtaaggaacgggtcctacttacgaccctactcctaccaagacgaaaccaacgtaacccaaaggtaacctacgtacttcgtttacagtaactaaaaggtcgaaacaccgaccgtagaagacgtacgtaggacggaccgacggtccgttggttaatttcgtttacgtggttctaaccgtaagaaaggagtttcggggttaagggtaaccctttcggtaagtttcgggttagggtaacggtttcgggtaacccg

SEQ ID NO: 415165 - DNA, 686 bp, Homo sapiens
  misc_feature: GZ8MTXP01D3QXM.9.76.G10.1.454.CMB.2.raw
  modified_base (573)..(573): a, c, t, g, unknown or other
tcagtgatacgtctcacgaccggtgctcgatttagtcactcatacagggggggagaggagcccagcactagaagtcggcggtgtttccattcggtgatcagcactgaacacaaaggactcaccatggagtttgggctgaactgggttttcctcgttgcttcttttaagaggtgtccagtgtcaggtgcagcgtggtggaggtcggtggggggaggcgtggtccagccgtgggaacgtccctgagactctcctgtgcagcctctggtacttcaccttcacgtaaccatcggcctgcacgtgggtcccgccgaggctccgagggcgagggggactgggagtggggtggctacgttatatctagtatgtaataaggtaaaaatttaaaaaagtctaagtacgacaacggtacgtaccggtagggaacggggtccctaagttaccaacctattccaacccgaagaacgtaacccaaactacccgaaactaacctacgtccttagttaccgtagaaacgtaaaacggtacgaaacgaccgtaccaggtacgaggtcgtaagggacgtacgtaccggtnttgggtaattttacgtttcgtagttcggaccttaagggaaagttggtttagggggtaaccggttactttaacggttacgttacggttggggttaacggttcgggttttaaccg

SEQ ID NO: 415166 - DNA, 480 bp, Homo sapiens
  misc_feature: GZ8MTXP02GHR93.9.76.G10.1.454.CMB.2.raw
tcagtgatacgtctcacgaccggtgctcgatttagtcactcatacagggggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtgtaaactggtatcagcagctcccgggaaagctcccaaactcctcatctattatgatgatctgctgccctcaggggtctctgaccgattctctggctccaagttctggcacctcagcctcctggcccatcagtgggctccagtctgaggatgaggctgatttattactgtggagcagtgggatgacagcctgaatgcttggatgttcggcgagggaccaagctgactcaggtcagcccaagg

SEQ ID NO: 415167 - DNA, 524 bp, Homo sapiens
  misc_feature: GZ8MTXP02JK884.9.76.G10.1.454.CMB.2.raw
  modified_base (437)..(437): a, c, t, g, unknown or other
  modified_base (465)..(465): a, c, t, g, unknown or other
tcagtgatacgtctcacgaccggtgctcgatttagtcactcatacagggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtctgggggagcgtggtccagcctgggaagtccctgagactctcctgtgcagcctctggattcaccttcagtaaccatggcctgcactggtccgccaggctccaggcaggggactggagtgggtggcacttatatcatatgatggaaattaaaaatctatgcagactcgtgaaggccgattcaccatctccagagacaactacaacgaacacgctagttctagcaaaatgaaacagcctganagctgagacaggctgtcgtatttcgtgngtactacgaaagagtaaggtggggtaactttcgacgtttcgtagggtagtacgggttcc

SEQ ID NO: 415168 - DNA, 488 bp, Homo sapiens
  misc_feature: GZ8MTXP02GMYI2.9.76.G10.1.454.CMB.2.raw
  modified_base (323)..(323): a, c, t, g, unknown or other
  modified_base (327)..(327): a, c, t, g, unknown or other
  modified_base (346)..(346): a, c, t, g, unknown or other
tcagtgatacgtctcacgaccggtgctcgatttagtcactcatacagggggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtgtaaactggtatcagcagctcccgggaaagctcccaaactcctcatctattatgatgatctgctgcctgagggtctctgaccgnttcntgctcaagtctggcacctnacgccctccgtggccatcagtcggctcagtctgagagtgagctgatttattacgtgtgagcagtgggatgacagcctagagtgacgttggatggttcggcgggacggaccaggcgtcgtaccgtcgtaggtcacgaccacgg

SEQ ID NO: 415169 - DNA, 554 bp, Homo sapiens
  misc_feature: GZ8MTXP02FZJZK.9.76.G10.1.454.CMB.2.raw
  modified_base (404)..(404): a, c, t, g, unknown or other
tcagtgatacgtctcacgaccggtgctcgatttagtcactcatacagggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtcgtgggggaggcgtggtccagcctgggaagtccctgagactctcctgtgcagcctctggattcaccttcagtaaccatggcctgcactggtccgccaggctccaggcaggggactggagtgggtgcacttatatcatatgataggaaattaaaaaatactatgacagtacctccgttagaaacgggccgattcgaccatctccaganacaactacaagaacacgtctacgttactagactaaatacgaacagacctagaacgagactaggaacgacgacggctggtattagtttctggtgtacctacgtaaagataggggtggtacttacgtagttcgtttaggtaggttcgtaccg

SEQ ID NO: 415170 - DNA, 488 bp, Homo sapiens
  misc_feature: GZ8MTXP02FSZ19.9.76.G10.1.454.CMB.2.raw
tcagtgatacgtctcacgaccggtgctcgatttagtcactcatacagggggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtgtaaactggtatcagcagctccgggaaaggctcccaaactcctcatctattatgatgatctgctgccctcgaggggtctctgaccgattctctggctcaagtctggcacctcacgccctccctggcccatcagtgggctcagtctgagatgagctgattattactgtggagcagtgggatgacagcctgaatgcttggatgttcggcggaggaccaaggcgtcggaccgtcgtaggtcacgcccaacgg

SEQ ID NO: 415171 - DNA, 553 bp, Homo sapiens
  misc_feature: GZ8MTXP02JFVD4.9.76.G10.1.454.CMB.2.raw
  modified_base (232)..(232): a, c, t, g, unknown or other
  modified_base (241)..(241): a, c, t, g, unknown or other
  modified_base (283)..(283): a, c, t, g, unknown or other
  modified_base (443)..(443): a, c, t, g, unknown or other
  modified_base (460)..(460): a, c, t, g, unknown or other
tcagtgatacgtctcacgaccggtgctcgatttagtcactcatacaggggggtagagaagacaggactcaggacaatctccagcatggcctggtcccctctcttcctcaccctcatcactcactgtgcagggtcctgggcccagtctgtgctgactcagccaccctcggtgtctggacgcccccaggcagagggtcaccatctcctgttctggaagcagctcaacatcgganataatggtntaaactggtatcagcagctaccgggaagctaccaaactcctnatctattatgatgatctgcctgccctgacggggttctcgtacgtaccgtactttccgtctcggccttaccaaaggttcctgggcctacctcacgtccctccgtaggcctatcgagtcgggctccagtctgaaggctgaggcttagattattactgtggangagtgggatacggaacncgtactagtagtcgtacgttaggtacgtcgggtacgggacggaacgggacaaggccgtacggtacccgttcggtggaccgacggaccgaacgg

SEQ ID NO: 415172 - DNA, 691 bp, Homo sapiens
  misc_feature: GZ8MTXP02GKWF9.9.76.G10.1.454.CMB.2.raw
  modified_base (528)..(528): a, c, t, g, unknown or other
tcagtgatacgtctcacgaccggtgctcgatttagtcactcatacagggggagaggagcccagcactagaagtcggcggtgtttccattcggtgatcagcactgaacacaaaggactcaccatggagtttgggctgaacttgggttttcctcgttgcttcttttaagaggtgtccagtgtcaggtgcagcgtggtggagtcgtgggggagcgtggtccagccgtgggaactccctgacgactctccgtgtgcagcctgtggtacttccaccttcaagtaacccagtcggcctgcctacgtcgggtcccgccgaggcctccgaggggccgagggggtacgtggggaggtggggtcggactaacgtttatactcaatagtagaacgttaaaggtaaaaatttaaaaaatctaatcgactacggtacctcggtagggaacggtccgtaataccaccgtatccgtacccaagaacgaaccaactaccgaaagaacctacgtcttagtttccaagaacctaaagtcgaaaacncgtaccgtagaacggacgcgttagggaaacggacctacgggtacgttaggttatttacgtttggtagttacgaccgttaaacggaaacggttcgttaagggggtaaccggttacttttaacggtaccggttttaggttacgggggtactttacgggtttaacc

SEQ ID NO: 415173 - DNA, 554 bp, Homo sapiens
  misc_feature: GZ8MTXP02JZO8V.9.76.G10.1.454.CMB.2.raw
  modified_base (293)..(293): a, c, t, g, unknown or other
  modified_base (400)..(400): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtcgtgggggaggcgtggtccagcctgggaatccctgagactctcctgtgcagcctctggattcaccttcagtaacccatggcctgcactgggtccnccaggctccaggcgaggggactggaggtggggtggcacttatatcatatgataggaaattaaaaatactatgacagactcggtagagggccattcacatctccaganacaactacaagaacacgctgttctagacaaatagaacagcctagagagcgtaggacgaccgaggactgttagttactttcgtcggtcacgtacgaaagtgtaaggggtcggtaacgttccggtagtttacgttgggtaacggttcggttaaccg

SEQ ID NO: 415174 - DNA, 515 bp, Homo sapiens
  misc_feature: GZ8MTXP02IYXE5.9.76.G10.1.454.CMB.2.raw
  modified_base (416)..(416): a, c, t, g, unknown or other
  modified_base (434)..(434): a, c, t, g, unknown or other
  modified_base (447)..(447): a, c, t, g, unknown or other
tcagtgatacgtctcacgaccggtgctcgatttagtcactcatacaggggggtagagaagacaggactcaggacaatctccagcatggcctggtcccctctcttcctcaccctcatcactcactgtgcagggtcctgggcccagtctgtgctgactcagccaccctcggtgtctggacgcccccaggcagagggtcaccatctcctgttctggaagcagctcaacatcggacataatggtagtaaactggtatcagcagctacccgggaaagcctaccaaactcctcatctattatgatgatctgctgccctgagggtctcgtgaccgtacttctctggtcctcaagttctcggcctacctcacgtccctcctggcccatcgaggtcgggccttaccgagtctgaggatcggagtntagtattagtgtgtgagngtagtggatgacngtctagtagtgtgttggactcgggtacggcggacggacgagcgtacgacgtcgtacgacacgacgacg

SEQ ID NO: 415175 - DNA, 570 bp, Homo sapiens
  misc_feature: GZ8MTXP02H4CJG.9.76.G10.1.454.CMB.2.raw
  modified_base (337)..(337): a, c, t, g, unknown or other
  modified_base (404)..(404): a, c, t, g, unknown or other
  modified_base (409)..(409): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtcgtgggggaggcgtggtccagcctgggaagtccctgagactctcctgtgcagcctctggattcaccttcagtaaccatggcctgcactgggtccgccaggctccgagggcaggggactggagtggggtggctacgttanatcatatgataggaaaactttaaaaaatctaatgacagactccgtaggaaacggccgattcacatcncaganacaactaccaaagaacacgctcgttctagactaaatagaacagacctagaacgagcgtagaacggtacaccgggtcttaggttacgttactttcgtgtcgtactacgaaggtaggtagggtcggtacttacggttacgtttcggtaggtacggttacggtc

SEQ ID NO: 415176 - DNA, 677 bp, Homo sapiens
  misc_feature: GZ8MTXP02I0SCX.9.76.G10.1.454.CMB.2.raw
  modified_base (306)..(306): a, c, t, g, unknown or other
  modified_base (408)..(408): a, c, t, g, unknown or other
tcagtgatacgtctcacgaccggtgctcgatttagtcactcatacagggggggtagagaagacaggactcaggacaatctccagcatggcctggtcccctctcttcctcaccctcatcactcactgtgcagggtcctgggcccagtctgtgctgactcagccaccctcggtgtctggacgcccccaggcagagggtcaccatctcctgttctggaagcagctccaacatcggacataatggtataaactggtatcagcagcgtaccgggaaagcctacccaaactcctcatctattatgatgatcngctcgccctcgagggtcctcgtacgaccgtattcctcgtcggccttaccgaacgtttccgtcggggccctaaacccttccgaccgtcccccgttcccccggngggtaccccctaacgtcccggtaacgggttccggggcccttacccgaagttccgttagggaacggtagttacgggacgggtcttaggttaaattttaacgttacgttggttagggacgtagtaaggtggggaacttagggaacacggtacctaggaacgttcggtacgtttagggtaagtttcgggttacggggacggggtaaacgggtacccgaaaggtccgtaacggtacccggttacgtacggtacccgacggaccccggtaacgg

SEQ ID NO: 415177 - DNA, 716 bp, Homo sapiens
  misc_feature: GZ8MTXP02FTK45.9.76.G10.1.454.CMB.2.raw
tcagtgatacgtctcacgaccggtgctcgatttagtcactcatacagggggggtagagaagacaggactcaggacaatctccagcatggcctggtcccctctcttcctcaccctcatcactcactgtgcagggtcctgggcccagtctgtgctgactcagccaccctcggtgtctgggacgccccccaggccaggagggtcaccatcctcctgttctggaagcagctaccaacatcggacataatggtagtaaactggtatcagcagctacccgggaaaggcctacccaaactccctcatctattatgatgatctgctcgccctgacgggtctcgtcgaccgtatttcctcgtcggtccttaccgaaagttccgtcgggccctaacccgtccgaccgtcccccttcccgtcgggaccctaactccgtacggttccggggccttcccgaaaggtttccgtagggtaaggggtaccgttagggaacgggtccttaagggttaattttaacgtttaaccggtgggttagggtaaacggtccgtaagggttaggggaattacggaacgacggtacccgtaagtaaacgttacggtccgtttaggggaacgtttacggggttcggggaaccgggaaacgggggttaacccaaagggtaacccgtacggtaacccggttacccggtaacgggtacccgaaaccgggaccccgtaaaccgggg

SEQ ID NO: 415178 - DNA, 562 bp, Homo sapiens
  misc_feature: GZ8MTXP02JQRCN.9.76.G10.1.454.CMB.2.raw
  modified_base (291)..(291): a, c, t, g, unknown or other
tcagtgatacgtctcacgaccggtgctcgatttagtcactcatacagggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtctgggggagcgtggtccagcctgggaagtccctgagactctcctgtgcagccctctggattcaccttcagtaaccatggcctgcactgggtccnccaggctccaggcaggggactggagtggggtggctacttatatcatatgaataggaaattaaaaatctaatgacagactccgtaggaacgggccgattcaccatctcagagacaactacaaagacacgctgtttctagacaaatacgaacagtaccctagaagagacgtaggaggaccgacggtctaggttgttagtttctggttcgtactacgtaaacgtgttaggggtcggttacttacggtacgtttcgttgggtagttcggttaccg

SEQ ID NO: 415179 - DNA, 555 bp, Homo sapiens
  misc_feature: GZ8MTXP02HV84Q.9.76.G10.1.454.CMB.2.raw
  modified_base (493)..(493): a, c, t, g, unknown or other
  modified_base (509)..(509): a, c, t, g, unknown or other
tcagtgatacgtctcacgaccggtgctcgatttagtcactcatacagggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtctgggggaggcgtggtccagcctgggaagtccctgagactctcctgtgcagcctctggattcaccttcagtaaccatggcctgcactcgggtccgccaggctccgaggcaggggactggagtggggtggcacttatatcatatgataggaaacttaaaaaatcttaatgactagactccgtagaacgggccgattcaccatctccagacgacaacgtccaaagaacacgcttagttcctgacaaatgaaactagacctagacgagcgtagaggacacggctggtgttattttccgngttgacttcgaaagtnttagggtaagggtaccttcgtagttcgtttaggcgttacggtttcg

SEQ ID NO: 415180 - DNA, 534 bp, Homo sapiens
  misc_feature: GZ8MTXP02IXASR.9.76.G10.1.454.CMB.2.raw
tcagtgatacgtctcacgaccggtgctcgatttagtcactcatacagggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtctgggggaggcgtggtccagcctgggaagtccctgagactctcctgtgcagcctctggattcaccttcagtaaccatggcctgcactgggtccgccaggctccaggcaggggactggagtgggtggcacttatatcatatgataggaaattaaaaatactatgacagactccggtagaacgggcccgattccaccatctccagacgacaactaccaagaacacgctgttctagactaaatgaacacgctagagagctggaacggacacgggctgtgtatttctgtgctacaagtagtaggtaagggtactttcgtatttcgttggagttcggttacc

SEQ ID NO: 415181 - DNA, 486 bp, Homo sapiens
  misc_feature: GZ8MTXP02GSUH9.9.76.G10.1.454.CMB.2.raw
  modified_base (422)..(422): a, c, t, g, unknown or other
tcagtgatacgtctcacgaccggtgctcgatttagtcactcatacaggggggtagagaagacaggactcaggacaatctccagcatggcctggtcccctctcttcctcaccctcatcactcactgtgcagggtcctgggcccagtctgtgctgactcagccaccctcggtgtctggacgcccccaggcagagggtcaccatctcctgttctggaagcagctccaacatcggacataatggtagtaaactggtatcagcagctcccgggaaagctcccaaactcctcatctattatgatgatctgctgccctgaggggtctctgaccgattctctggctccaagtctggcactcagccctcctgccatcagtcggctccagtctgagatgagctgtattatactgtggagcagtgggatgacngcctgaatgcttggattggttcggcggacggactaagcgtgaccgtctaggtcacgccgaacgg

SEQ ID NO: 415182 - DNA, 611 bp, Homo sapiens
  misc_feature: GZ8MTXP02G5FM9.9.76.G10.1.454.CMB.2.raw
  modified_base (214)..(214): a, c, t, g, unknown or other
  modified_base (338)..(338): a, c, t, g, unknown or other
tcagtgatacgtctcacgaccggtgctcgatttagtcactcatacaggggggtagagaagacaggactcaggacaatctccagcatggcctggtcccctctcttcctcaccctcatcactcactgtgcagggtcctgggcccagtctgtgctgactcagccaccctcggtgtctggacgcccccaggcagaggtcaccatctcctgtctggaancagctacaacatcggacataatggtataaactggtatcgagcagccgtacccgggaaagcctacccaaactcctacactctattatgatgatctgctcgccctgagggtctctgacctattccnctcgctaccgagtctcggccacctcgaccgcccctccgtcggaccctatccgacggtcgggcctacccgtagttcctggaggtagtggaggtcgtagttatttattacgttggtggagtacaggttgggaatcgggaacaggtccgtaggtaacgttggtaccgtttgggtacggttcggggttacggggacgggggtaaacgggtaacccgaaaggtccgtaacgggtacccgttacggtacgggtacccgacgggaacccccgtaacgggg

SEQ ID NO: 415183 - DNA, 562 bp, Homo sapiens
  misc_feature: GZ8MTXP02FPG77.9.76.G10.1.454.CMB.2.raw
  modified_base (254)..(254): a, c, t, g, unknown or other
  modified_base (493)..(493): a, c, t, g, unknown or other
  modified_base (509)..(509): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtcgtgggggaggcgtggtccagcctgggaagtccctgagactctcctgtgcagcctntggtattcaccttcaagtaacccatcggcctgcacgtgggtccgccaggcctcgaggcgaggggctgggagtgggtggcacttatatcatatgatagaaattaaaaaatactatgacagacctccggtagaacgggccgtaattccaacctatcctaccaagacgaaccaactaccgaaagaaaccacgtctagttcagacaaatgaaacagacctagacgagacgtggaggacacggntgtgttactttgtgtncttacgaagtagtagggtcggtacttcggtatttcgtaggtaggttcgttacg

SEQ ID NO: 415184 - DNA, 583 bp, Homo sapiens
  misc_feature: GZ8MTXP02HOS9D.9.76.G10.1.454.CMB.2.raw
  modified_base (244)..(244): a, c, t, g, unknown or other
  modified_base (251)..(251): a, c, t, g, unknown or other
  modified_base (290)..(290): a, c, t, g, unknown or other
  modified_base (336)..(336): a, c, t, g, unknown or other
  modified_base (360)..(360): a, c, t, g, unknown or other
  modified_base (432)..(432): a, c, t, g, unknown or other
  modified_base (482)..(482): a, c, t, g, unknown or other
tcagtgatacgtctcacgaccggtgctcgatttagtcactcatacagggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtctgggggaggcgtggtccagcctgggaatccctgagactctcctgtncagcctntggattcaccttcagtaaccatggcctgcactgggtccncaggctccaggcaggggctggagtgggtggctacttatatcagtanggtataggaaaatttaaaaaactntaatgacaggtaccttaccggtagaaacggggccattccaaccatcctaccgaagaacacaaactaccaaanaacgacgtcttagttcctaggactaaaatgaaacagacctagagtaacgngtagacgacgacgcgtagttacttatttcgtgtctactacgaaggtaggttagggttaacggttacttacgttacgtttcggttacggtacgttcggtacg

SEQ ID NO: 415185 - DNA, 617 bp, Homo sapiens
  misc_feature: GZ8MTXP02I691J.9.76.G10.1.454.CMB.2.raw
  modified_base (296)..(296): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtcgtgggggagcgtggtccagcctgggaagtccctgagactctcctgtgcagcctctggattcaccttcagtaaccatggcctgcacgtcggggtcccnccaggcctccgagggccgaggggactgggaggtggggtgctacgttatatcatatgactaggaaaattaaaaatctatgcagactccgtaggaacggccgattcaccctatcctaccagaacacaaactaccaaagaacacgtacttgttacagactaaagtcaaacgacgactagacgtagactaggaacggactaacgggcttaggttacgttaatttccgttgggttacgaccttacgaaaacgggttagttaagggggtaacggttaacgtttccggtaaagttttccggttacggggtaacggtttcgtaacccgg

SEQ ID NO: 415186 - DNA, 617 bp, Homo sapiens
  misc_feature: GZ8MTXP02JC982.9.76.G10.1.454.CMB.2.raw
  modified_base (291)..(291): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtctgggggaggcgtggtccagcctgggaagtccctgagactctcctgtgcagcctctggattcaccttcagtaaccatgcctgcactgggtccnccaggctccgaggcgaggggactggaggtgggtggctacgttatatcatatgaatagaaaattaaaaatactatagacagactccggtagaaacggggtccgaatttcaacctactcctaccaagaagaccaaacgtaccaaaaggaaccaacgtctcgtttactagacctaaaatgaaacgacgtccgtagagagctaggaacggacgacgggtcttggttgtaacgttttcgtaggtactacgttacgaaaacgggtgttaaagggggtcgggttaccgtttaggtaacgtttccggtttaggggacgtttcggggtttaaccg

SEQ ID NO: 415187 - DNA, 604 bp, Homo sapiens
  misc_feature: GZ8MTXP02HC6UF.9.76.G10.1.454.CMB.2.raw
  modified_base (342)..(342): a, c, t, g, unknown or other
  modified_base (523)..(523): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtcgtgggggagcgtggtccagcctgggaatccctgagactctcctgtgcagcctctggacttcaccttcaacgtaaccatcggcctgcacgtcgggtccgccaggcctccgaggcgaggggactgggaggtgggtgcgtacttanactcatagtgagtaggtaaaattaaaaaagtactaatgacagtaccgttacggtaggaaacgggccgtacttaccgacctactcctaccgaacgacgaaccaactacaaacgacaacgtccttagttactagactaaaagacgtaacacgaccgtagaagagacgaggacgacgtaccggngttagttcgttatttcgtagtgacctagaacgtagtaggtgggtaccttaggtacgttacgttaggtacgttacgttaccg

SEQ ID NO: 415188 - DNA, 633 bp, Homo sapiens
  misc_feature: GZ8MTXP02GTENS.9.76.G10.1.454.CMB.2.raw
  modified_base (257)..(257): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagcgtggtggagtcgtgggggaggcgtggtccagcctgggaacgtccctgacgactctcctgtgcagcctntggacttccaccttcagtaaccatcggcctgccacgtcgggtcccgccgacggcctccgagggccgaggggacgtgggaggtggggtcggactacgtttatagtcatagtagaagtaggtaaaaatttaaaaaatactaatgacacgtacctcggtaggaacggggcctaattccaacctatccaccgaagaacgaaccaactaccgaaacgtaaccacgtcttacgtttcacgaactaaagtacgaaactcgaccgtagaacgtagacggtaggggaacctcgggtacttggttacgtttatttcgtagttcgacgttaacgaagtacggtaagggtggtaaccgttgtagttcgtaggacgttcggtactaaag

SEQ ID NO: 415189 - DNA, 699 bp, Homo sapiens
  misc_feature: GZ8MTXP02HSBR7.9.76.G10.1.454.CMB.2.raw
  modified_base (299)..(299): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgcttcttttaagaggtgtccagtgtcaggtgcagctggtggagtcgtgggggaggcgtggtccaggcctgggaacgtccctgagactctcctgtgcagcctctggacttcacccttcagtaccatggcctgcacgtgggtcccncaggcctccgagggcaggggctgggagtggggtacggcaacgtttatagtcaatagtgaattaaggaaaaactttaaaaaatctaatcgacacggtacgtaccggtaggaaacggggtcctaaacgtttaccgaacccctaattaccctacccgaaagggtaaaccgaaaccctaaaacccgttacccgaaaacgtaacccggaaacccgtccttaggttttaccctaggaactaaaaacgttacggaaaacctacgacccgtaggaacgtaagccgtaaggacggaaccgtacgggcttaggggtttacttacgtttcgcgtagtacgtacgtaaaggtaggtacggggttcggttaacgtttacggtacgtttacgggtacgggttacggttcggtac

SEQ ID NO: 415190 - DNA, 658 bp, Homo sapiens
  misc_feature: GZ8MTXP02JT6Y8.9.76.G10.1.454.CMB.2.raw
  modified_base (222)..(222): a, c, t, g, unknown or other
  modified_base (296)..(296): a, c, t, g, unknown or other
tcagtgatacgtctcacgaccggtgctcgatttagtcactcatacagggggggtagagaagacaggactcaggacaatctccagcatggcctggtccccctctcttcctcaccctcatcactcactgtgcagggtcctgggcccagtctgtgctgactcagcccaccctcggtgtctgggacgcccccaggccaggagggtcaccatctcctgttctggaancagctcaacatcggacataatggtagtaaactggtatcagcacgccgtaccgggaaagcctacccaaactcctnatctattatgatgatctgctcgccctgacgggtctcgcgactctcgtctcgtcctcgacgtcgtcggcctacctcgaccgtccctcccgtggccctagtccgtaggttcgggctccggtaagtcgtggaagggtcgtgggacgtcgttagtagttacgttacgtgggtaggacgtactagggttaggacttacggacgacggtaccgtagtaaagtttcggaccggtttagggtacggtttcggggttaaccggggaccgggggtaaaacgggaaccccgtaaacggcccggttaacccggtaacccgggttacccggttaaacggggtacccgaaccggttaaccccggggtaaccccggg

SEQ ID NO: 415191 - DNA, 581 bp, Homo sapiens
  misc_feature: GZ8MTXP02GY38U.9.76.G10.1.454.CMB.2.raw
  modified_base (291)..(291): a, c, t, g, unknown or other
  modified_base (339)..(339): a, c, t, g, unknown or other
tcagtgatacgtctcacgaccggtgctcgatttagtcactcatacagggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtctgggggagcgtggtccagcctgggaagtccctgagactctcctgtgcagcctctggattcaccttcagtaaccatggcctgcacgtgggtccnccaggctccgaggcaggggactggagtgggtggcacttatatcatatnaagtaggaaaatttaaaaaatactatagacagacctaccggtagaaacggggccgtaattccacctatcctacccagaacgaacaaactaccaaagaaccacgtctgttactagacaaaatcgaaactagacccgtagaacgtagacgtaggacggacacggtctagtagttatttcgtcgtgccttacgaagtagttagggtaaggtacttacgtatttcggttaggtacggttgttaccg

SEQ ID NO: 415192 - DNA, 590 bp, Homo sapiens
  misc_feature: GZ8MTXP02FXCLS.9.76.G10.1.454.CMB.2.raw
  modified_base (294)..(294): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtcgtgggggaggcgtggtccagcctggggaatccctgagactctcctgtgcagcctctggattcaccttcagtaacccatgcctgcactcgggtccnccaggctccgaggcgaggggactgggaggtggggtggcacttatatcatatgaataggtaaaattaaaaatactatgacagactccggtaggaaacgggccgtaatcacatcacagagacaactcaaacgaacacgctacgttctagactaaaatacgaacagcctagagagacgtaggaacggaccgacggcgtgtagttactttgtcggtgtaccttacgaaacggtagttaggggttaacgggtaacgtttacggtacgtttcggtttaggggtaacggttcgggtttaaccg

SEQ ID NO: 415193 - DNA, 629 bp, Homo sapiens
  misc_feature: GZ8MTXP02GE10V.9.76.G10.1.454.CMB.2.raw
  modified_base (252)..(252): a, c, t, g, unknown or other
  modified_base (266)..(266): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtcgtgggggagcgtggtccagcctgggaatccctgagactctcctgtgcagcctntggacttcaccttnagtaaccagtggcctgcacgtgggtccgccaggctccagggcaggggactggaggtggggtgcacgtttatatctatatgataggtaaaacttaaaaatctaatcgactagtacctacggtaggaaacggggtccgtattaccgaccctacgtcctacccgagacaaccaaaccgtacaaacgaaacacgtacttacgtttctacgactaaaatcggtaaaacacggtacctagaacgtagcgtaggaacggacgaacgggtcttaggttgtttagtttccgtaggttcgtacgtacgaaaggttagtacggggtaacgggtacttacggtagttttcggttacggtagggtttacgttaccg

SEQ ID NO: 415194 - DNA, 558 bp, Homo sapiens
  misc_feature: GZ8MTXP02HA0H8.9.76.G10.1.454.CMB.2.raw
  modified_base (282)..(282): a, c, t, g, unknown or other
  modified_base (375)..(375): a, c, t, g, unknown or other
tcagtgatacgtctcacgaccggtgctcgatttagtcactcatacaggggggtagagaagacaggactcaggacaatctccagcatggcctggtcccctctcttcctcaccctcatcactcactgtgcagggtcctgggcccagtctgtgctgactcagccaccctcggtgtctggacgcccccaggcagagggtcaccatctcctgttctggaagcagctccaacatcggacataatggtataaactggtatcagcagctaccgggaagctcccaaactcncatctattatgatgatctgctcgccctgacggggtctcgtcgaccgtacttctcgtggcctcgaagttctcggcctacgtcacgtccctccgngcccatcaggtcggctccgagtctgagatggaggctaggtaatttacttacgtgtaggagagtaagttggggatcggaacgagccgtagaacttggcgtttagggtacttgggttcgggcgggtaacggggaaccctaaggccgttacggaacccgttcgtacggtacaccggtacccgacgg

SEQ ID NO: 415195 - DNA, 835 bp, Homo sapiens
  misc_feature: GZ8MTXP02HDLD3.9.76.G10.1.454.CMB.2.raw
  modified_base (309)..(309): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgcttcttttaagaggtgtccagtgtcaggtgcagcgtggtggagtcgtgggggaggcgtggtccagccgtgggaacgtccctgagactctcctgtgcagtcctcgtggtacttcgacccttcaacgtaacccagtcggcctgcacgtcggtccnccgaggctccgaggcgaggggactggaggtgggtggactacttagtactacgatagtgtaagttaaggtaaaaactttaaaaaaatacttaagttacggaaccgtacggtaacccgttaccggtaacggggtaaaaccggggtaccccgttaaacgtttacccgaaaccccgttaaacgtaccctaacccgaaacggaaaccggtaaccctaaaaacccgttacccgaaaaacgtaaacccgtaacgtacccgtttacggttttaaccgacggtaaaccctaaaagttacgaaacccgaacggttacccggtaaggtaaaccggtaacggaacggttaacgggaaaccggggttaaccgaaaccgggggttccttacggggtttacgtttaaacgtttttcccggttaaacggttcggtaaacccgtttaacgaaaacggggttacgtttaaagggggtcggtttaacccgtttaacggtaggttttaccgggtttagggtaaacgggttttccggtttaacccgg

SEQ ID NO: 415196 - DNA, 564 bp, Homo sapiens
  misc_feature: GZ8MTXP02GTBVT.9.76.G10.1.454.CMB.2.raw
  modified_base (252)..(252): a, c, t, g, unknown or other
  modified_base (451)..(451): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtcgtgggggagcgtggtccagcctgggaatccctgagactctcctgtgcagcctntggattcaccttcagtaacccatcggcctgcacgtcggccgccaggcctccgagggcgaggggactggaggtgggtggcctattatatcatatagatagtaaaacttaaaaatctatgacaggactcggtagaacgggccatccacatcgtaccagacgacaactacaaagacacgtctgttcagaccaaatacgaacngacctagagacgcgtagacggacaacggtcgtagtcgttatttcgtgtacgtctacgtaaagtgttaagggtcggtacgttacggtactttcggtacggaggttcggttaccg

SEQ ID NO: 415197 - DNA, 598 bp, Homo sapiens
  misc_feature: GZ8MTXP02J445W.9.76.G10.1.454.CMB.2.raw
  modified_base (307)..(307): a, c, t, g, unknown or other
  modified_base (449)..(449): a, c, t, g, unknown or other
  modified_base (511)..(511): a, c, t, g, unknown or other
tcagtgatacgtctcacgaccggtgctcgatttagtcactcatacgagggggtagaggagccagcactagaagtcggcggtgtttccattcggtgatcagcactgaacacaaaggactcaccatggagtttgggctgaactgggttttcctcgttgctcttttaagaggtgtccagtgtcaggtgcagctggtggagtcgtgggggtagcgtggtccagcctgggaatccctgagactctcctgtgcagcctctggattcacctcagtaaccatgcctgcactcggtccgccaggctccgagggcgnggacggtggtggtagggtggtctactttattctatctaatgtaacgtaggtaaattcaaaaaaaattctaaaactttgggcctaagggtactcccccggtagtaaacggggtcccgaaaggtttccgaaccctatacctccncgacgacaacgtacccaacaacacgactacgttcttattccatgtaacagcacgcagctagngacgacggaacgttcgtcgtgttaacgtgtgttccgtctaggtattaacgaggtacggtattacggtacttttcgtaggtttaacgg

SEQ ID NO: 415198 - DNA, 610 bp, Homo sapiens
  misc_feature: GZ8MTXP02IUTOF.9.76.G10.1.454.CMB.2.raw
  modified_base (520)..(520): a, c, t, g, unknown or other
  modified_base (526)..(526): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgcttcttttaagaggtgtccagtgtcaggtgcagctggtggagtcgtgggggaggcgtggtccagccgtgggaactccctgacgctctcctgtgcagcctctggacttccaccttcaacgtaaccatcgcctgcacgtcgggtccgcgacggctccgagggcgaggggacgtgggaggtggggtgactacttatatctatatgaagtaagtaaaatttaaaaatctaatcgacacgtacgtcggtaggaacgggtacctattccaaccgtactcctacgagaacgacctaactaccaaagacctacgtcttacgtttcagaactaaagtcgaaacacgccgtagacgtagacgtagaacggaccncgggtntgttagtactttgcgtgacttacgaaaaggtggtagggtaacggttacttacggttattcggtagggtacgtttacggttaacg

SEQ ID NO: 415199 - DNA, 685 bp, Homo sapiens
  misc_feature: GZ8MTXP02FTAQ7.9.76.G10.1.454.CMB.2.raw
  modified_base (253)..(253): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtcgtgggggagcgtggtccagcctgggaagtccctgagactctcctgtgcagcctntggattcaccttcagtaaccatggcctgcacgtcgggtccgccaggctccgagggcgaggggactgggagtggggtggcacttatatcatatgataggtaaattaaaaatctaatgacagtactccggtagaacggggccgtagttaccaacctatcctacccgaagaacgaacctaaacctacccaaaaggaaaccctacgggtcttacggtttacctaagtacctaaaaatcggaaaacctacggaccctagggaacgacggtaccgtagggaacgggaaccgaacgggggtccttagggttaggtttaacttttccgtaagggtttcgaacccgtttacgaaaaacggggtgttaagggggttaacggggtaaacccttttcggtaaagtttttccgtttaagggggtaggtttccggggtttaacccg

SEQ ID NO: 415200 - DNA, 788 bp, Homo sapiens
  misc_feature: GZ8MTXP02HTN0Z.9.76.G10.1.454.CMB.2.raw
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgcttcttttaagaggtgtccagtgtcaggtgcagcgtggtggagtcggtgggggaggcggtggtccaggccgtgggaacgtccctgacgactcgtcctgtcgcagcctcgtggtacttccacccttcaagtaacccattcggcctgccacgtcggggtccccgccgaggccctaccgagggtccgaagggggactggggaggttggggtcggactacgtttaatacttcgaattaagtaggtaagttaaggggttaaaaaaatttaaaaaaaacgttactttaaagttacggaacctacggtaaacccgtttaccgggtagggaaaacgggggtccccgtaactttacccaaacccgtattcccgtaacccgaaagaaccgaaaccaaaccttaccccgaaaaagggtaaccccaaccgtcttacgtttcccaaggaacctaaaattacgaaaaccgacgtacccgtaaggagacgtacgtacgggaacggaaccggtacgggtacttgggttatttacgtttttccgtggttacgtaaccctacggtaaaacgttaacggttagggggttaacgggttaccgtttacggttacgtttaccggtttaggggaacggttttaccgggttaaccg

SEQ ID NO: 415201 - DNA, 750 bp, Homo sapiens
  misc_feature: GZ8MTXP02IRI2E.9.76.G10.1.454.CMB.2.raw
  modified_base (217)..(217): a, c, t, g, unknown or other
  modified_base (226)..(226): a, c, t, g, unknown or other
  modified_base (253)..(253): a, c, t, g, unknown or other
  modified_base (304)..(304): a, c, t, g, unknown or other
tcagtgatacgtctcacgaccggtgctcgatttagtcactcatacagggggggtagagaagacaggactcaggacaatctccagcatggcctggtcccctctcttcctcaccctcatcactcactgtgcagggtcctgggcccagtctgtgctgactcagccaccctcggtgtctggacgcccccaggcagagggtcaccatctcctgttctggaancagctcaanatcggacataatggtataaactggtancagcagcctaccgggaagcctacccaaactcctcatcttatatgatgatcngtctcgcctggtacgggtctcgtacgtaccgtctttccgtcgtcggtcctacgtacgttccgtcgggaccctacccgttccgaccgtcccccgttccgtcgggaccctaacggttaccgtacggggtttccggggcccttacccgtaacgggtttccgacggggtaaacggggttagttcggggaaaccgggtttacgtttaaacggtttaaacgttttaacgggtttacgggttaggggtacggggtaacggtacgggttaggggtacgggtaacgtacggaaaccggtcggtaaccggtaaggtaacggttcggttacgggtttagggttcggggtttacggggtaccgggggtacggggtaaaccggggtaccgtaaccgggtccgtacccggtaaccgggttaccggtaccggtacccgaacccgggtacccggtacccggg

SEQ ID NO: 415202 - DNA, 582 bp, Homo sapiens
  misc_feature: GZ8MTXP02F53NX.9.76.G10.1.454.CMB.2.raw
  modified_base (293)..(293): a, c, t, g, unknown or other
  modified_base (333)..(333): a, c, t, g, unknown or other
  modified_base (502)..(502): a, c, t, g, unknown or other
  modified_base (508)..(508): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtcgtgggggagcgtggtccagcctgggaatccctgagactctcctgtgcagcctctggattcaccttcagtaacccatggcctgcacgtcgggccnccaggctccaggcgaggggactggagtgggtggcacttanatcatatgataggaaaattaaaaatctaatgacagacctccggtagaacgggccgtattacaccaatcctaccagaacgacaaacgtacaaacgtaacacgcttagttctagacaaataggaacacgtcctagacgagacgtaggaacggaccacgggcttggtagttntttcgngtcgcgttacgaaacggtagttaggggtaagggtacctttacggtaatttccggtggggtacgtacggtttccg

SEQ ID NO: 415203 - DNA, 648 bp, Homo sapiens
  misc_feature: GZ8MTXP02FTTJ2.9.76.G10.1.454.CMB.2.raw
  modified_base (218)..(218): a, c, t, g, unknown or other
  modified_base (257)..(257): a, c, t, g, unknown or other
  modified_base (292)..(292): a, c, t, g, unknown or other
tcagtgatacgtctcacgaccggtgctcgatttagtcactcatacagggggggtagagaagacaggactcaggacaatctccagcatggcctggtcccctctcttcctcaccctcatcactcactgtgcagggtcctgggcccagtctgtgctgactcagccaccctcggtgtctggacgccccccaggcagagggtcaccatctcctgttctggaancagctccaacatcggacataatggtataaactggtaatnagcagcgtcccgggaaagcctacccgaaactcctnatctattatgatgatctgctcgcctcgaggggtcctgtcgaccgtacttccgtcgtggtcctacgaacgttccgttcggccaacccgttccgaccgtcccccttacccgtgggaccctaacgtcgaacggtcgggtccctcgtaacgtcgtggaagtagttagggacgtcgttaggttaattttaagttacgtagggttacggacgagtaagtggggtatacgacgacgtaccgtagtaacgtcgtggtttaggggtacggttacgggtacggggaccgggtaacgggaaccgtacggtaaccggttaccggtaaccggttaccggtaaccggtaccgaaccggtacccggtacgg

SEQ ID NO: 415204 - DNA, 557 bp, Homo sapiens
  misc_feature: GZ8MTXP02FO6ZQ.9.76.G10.1.454.CMB.2.raw
  modified_base (433)..(433): a, c, t, g, unknown or other
  modified_base (488)..(488): a, c, t, g, unknown or other
  modified_base (515)..(515): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtcgtgggggaggcgtggtccagcctgggaagtccctgagactctcctgtgcagcctctggattcaccttcagtaacccatggcctgccactcgggtccgccaggcctccgagggcaggggactggaggtggggtgcacttatatcatatgataggtaaattaaaaagtactaatgacaggtacctcggtaggaaacgggccgaattcacctatcgtaccagaagacaactacaaanaacacgctagttctagacaaatcgaaacagtcctagagagctagaggacacggtntgtacgttatttctgtcgctacgaagngttaggcggtaacttcgtagttcgttaggagttcggttaacg

SEQ ID NO: 415205 - DNA, 719 bp, Homo sapiens
  misc_feature: GZ8MTXP02H8JBG.9.76.G10.1.454.CMB.2.raw
  modified_base (562)..(562): a, c, t, g, unknown or other
  modified_base (617)..(617): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgcttcttttaagaggtgtccagtgtcaggtgcagcgtggtggagtcgtgggggagcggtggtccagccgtagggaacgtcctgacgactctccgtgtcgcacgtcctcgtggtacttcaccttcaagtaacccagtcggccctcgcgacgttcggggcccgccgacggtcctccgagggcggaggggacgtgggaggtggggtcgctaacgtttatagtactaatagtagaagtaaggtaaaaaactttaaaaaagtacttattacggactaggtacccttaacgggtaggggaaaccgggtcctaactaccaacccgatcccgtaccgagaacaacccgtaacctaaaccgaacggaaaacctcgtaccgtttcgtttacacggtaaactaaacgtaccgaaaacncggacccgtagggaacgacggttacgagggaacggaccaacgggtcgttaggttnttaaccgtttttggcggttaccgtactaaacgggtaaggttaggtacgggttaacggttcgtttaacggttacgtttaggttacgggtacggtttacgtacg

SEQ ID NO: 415206 - DNA, 615 bp, Homo sapiens
  misc_feature: GZ8MTXP02IWT27.9.76.G10.1.454.CMB.2.raw
tcagtgatacgtctcacgaccggtgctcgatttagtcactcatacaggggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtctgggggagcgtggtccagcctgggaatccctgagactctcctgtgcagcctctggattcaccttcagtaaccatcggcctgcactcgggtccgccaggctccaggcgaggggactgggagtggggtggctacgttatatcatacgtgacgtaggaaaatttaaaaatacgttaatcgacagtacctccgggtagaacggggtcctagtttaccacctatactcccgaagacgaacaactacaacgaaacacgacttcgttactagactaaagtactaacgagaccgtagacgacgcgtaggacgtacgacggtctcggttagttacgtttcgtagttacgtccgttaagaacggtaggtaaggggttcgggtaactttaccggtaagtttcggttagggtacgtttccgggttacg

SEQ ID NO: 415207 - DNA, 629 bp, Homo sapiens
  misc_feature: GZ8MTXP02H9DU3.9.76.G10.1.454.CMB.2.raw
  modified_base (347)..(347): a, c, t, g, unknown or other
  modified_base (376)..(376): a, c, t, g, unknown or other
  modified_base (505)..(505): a, c, t, g, unknown or other
  modified_base (511)..(511): a, c, t, g, unknown or other
  modified_base (529)..(529): a, c, t, g, unknown or other
  modified_base (556)..(556): a, c, t, g, unknown or other
  modified_base (571)..(571): a, c, t, g, unknown or other
tcagtgatacgtctcacgaccggtgctcgatttagtcactcatacaggggggagaggagcccagcactagaagtcggcggtgtttccattcggtgatcagcactgaacacaaaggactcaccatggagtttgggctgaacttgggttttcctcgttgcttcttttaagaggtgtccagtgtcaggtgcagcgtggtggagtcggtgggggagcggtggtccaggccgtagggaacgtccctggagtacctctcctgtgcacgtcctgtggtacttccaccctttcagtaacccagtcggccctgacacgttcgggccccaccaggcctccgagggcgaggggtacgngggaggtcggggtcggacctaacgtttanatcgtaaatggttacgaaggttaaaaggttaaaaaactttaaaaatacgttatacggactacgtaccgttcgaaggacggcctacgtacaccgtactccacgagtacgaacacctacaaacgacacgtntttctnaacgacaaatggaaactnacgtagacgtgcgtagacgtacgcgtntagttcgtatttcgngtacacgtagaagtcggtaggtcgttacttacggttgtacggtcggtacgttacgacg

SEQ ID NO: 415208 - DNA, 611 bp, Homo sapiens
  misc_feature: GZ8MTXP02JNB6Z.9.76.G10.1.454.CMB.2.raw
  modified_base (274)..(274): a, c, t, g, unknown or other
  modified_base (296)..(296): a, c, t, g, unknown or other
  modified_base (335)..(335): a, c, t, g, unknown or other
tcagtgatacgtctcacgaccggtgctcgatttagtcactcatacagggggagaggagcccagcactagaagtcggcggtgtttccattcggtgatcagcactgaacacaaaggactcaccatggagtttgggctgaactgggttttcctcgttgctcttttaagaggtgtccagtgtcaggtgcagctggtggagtcgtgggggagcgtggtccagcctgggaatccctgagactctcctgtgcagcctctggacttcaccttcagtaacccntggcctggccacgtgggtcccncaggctccgaggccaggggactggagtgggtgcatttanatcatatgactaggaaaattaaaaatctagtacgactaggaaccttccggtaggaaacggggccctaaatttcccgaaaccattcctacccgagaacgaacctaactaccaaacgaactaacggcttacgttactagactaaatcggaaactacgccgttagacgagactaggacgacgggtacgtcgtgtacgttatttcgagtcgtactacgtaaacgtagttaggggtaacggttacgttcggtagtttacgttcgggtacgttcgggttacc

SEQ ID NO: 415209 - DNA, 679 bp, Homo sapiens
  misc_feature: GZ8MTXP02JOGYB.9.76.G10.1.454.CMB.2.raw
  modified_base (226)..(226): a, c, t, g, unknown or other
tcagtgatacgtctcacgaccggtgctcgatttagtcactcatacagggggggtagagaagacaggactcaggacaatctccagcatggcctggtcccctctcttcctcaccctcatcactcactgtgcagggtcctgggcccagtctgtgctgactcagcccaccctcggtgtctggacgcccccaggcagaggtcaccatctcctgtctggaagcagctccaanagtcggacataatggtagtaactggtatcagcagctaccgggaagcctacccaaactcctacattctattatgatgatcgtgctcgccctggacgggtcctcgtacgtaccgtatttccacgtcggtcctaccgtaagttccgtcgggtacctaacccgttccggacctcccccgttcccgtacgggtaccctaacgttccgtaacgggttcgggcccttacccgtaaggttccgttacggggaaggtaacggttacgggaacggtccgtttaggttaaattttacgttaacggtgggttacgggaagtaccgtaagggtaggggtaactgaacgtacgtaccgtaggaacgttggtacggttagggtacggttcgggtacgggacggggaacggtaccgaaaggtccgtacggtacccgttacggacgtacccgaacggacccgtaaccggg

SEQ ID NO: 415210 - DNA, 702 bp, Homo sapiens
  misc_feature: GZ8MTXP02IIXC4.9.76.G10.1.454.CMB.2.raw
  modified_base (211)..(211): a, c, t, g, unknown or other
  modified_base (216)..(216): a, c, t, g, unknown or other
tcagtgatacgtctcacgaccggtgctcgatttagtcactcatacagggggggtagagaagacaggactcaggacaatctccagcatggcctggtcccctctcttcctcaccctcatcactcactgtgcagggtcctgggcccagtctgtgctgactcagccaccctcggtgtctggacgccccaggcagagggtcaccatctcctgttcnggaancagctccaacatcgacataatggtataaactggtatcagcagcgtacccgggaaggcctacccaaaactcctacaactctaattatacgtatgtatcgtgcctcgccctcgacggggttctcgtacgaccgtacttcgtcgtcggtactccgtaacgttcgttcgggacccttacccgaccgtacgtcccccgttacccgtcgggacccctacgttacgtacgggtcggggtccttacccgtaacgttccgttaggggaacggtaggttcggaacgggtctaggttaaatttaacgtttaacgtggttagggagacgttaggtagggtaagtaggaaccgtcggtaccgtaggaacgttcggtaacggtttgggaagtttcgggggttaccggggtaccggggaaaaccgggtaccgtaaacgggtaacccgttacggtaccccggttaacggtacggttacccgacgtaccccgggtaaaccggg

SEQ ID NO: 415211 - DNA, 522 bp, Homo sapiens
  misc_feature: GZ8MTXP01DJ775.39.3.A03.1.454.CMB.2.raw
  modified_base (198)..(198): a, c, t, g, unknown or other
  modified_base (363)..(363): a, c, t, g, unknown or other
  modified_base (515)..(515): a, c, t, g, unknown or other
tcagtcgcactagtcacgaccggtgctcgatttagagagcgtcacagggggaggaactgctcagttaggacccagacggaaccatggaagccccagcgcagcttctcttcctcctgctactctggctcccagataccactggagaaatagtgatgtcgcagtctccagccaccctgtctgtgtctccagggggaaagngccaccctctcctgcagggccagtcagaatattagcaccaacttagcctggtaaccaacagaaacctggccagggcccagactcctcatctatgatgcatcccaccgagggccactggtttcccagccaggttcagtggcaggtgggtctggggacagaagttcnctctcaccatcagcagcctgcagtctagaagtattttgctagtttattactgtacaacaggtactaatgactgcctctctacttcggcggtagggaccgagggtggagatacgaaacgaacgtgttacggcttcgcacaatctcgttcttcncttcccg

SEQ ID NO: 415212 - DNA, 593 bp, Homo sapiens
  misc_feature: GZ8MTXP01ED8T6.39.3.A03.1.454.CMB.2.raw
  modified_base (198)..(198): a, c, t, g, unknown or other
  modified_base (294)..(294): a, c, t, g, unknown or other
tcagtcgcactagtcacgaccggtgctcgatttagagagcgtcacagggggaggaactgctcagttaggacccagacggaaccatggaagccccagcgcagcttctcttcctcctgctactctggctcccagataccactggagaaatagtgatgtcgcagtctccagcccaccctgtctgtgtctccgaggggaaangcccacctctcctgcagggccagtcagaatatagcacctaattgcctaggtaaccaacagaaacctggacccagggtcccagacctcctcatctangatgacactccaccgagggcctacgtcggtttcccagcctaggttcaggtcggctagggtcggggtctggggactaggtacgttcaacgtctacaccagtcaggcagcctgactagtctagaagttatttgacttagtttactactgtacagactaaagtcttaagtacgtgggtcggtaacgttcggaaaccgaaggggtaccgtaagggtaacgaaaactaacgaaaacggttagtgggttcgactaggaccttacgttacttcgtcgttcttacgacttcccgttcccgcttaacg

SEQ ID NO: 415213 - DNA, 647 bp, Homo sapiens
  misc_feature: GZ8MTXP01BHJ35.39.3.A03.1.454.CMB.2.raw
  modified_base (198)..(198): a, c, t, g, unknown or other
  modified_base (209)..(209): a, c, t, g, unknown or other
  modified_base (251)..(251): a, c, t, g, unknown or other
  modified_base (257)..(257): a, c, t, g, unknown or other
  modified_base (270)..(270): a, c, t, g, unknown or other
  modified_base (291)..(291): a, c, t, g, unknown or other
tcagtcgcactagtcacgaccggtgctcgatttagagagcgtcacagggggaggaactgctcagttaggacccagacggaaccatggaagccccagcgcagcttctcttcctcctgctactctggctcccagataccactggagaaatagtgatgtcgcagtctccagcccaccctgtctgtgtctccgaggggaaancgcccaccctntcctgcagggccagtcagaatatagcaccattgcctgaccanagaacngcaggccagctcnatctatgatgcactccaacgngggccacgttggtttccccagtcctaggttccaggtcggctaggttggggtctgggggacaggtaacgtttccaaccttctaccaaccctatccaaggtcaacggtcccttaggccctaggttacctagggtaaacgtttacgtttttaggaccgtttaaggtttttacttaacgttcggtactaacggtactaaagttagttaacgttaacgttgggtacggtaccggtttccggaacgtaaacggggtacctaaagggtacggaaaactaacgaaaacggttacgtgggttggactcggaccttaccgttattccgtagttccttcgactttcccgttaaccccgttcctaacg

SEQ ID NO: 415214 - DNA, 510 bp, Homo sapiens
  misc_feature: GZ8MTXP02IV562.39.3.A03.1.454.CMB.2.raw
  modified_base (282)..(282): a, c, t, g, unknown or other
  modified_base (293)..(294): a, c, t, g, unknown or other
  modified_base (382)..(382): a, c, t, g, unknown or other
  modified_base (417)..(417): a, c, t, g, unknown or other
tcagtcgcactagtcacgaccggtgctcgatttagagagcgtcacagggggaggaactgctcagttaggacccagagggaaccatggaaaccccagcgcagcttctcttcctcctgctactctggctcccagataccaccggagaaattgtgttgacgcagtctccagccaccctgtctttgtctccaggggaaagagccacctctcctgcagggccagtcagagtgttagcagcacctattagcctggtaccagcagaaacctggccaggctccaggctcncatctatggtnnatccacaggccatgcactccccgatacggttcagtggcaggtggtctgggacagcttcactctcacatcagcagactgagctgaagtntttgctagtgttaattactgtcagcagtatggtanctcaccttcacgttcgcgaaggactacgacgtggaataacgttaaacgaacgtgacgtactacgaactacctatcgtatcttacactttcccg

SEQ ID NO: 415215 - DNA, 560 bp, Homo sapiens
  misc_feature: GZ8MTXP02JD2Z7.39.3.A03.1.454.CMB.2.raw
  modified_base (197)..(197): a, c, t, g, unknown or other
  modified_base (206)..(206): a, c, t, g, unknown or other
  modified_base (365)..(365): a, c, t, g, unknown or other
tcagtcgcactagtcacgaccggtgctcgatttagagagcgtcacagggggaggaactgctcagttaggacccagacggaaccatggaagccccagcgcagcttctcttcctcctgctactctggctcccagataccactggagaaatagtgatgtcgcagtctccagccaccctgtctgtgtctccgaggggaaangccaccctntcctgcagggccagtcagaatattagcaccaacttgcctggtaccaacagaacctggccagggtcccagactcctcatctatgatgcatccaccgagggccacgtcggtttccccagcctaggttcagtggcaggtgggtctggggacaggtacgttcnctctcaccatcgagcagcctgccagtctagaagtatttgacttagtttatactgtacagtactaattataagtaacgttgggtacggtacgttcgggacgtaaaggggacctaaagggtgaaaactacgaaaacgtaacgtggtacggactcgaccaccgattccgtcgttaccttcacttcccttcccgactac

SEQ ID NO: 415216 - DNA, 551 bp, Homo sapiens
  misc_feature: GZ8MTXP02IMB0U.39.3.A03.1.454.CMB.2.raw
  modified_base (254)..(254): a, c, t, g, unknown or other
tcagtcgcactagtcacgaccggtgctcgatttagagagcgtcacagggggaggaactgctcagttaggacccagacggaaccatggaagccccagcgcagcttctcttcctcctgctactctggctcccagataccactggagaaatagtgatgtcgcagtctccagccaccctgtctgtgtctccgaggggaagagccaccctctcctgcagggccagtcagaatattagcaccaattagcctggtaccaanagaaacctggccagggtcccagactcctcatctatgatgcatcccaccaggccacgtcggtttcccagccaggttcagtggcaggtggggtctggggacaggtagttcacgtctccgaacctatccgaagcacgccctgctagtctagaagtatttgtctaagtttatactgtacaactagtaactatgactcggcctactctacgtttcgggcggtacgggacgaaggtggagtatacgaaaacgaacgtcgtacggtctcgaacgactacttcgtacgtctttacgactttcccg

SEQ ID NO: 415217 - DNA, 735 bp, Homo sapiens
  misc_feature: GZ8MTXP02F3NIU.39.3.A03.1.454.CMB.2.raw
  modified_base (198)..(198): a, c, t, g, unknown or other
  modified_base (251)..(251): a, c, t, g, unknown or other
  modified_base (273)..(273): a, c, t, g, unknown or other
  modified_base (279)..(279): a, c, t, g, unknown or other
tcagtcgcactagtcacgaccggtgctcgatttagagagcgtcacagggggaggaactgctcagttaggacccagacggaaccatggaagccccagcgcagcttctcttcctcctgctactctggctcccagataccactggaagaaatagtgatgtcgcagtctccagccaccctgtctgtgtctccgaggggaaangcccaccctctcctgcagggccagtcaagaatatagcacaatgctagtacaanagaactgcaggtccagactctnatctangatgcactaccaccgaggccctacgttcggtttacccagtccgtacggttcgaggtcgggctacgggtcggggttcgaggggtaactaggtacgtttacacctttaccgacctaacctactccgaacggtcaacggtcccttaggaccgtacggttccgttaaggttaaagtttacgtttttacgggaaccttttaaagttttttaacgttaaaccgttcggtttaaaccgaaagttaaaccgttaaaagtttaagtttaaacgggtttaaacgggtttacggggttaaccgggggtttaccgggtttaacccggggaaccgggtaaaaacgggggtaacccggtaaaagggggtaaacgtaaaaaccgtaacgtaaaaacggtacggttaggtaacggtcgtacgacctaccgtaagttccgttcgttacttacactttccacccgtacttaacg

SEQ ID NO: 415218 - DNA, 606 bp, Homo sapiens
  misc_feature: GZ8MTXP02FL9AJ.39.3.A03.1.454.CMB.2.raw
  modified_base (198)..(198): a, c, t, g, unknown or other
  modified_base (255)..(255): a, c, t, g, unknown or other
tcagtcgcactagtcacgaccggtgctcgatttagagagcgtcacagggggaggaactgctcagttaggacccagacggaaccatggaagccccagcgcagcttctcttcctcctgctactctggctcccagataccactggagaaatagtgatgtcgcagtctccagcccaccctgtctgtgtctccgaggggaaangccaccctctcctgcagggccagtcagaatattagcaccaacttgcctggtaccaanagaaacctggcccagggtccccagacctcctcatctatgatgcactccaccgagggcctacgttcggtttccccagtcccgtaggtttccagtcgggcagggttggggtcgtggggactaggtacgtttcacctcctcaccatcagcagccctgctagtcgtagaaagttactttgacttaagttttattaccgtgttaccagtactaaagtattaagtaacgttggtggtaccgttcggaccgtaaacgggtaccgaaaggtacggaaaataccgaaaacggtacttaggtacggctacgccaacgtctaacgttcgtactttccaacgtttcccgttacccgacttacg

SEQ ID NO: 415219 - DNA, 508 bp, Homo sapiens
  misc_feature: GZ8MTXP01CVDS7.25.73.G07.1.454.CMB.2.raw
  modified_base (421)..(421): a, c, t, g, unknown or other
tcagactgtacagtcacgaccggtgctcgatttagctctacgctcagggggagtcagacccagtcaggacacagcatggacatgagggtcccgctcagctcctggggctcctgctgctctggctcccaggtgccaaatgtgacatccagatgacccagtctccttccaccctgtctgcatctgtaggagacagagtcaatatcacttgccgggcagtcagagtattgccaattggtggctggtatcagcaagaaaccagggaaacgcccctaaactcctagaatttataaagacctctaagtttacaaagtggggtacccatcaaggttcagcgcagtggatcgtggacaagaattcactctacaccatcagcagtctgcagcctgatgattctgactaacttattactggtacaaagttntatgtactggagttcgcaagggacaacgtaggaaatacaaacgattggtagcttgcactaatctgttctcttactccgttccgaacc

SEQ ID NO: 415220 - DNA, 617 bp, Homo sapiens
  misc_feature: GZ8MTXP01C6UK0.25.73.G07.1.454.CMB.2.raw
  modified_base (264)..(264): a, c, t, g, unknown or other
  modified_base (287)..(287): a, c, t, g, unknown or other
  modified_base (295)..(295): a, c, t, g, unknown or other
  modified_base (332)..(332): a, c, t, g, unknown or other
tcagactgtacagtcacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttcacctgtctgcatctgtaggagacagagtcaatatcacttgccggcagtcagagtattgccaattggtggctggtatcagcaagaaaccagggaaacnccccctaaaatcctagaatttanaagacctntagtttacaaagtgggtcccatcaaggttcagcgganagtgatgaggactaagtaattcactcacacatacacacacgtctcgacgacgtacgtacgtagtagtacttactacgtactaacttaacttaacgttaacggttaacgttaaaagttaaagtttaagttaaggttacgttacgggttaacgggttacgggtaaccggtaaaccgggtaaaccgtaaacggtaaacggtaaacgtaaacgaaacgtaaacgttacgtacggtacgttacgacttacctaactacttcgttcttacttacttccgttcccgtaaccg

SEQ ID NO: 415221 - DNA, 499 bp, Homo sapiens
  misc_feature: GZ8MTXP01D4971.25.73.G07.1.454.CMB.2.raw
  modified_base (267)..(267): a, c, t, g, unknown or other
  modified_base (386)..(386): a, c, t, g, unknown or other
  modified_base (472)..(472): a, c, t, g, unknown or other
  modified_base (479)..(479): a, c, t, g, unknown or other
  modified_base (481)..(481): a, c, t, g, unknown or other
tcagactgtacagtcacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaatatcacttgccgggccagtcagagtattgccaattggttgcctggtatcagcagaaaccagggaaancccctaaatcctagatttataagacctctagttacaaaggtggtcccatcaaggttcagcgcagtggatctggacaagaattcactctcacatcagcagtctgcagcctgatgtatctnactattattatagtataaattaattagtagtagtgtaggtacgacgtaacgacgtaacgaagaataacgaacgtacgttagtgtcncgcactntntctctcttctcttccgtc

SEQ ID NO: 415222 - DNA, 503 bp, Homo sapiens
  misc_feature: GZ8MTXP01EMH6E.25.73.G07.1.454.CMB.2.raw
  modified_base (251)..(251): a, c, t, g, unknown or other
  modified_base (263)..(263): a, c, t, g, unknown or other
  modified_base (271)..(271): a, c, t, g, unknown or other
  modified_base (280)..(280): a, c, t, g, unknown or other
  modified_base (288)..(288): a, c, t, g, unknown or other
  modified_base (324)..(324): a, c, t, g, unknown or other
  modified_base (335)..(335): a, c, t, g, unknown or other
  modified_base (369)..(369): a, c, t, g, unknown or other
  modified_base (372)..(373): a, c, t, g, unknown or other
  modified_base (375)..(375): a, c, t, g, unknown or other
  modified_base (379)..(379): a, c, t, g, unknown or other
  modified_base (383)..(383): a, c, t, g, unknown or other
  modified_base (385)..(385): a, c, t, g, unknown or other
tcagactgtacagtcacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaatatcacttggccgggcagtcagagtatgcctaattggtggctggtatcagnagaacaggaacnccctaaanctagattanaacgactntaagttacaaggtggtacccatcaaggttcagcggnagtggattcgngggacaaagtacttcactcacacatcagcagtcngcnntntatntatntntatattatatagtaataatattagtagtagtaggtaggtacggacgtaacgacgaacgaagaaagtaacgaagtagttagtgtcgttcgcactaatctctctcttactccgttccgtc

SEQ ID NO: 415223 - DNA, 863 bp, Homo sapiens
  misc_feature: GZ8MTXP01AROF3.25.73.G07.1.454.CMB.2.raw
tcagactgtacagtcacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaatatcacttgccgggccagtcagagtattgcctaagttggttggcctggtatcagcaagaaaccgagggaaacgcccctaaactcctagtaatttaataaacgtaccttacgttaagttttaaccgaaaagggttcgggggttacccctaagttaccgtaaaggggtttccaacggccggggtaccgtaagggttacggggtaacgtttacggttacggggggaaacctaaaaacgggtaaaacgtttttcccgaaaccctttccctttaaacccgaaacccccgttaacttacccgaaacggggtacccctaaagggtttcccttacggggtacccaacggggttccccttagggtaaacttgggtaaacttttcccgtaggtaaccctttaaaacttttaactttaaccgttaagggggttaaaccttaaaaaaggtttaactttaaggttacgggtttaaaccgtttagggggtaccgggggtttaaccgggtaacccggtaaaacgggggtaaaccccgtaaacgggttaaggggaaaaacttaaccggaaaaacgggtaacttacggggtacgggtaccttaacggttcccttaaaccccgtaagttcccttcggtttacccgttaccgttaactttccccgtttcccccggtaacccg

SEQ ID NO: 415224 - DNA, 519 bp, Homo sapiens
  misc_feature: GZ8MTXP01DH1CV.25.73.G07.1.454.CMB.2.raw
  modified_base (249)..(249): a, c, t, g, unknown or other
  modified_base (388)..(388): a, c, t, g, unknown or other
  modified_base (403)..(403): a, c, t, g, unknown or other
  modified_base (417)..(417): a, c, t, g, unknown or other
tcagactgtacagtcacgaccggtgctcgatttagctctacgctcaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaatatcacttgccggcagtcagagtattgccaattggttggcctggtatnagcagaaaccagggaaagcccctaaatcctgatttataagacctctagtttacaaagtggggtcccatcaaggttcagcgcagtggatctgggacaagaattcactctcaccatcagcatctgcagcctgaatgattcnactaacttattactnttaactaaaagttnttaagtggttacttggaggttacggctaaaggggaccaaacgtggaaaatcgaaagaacttgtaggcttggcacctaatctcttctcacttcgttcccgaac

SEQ ID NO: 415225 - DNA, 551 bp, Homo sapiens
  misc_feature: GZ8MTXP01B0A26.25.73.G07.1.454.CMB.2.raw
  modified_base (415)..(415): a, c, t, g, unknown or other
  modified_base (533)..(533): a, c, t, g, unknown or other
tcagactgtacagtcacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaatatcacttgcccgggccagtcagagtattgacctaattggttggcctggtatcagcaagaaaccagggaaacgccccctaaactcctagatttataacgacctacttagtttaacaaaggttcgggggtaccccatacgaaaggttcaggcggcacggtggatcgtggggacaagaattcactctcacatcagcagtctgcagcctgatgattcngctaacttattactggtaactaaaagttattagtggtacttgggaggttcggaccgtaagggaccaacggtgaaactcaaaacggtacttgtcggcttaggcacctaatctgttcttnactcccgtttcccgaacc

SEQ ID NO: 415226 - DNA, 586 bp, Homo sapiens
  misc_feature: GZ8MTXP01B7E90.25.73.G07.1.454.CMB.2.raw
  modified_base (406)..(406): a, c, t, g, unknown or other
  modified_base (409)..(410): a, c, t, g, unknown or other
tcagactgtacagtcacgaccggtgctcgatttagctctacgctcagggggagtcagacccagtcaggacacagcatggacatgagggtccccgctcagctcctggggctcctgctgctctggctccaggtgccaaatgtgacatccagatgacccagtctccttccaccctgtctgcatctgtaggagacagagtcaatatcacttgccgggcagtcagtagtattgcctaattggttggcctggtatcagcaagaaaccgaagggaaacgaccccctaaactcctagtaatttaataacgtaccttactaagtttaacaaagggttcgggggtacccaatacgaaggttcaggcggacaggtggatcgtagggacaagtaattcactctcaccatcagcagtcngcnnctgatgtattcatactaacttattactagtaactaaagttattagttaggtacgttgggtacggttacggacgtaaacgggtaacctaacggtaagtaaactaacgaaacggtaacgttggtacgtcgttacgaccactaacttcttcgttctacttaccttcccgttcccgtaac

SEQ ID NO: 415227 - DNA, 762 bp, Homo sapiens
  misc_feature: GZ8MTXP01CGGK4.25.73.G07.1.454.CMB.2.raw
tcagactgtacagtcacgaccggtgctcgatttagctctacgctcaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaatatcacttggccgggcagtcagtatatgacctaagttggtggctggtatcagcaagaaaccgagggaaacgacccctaaactcctagtaatttaataacgtaccttacttaaggtttaacaaagggttcgggggtacccctaagtaccgtaaagggttcaaggtccggacgtaaggttgggactccggtaggggaacctaaaggttaacttccaacttcctaccaacctataccgaaaggtcctaacgttcgtcggaccgtacgtcccgttaggtattacggtatttaccgtagtaacctttaaacctttaatttaacccgttaggggttaaacttaaaaagggtttatttaacggttacgggtttacgtttagggggtaacgggttttaccggggaaacccgtaaaacgggggtaacccctaaaacggggttaaggtaaaaaccgttaacgaaaaccggtaaaccggttgggttaacgggctttaccgggaccttaacccgtaagtttccttaacggttccctttacgttaacctttcccgggtttaaccccgtaacccg

SEQ ID NO: 415228 - DNA, 590 bp, Homo sapiens
  misc_feature: GZ8MTXP01D0KCB.25.73.G07.1.454.CMB.2.raw
  modified_base (445)..(445): a, c, t, g, unknown or other
  modified_base (475)..(475): a, c, t, g, unknown or other
  modified_base (513)..(513): a, c, t, g, unknown or other
  modified_base (563)..(563): a, c, t, g, unknown or other
tcagactgtacagtcacgaccggtgctcgatttagctctacgctcaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaatatcacttgccgggcagtcagtagtatgcctaagttggtcggctggtatcagacaagaaaccgagggaaacacccctaaactcctagtaatttaagtaacgtaccttacgttaagtttaacgaaacggttcgggggtaccctaagtacgtaaggttcaggcggcaggtggatcgtagggacaaagtaacttcactctaccactatacgagctagtctagcacgtcctaggtactgtacttcganacttaacttattactaggtaactaaagttnttagtgtagttggagttacgacgtaaaggacctaaggngtaaactcgaaacggtacgttggtcggacttacggccttacctaatcgtnttctacttacttcccgttcccgtaacc

SEQ ID NO: 415229 - DNA, 742 bp, Homo sapiens
  misc_feature: GZ8MTXP01AET5B.25.73.G07.1.454.CMB.2.raw
  modified_base (192)..(192): a, c, t, g, unknown or other
  modified_base (275)..(275): a, c, t, g, unknown or other
  modified_base (297)..(297): a, c, t, g, unknown or other
tcagactgtacagtcacgaccggtgctcgatttagctctacgctcagggggagtcagacccagtcaggacacagcatggacatgagggtccccgctcagctcctggggctcctgctgctctggctcccaggtgccaaatgtgacatccagatcgacccagtcctccttccacctgtctgcatctggtagganacagagtcaatatcacttgccgggcagtcagattattgacctaagttggtgcctggtatcagacaagaaaccgagggaaaccncccctaaatcctagtaatttanaacgtaccttacgttaacgtttaacgaaagggttcggggtacccctaagttaccgtaaagggtttccgaaggtccgggtacgtaaggttcgggaacttaccggggttagggggaacctaaaagggttaaccttttccgacccttcctaccaaccctactcgaaacgggtccctaggttccctacggacgtacggtcgtagtacgttacgttactttcgtacgttaacttaactttaacgttacgttaacggttaaacgttaaaaggtttagtttaacggttacgggtttaacggttacgggttacgggttaacccgggaaccggtaaacgggtaaaccgtaaacgggtaacggtaaaactaaccggaaacggtacgttcggtacggtaccttacgaccacttaacgttcgttcgttaccttacttaccttccccgttcccgtaac

SEQ ID NO: 415230 - DNA, 569 bp, Homo sapiens
  misc_feature: GZ8MTXP01AVIKI.25.73.G07.1.454.CMB.2.raw
  modified_base (289)..(289): a, c, t, g, unknown or other
  modified_base (391)..(391): a, c, t, g, unknown or other
  modified_base (394)..(394): a, c, t, g, unknown or other
  modified_base (402)..(402): a, c, t, g, unknown or other
tcagactgtacagtcacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaatatcacttgccgggcagtcagagtattgcctaattggtgcctggtatcagcagaaaccgagggaaacgcccctaaactcctagatttanaacgacctctagtttaacaaaggtcggggtacccatacgaaggttcagcggcacggtggatcgtggggacaagtaacttcactctacaccatcagctagtcngcncgctgatntactctatactaacttattactaggtaactaaagttattagttaggttacgttagggtacggttaccggacgtaacgggaacctaacggtaagaaactaacgaaacgtacgttggtacgtacttcgccttactaattcgttcttcttcttaccttcccgttcccgtc

SEQ ID NO: 415231 - DNA, 748 bp, Homo sapiens
  misc_feature: GZ8MTXP01AJKKK.25.73.G07.1.454.CMB.2.raw
  modified_base (191)..(191): a, c, t, g, unknown or other
  modified_base (202)..(202): a, c, t, g, unknown or other
tcagactgtacagtcacgaccggtgctcgatttagctctacgctcagggggagtcagacccagtcaggacacagcatggacatgagggtccccgctcagctcctggggctcctgctgctctggctcccaggtgccaaatgtgacatccagatcgacccagtcctccttccaccctgtctgcatctgtaganacagatcaatntcacttcggccggccagtcagtagttatgacctaagttggtggtcctggtatcgagacgaagaaaccgagggaaaccgcccctaaactcctagtaatttaagtaacgtaccttacgttaagtttaacgaaagggtttcgggtaccctaagtaccgtaaaggttccaaggtcggactagggtggagttcggaggggaactaaacggtaacctttccaccttcctacccgaccctagttacgaaacgtctaacggtcttcggaccgacgtcccgttagtaaccgttggttactttaccctaggttacctttaaaaccttttcgtttaaacccgttagggtttaaaaccgttaaaaaaggttttcgtttaaaggtttaccggggtttaccgggtttaaggggtaaccggggtttaacccggaacccgggttaaacggggaacccttaaaaggggtacggtaaaactaccggttaaaacggtacttacggtacggtacttccgacttacgtaacttcgtcgttacctcgttaccttcccgttcccgtaac

SEQ ID NO: 415232 - DNA, 498 bp, Homo sapiens
  misc_feature: GZ8MTXP02FVTP7.25.73.G07.1.454.CMB.2.raw
  modified_base (296)..(296): a, c, t, g, unknown or other
  modified_base (414)..(414): a, c, t, g, unknown or other
tcagactgtacagtcacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaatatcacttgccgggccagtcagagtattgccaattggttggcctggtatcagcagaaaccagggaaagcccctaaactcctgatttataagacctntagtttacaaagtgggtcccatcaaggttcagcggcagtggatctgggacagaattcactctcaccatcagcagtctgcagcctgatgattctgacaacttatactgtacaaaagttnttatgtacttggagttcggacaagggacaagtggaaaactcaaacgactgtaggctgcacaatctagtcttcatccttccgacc

SEQ ID NO: 415233 - DNA, 550 bp, Homo sapiens
  misc_feature: GZ8MTXP02HQEDS.25.73.G07.1.454.CMB.2.raw
  modified_base (190)..(190): a, c, t, g, unknown or other
  modified_base (355)..(355): a, c, t, g, unknown or other
  modified_base (363)..(363): a, c, t, g, unknown or other
  modified_base (386)..(386): a, c, t, g, unknown or other
tcagactgtacagtcacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaatatcacttgccgggcagtcagagtattgcctaattggttgcctggtatcagcagaaaccagggaaacgacccctaaactcctagatttataagacctctagttacaagtgggtcccatcaaggttcagcggcagtgatcgtggacagatcactcncacatcancagtctgcagcctgatcgattcngtactaactttagttaccttgtaactaaaagttatttaagtaggttacttgggtaagggtttaccgggacgaaaggggtacccgtaaacggtaggtaaaactacgaaaacggtaactaggtacggctacgaccacgaatactgtcttctactcctttcccgacc

SEQ ID NO: 415234 - DNA, 508 bp, Homo sapiens
  misc_feature: GZ8MTXP02JE05L.25.73.G07.1.454.CMB.2.raw
  modified_base (293)..(293): a, c, t, g, unknown or other
  modified_base (384)..(384): a, c, t, g, unknown or other
  modified_base (409)..(409): a, c, t, g, unknown or other
tcagactgtacagtcacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaatatcacttgccgggccagtcagagtatgccaattggtggctggtatcagcagaaaccagggaaagcccctaaactcctagattataagacctntagttacaaagtgggtacccatcaaggtcagcggcagtgatctgggacagaattcactctcaccatcagcagtctgcagcctgatgattcngacaattattactgtacaaaagttnttagtgtacttggacggttcggcaagggtaccaaaggttggaaaactcgaaaacgactggtacggctacgcaccaatctcgtcttcacgttcctccgac

SEQ ID NO: 415235 - DNA, 589 bp, Homo sapiens
  misc_feature: GZ8MTXP02H8PF7.25.73.G07.1.454.CMB.2.raw
  modified_base (265)..(265): a, c, t, g, unknown or other
  modified_base (360)..(360): a, c, t, g, unknown or other
  modified_base (393)..(393): a, c, t, g, unknown or other
tcagactgtacagtcacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaatatcacttgccgggccagtcagagtatgcctaattggtggctggtatcagcagaaaccaggaacncccctaaactcctgtactttataagactactagtttacaaaggtcgggtacccatcaaggttcagcggcagtgatctaggacagaattcacttcnctacatcagcagtctgcagctgatgattcgtanctaacttattactagtaactaaaagttatttagtacgggttagtagggtacggtttacgggaccgtaaaggggtacctaaacgggttaagggaaaattaacgaaaaccggtaactagggttacggaccgttacggacctaaccgtaattccggttaacgttcctttacgtaccgtttcccgtttaacccccgtacg

SEQ ID NO: 415236 - DNA, 618 bp, Homo sapiens
  misc_feature: GZ8MTXP02HLZVM.25.73.G07.1.454.CMB.2.raw
  modified_base (190)..(190): a, c, t, g, unknown or other
  modified_base (225)..(225): a, c, t, g, unknown or other
tcagactgtacagtcacgaccggtgctcgatttagctctacgctcagggggagtcagacccagtcaggacacagcatggacatgagggtccccgctcagctcctggggctcctgctgctctggcctcccaggtgccaaatgtgacatccagatgacccagtctccttccacctgtctgcatctgtagganacagagtcaatatcacttggccggcagtcagagtnttgctaattggtgctggtatcagcagaaaccaggaaacgaccccctaaactcctagtaatttataagtaccctctaagtttaacgaaaagtggggtacccatcgaaaggttcagcggcagtggatcgtgggacagaattcaactctcaccatcgagcagtctgcagcctgatgattctgactaactttattaccgtagttaactaaaaggttatttaagtaggttaccgttaggggtacggtttaccggggaccgtaaagggggacccctaaaaggggtaacggtaaaacgttaaccgaaaacggtaaacgttagggtaacgggtccttacggaccctaaccgaattccggttacgtaccctttacgaccgtttccctttcccccggtaaccc

SEQ ID NO: 415237 - DNA, 506 bp, Homo sapiens
  misc_feature: GZ8MTXP02GGCSV.25.73.G07.1.454.CMB.2.raw
  modified_base (342)..(342): a, c, t, g, unknown or other
  modified_base (400)..(400): a, c, t, g, unknown or other
  modified_base (426)..(426): a, c, t, g, unknown or other
  modified_base (486)..(486): a, c, t, g, unknown or other
tcagactgtacagtcacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaatatcacttgccgggcagtcagagtattgcctaattggttggcctggtatcagcaagaaaccagggaaacgcccctaaactcctagtatttataagacctgttaagttacaaaggtcggggtacccatcaaaggttcagcggnagtggatcgtgggacagtaattcactctcacatcagcagtctgcagctgatcgattcngactaacttatactagtactaaagtntagtgtactggagtcgacaaggccaagtagaaactcaaacgacgtagtggctagcaactntctctctactactcctacgc

SEQ ID NO: 415238 - DNA, 663 bp, Homo sapiens
  misc_feature: GZ8MTXP02HA0GG.25.73.G07.1.454.CMB.2.raw
  modified_base (468)..(468): a, c, t, g, unknown or other
tcagactgtacagtcacgaccggtgctcgatttagctctacgctcagggggagtcagacccagtcaggacacagcatggacatgagggtccccgctcagctcctggggctcctgctgctctggctcccaggtgccaaatgtgacatccagatgacccagtcctccttccacctgtctgcatctgtaggagacagagtcaatatcacgttcggccgggccaggtcagtagttattcgacctaagttggtggccttggtatcagacaacgaaaccgagggaacctacccctaaatcctagtaatttaacaacgtaccttagttaagtttaacgaaagggtcgggtacccaagtacgtaaaggttcaaggcggactaggtggactacggtaggggactaagtaacttcccattcctacaaccctatacgacgcgtaagtctcggacaggtcctagtattcgtacttcgtanaccttaaagtttatacttagtaacttaaaagttcgtttaggttacggttacgttaggggtacggttaaccgggaacgtaaacggggtaaccctaaagggtaacggtaaaactaacggaaaccgtaacggttggttaacggcttaacgaccttaaaccgcgtttactacgttacttacctacctttccgtacctac

SEQ ID NO: 415239 - DNA, 580 bp, Homo sapiens
  misc_feature: GZ8MTXP02H4473.25.73.G07.1.454.CMB.2.raw
  modified_base (358)..(358): a, c, t, g, unknown or other
  modified_base (384)..(384): a, c, t, g, unknown or other
  modified_base (405)..(405): a, c, t, g, unknown or other
  modified_base (560)..(560): a, c, t, g, unknown or other
tcagactgtacagtcacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaatatcacttgccgggcagtcagagtatgctaattgtgctggtatcagcagaaaccaggaaacgcccctaaatccctagatttataaagtacctcttaagtttaacaaaggttcggggtacccctagtacaaggtttcagtcggcacgtgatcgtagganagaattcactctcaccatcagcagtntggcagcctagatgaatttcngtactactttattactagtaactaaaagttattagttaggttagttgggtaacggtttaccggaaccgtaacgggtaacctaaaacggtgggtaaaactacgaaaacgtacgttacggtaggcgtacggtacaaccctgttacctcgtttacctnacctttccctttacccgccc

SEQ ID NO: 415240 - DNA, 531 bp, Homo sapiens
  misc_feature: GZ8MTXP02HTS7B.25.73.G07.1.454.CMB.2.raw
  modified_base (296)..(296): a, c, t, g, unknown or other
  modified_base (360)..(360): a, c, t, g, unknown or other
  modified_base (368)..(368): a, c, t, g, unknown or other
  modified_base (390)..(390): a, c, t, g, unknown or other
tcagactgtacagtcacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaatatcacttgccgggcagtcagagtattgccaattggtggcctggtatcagcagaaaccaggaaacgcccctaaactcctgatttaataagtacctntaagtttacaaagtgggtcccatcaaggttcagcggcagtggatcgtgggacagaattcactcncacatcancagtctgcagcctgatgattcngactaacttattactagtactaaaagtattagtgtacgttggacggttcggacgaagggaccaaaggtaggaaaactacgaaaactaacgtggttaacgctacgaccaccgtaatccgtagttctacactttcttcccgac

SEQ ID NO: 415241 - DNA, 517 bp, Homo sapiens
  misc_feature: GZ8MTXP01CXBTR.3.55.E11.1.454.CMB.2.raw
  modified_base (203)..(203): a, c, t, g, unknown or other
  modified_base (290)..(290): a, c, t, g, unknown or other
  modified_base (369)..(369): a, c, t, g, unknown or other
  modified_base (396)..(396): a, c, t, g, unknown or other
tcagagacgcactccacgaccggtgctcgatttagcactcgcacgttgggtttggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcagaaacctggccaggctcccaggctctnatctatgctgcatccaccaggccatggtatcccagccccaggttcagtggcaaggtgggtctgggacagagttcattcncacatcagcagcctgcagtctgaagtntttgctaatttatactgtcagcaagtataaatacgtggtaggacgttcggaacctaaagggacctaaaggttagaaaatcgaaaacggttcttaggtggctgctaccattcgttgttaacc

SEQ ID NO: 415242 - DNA, 537 bp, Homo sapiens
  misc_feature: GZ8MTXP01AM0U9.3.55.E11.1.454.CMB.2.raw
  modified_base (202)..(202): a, c, t, g, unknown or other
tcagagacgcactccacgaccggtgctcgatttagcactcgcacgttgggtttggggaggaactgctcagttaggacccagacggaaccatggaagccccagcgcagcttctcttcctcctgctactctggctcccagatgccactggagaagtgctgatgacgcagtctccagccaccctgtctgtgtctccaggggaaangccacctctcctgcagggccagtcagagtattagcagcaacttagcctggtaccagcagaacctggccaggctccaggctcctcatctatgctgcatcccaccagggccacgtggtactccccgagcccaggttccaggtggcaggtggggtctggggacagtagttcattctcaccatcagcagcctgcagtctgaagtatttgacttaatttattactgtctagtcagtaataatacgtggtacgtacggttcgggaccgaaaggggaccaaagggtaagaaagttacgaaacggttaataacggtgtaaccgtggaccacctaagttcttcg

SEQ ID NO: 415243 - DNA, 523 bp, Homo sapiens
  misc_feature: GZ8MTXP01EJ0TX.3.55.E11.1.454.CMB.2.raw
  modified_base (203)..(203): a, c, t, g, unknown or other
  modified_base (290)..(290): a, c, t, g, unknown or other
  modified_base (418)..(418): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctccaggctcctnatctatgctgcatccaccagggccatggtactcccagccccaggttcaggtgcaagtgggtctggggacagagttcagttctcaccatcagcagcctgctagtctagaagtattttgacttaaatttnttaactgtacagctagtaataaatacgtggtagtacgttcggaaccgtaaagggaccaaaggttagaaatacgaaaacgcttggtaagctgcacattcttgttcc

SEQ ID NO: 415244 - DNA, 547 bp, Homo sapiens
  misc_feature: GZ8MTXP01D54MG.3.55.E11.1.454.CMB.2.raw
  modified_base (202)..(202): a, c, t, g, unknown or other
  modified_base (406)..(406): a, c, t, g, unknown or other
tcagagacgcactccacgaccggtgctcgatttagcactcgcacgttgggtttggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctcccaggctcctcatctatgctgcatccaccagggccactggtactcccagcccccaggttcagtggcaaggtgggtctggggacagtagttcattctacaccatcagcagccctgcagtctagaagtnttttagacttaaattttactttacttgttacagtctaagttaataaattaacgtgggtaggtacggttcggaaccgtaaagggttaccaaagggttagaaagtacaaacgttaacttggtggtctggcacattcttgttcc

SEQ ID NO: 415245 - DNA, 574 bp, Homo sapiens
  misc_feature: GZ8MTXP01EZ31E.3.55.E11.1.454.CMB.2.raw
  modified_base (204)..(204): a, c, t, g, unknown or other
  modified_base (533)..(533): a, c, t, g, unknown or other
  modified_base (553)..(553): a, c, t, g, unknown or other
  modified_base (557)..(557): a, c, t, g, unknown or other
tcagagacgcactccacgaccggtgctcgatttagcactcgcacgttggggtttgggggaggaactgctcagttaggacccagacggaaccatggaagcccagcgcagcttctcttcctcctgctactctggctcccagatgccactggagaagtggtgatgacgcagtctccagccaccctgtctgtgtctccgaggggaaanacgcccaccctctcctgcgagggccagtcagagtattagcagcaacttagcctggtaccagcaagaaacctggccaggcctcccgaggcctcctcatctatgctgcactcccaccgagggccacgttggtactccccgagtcccccctaggttcaggtcggccgtaagggttcggggtctagggggaacagggtacgtttcatttctaccacctatcagcagctagctagtctagaagtacttttgacttaagttttattacgtgtacagtactaagttaataaacgtacgtgggtagtacgttggaaccgtaaagggacaaaggttanaaagtacaaacgttattggngtcngactacattcttgttcc

SEQ ID NO: 415246 - DNA, 589 bp, Homo sapiens
  misc_feature: GZ8MTXP01AOICL.3.55.E11.1.454.CMB.2.raw
  modified_base (277)..(277): a, c, t, g, unknown or other
  modified_base (396)..(396): a, c, t, g, unknown or other
  modified_base (403)..(403): a, c, t, g, unknown or other
tcagagacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtcctcaggctccaggcaaggggctggagtgggtggcagttatgtcacatgataggaaagaaaaaatnttacgcagactccctagaaggtcgattcaccatctaccagagacaattccaaacaacaccctgtatttgacaaatgaaacagaccctgaagaactagaaagacacggctatctattacngtgcganagatcgagtccggaagacgaaatgaactacgggggtcgtaaaccttccaagactacgtggggaccagggaacccctgggtaccaccggtcctcctacgacgcccttaccgaaccgtaacgggccccttagttcccgggttcccttcccccgtgggaccccaccccttcctaacccgaagtaacccg

SEQ ID NO: 415247 - DNA, 502 bp, Homo sapiens
  misc_feature: GZ8MTXP01AKYCX.3.55.E11.1.454.CMB.2.raw
  modified_base (202)..(202): a, c, t, g, unknown or other
  modified_base (289)..(289): a, c, t, g, unknown or other
  modified_base (374)..(374): a, c, t, g, unknown or other
  modified_base (396)..(396): a, c, t, g, unknown or other
  modified_base (402)..(402): a, c, t, g, unknown or other
tcagagacgcactccacgaccggtgctcgatttagcactcgcacgttgggtttggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctctcctgcagggccagtcagagtattagcagcaacttagcctggtaccagcagaaacctggccaggctcccaggctcctnatctatgctgcatccaccagggccactggtactcccagcccccaggttcagtggcaaggtgggtctggggacaggtgttcattcncaccatcagcagcctgcagtcngaagtntttgctaagtttattactgtacagctagtataatacgtggtgacgttggaacaagggacaaggttagaaatcaaacgacttgtggctgcacatcgttgtc

SEQ ID NO: 415248 - DNA, 542 bp, Homo sapiens
  misc_feature: GZ8MTXP01DC5EH.3.55.E11.1.454.CMB.2.raw
  modified_base (204)..(204): a, c, t, g, unknown or other
  modified_base (213)..(213): a, c, t, g, unknown or other
  modified_base (291)..(291): a, c, t, g, unknown or other
  modified_base (319)..(319): a, c, t, g, unknown or other
  modified_base (365)..(365): a, c, t, g, unknown or other
  modified_base (388)..(388): a, c, t, g, unknown or other
  modified_base (396)..(396): a, c, t, g, unknown or other
tcagagacgcactccacgaccggtgctcgatttagcactcgcacgttgggtttggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaangccaccctntcctgcagggccagtcagagtattagcagcaacttagcctggtaccagcagaaacctggccaggctcccaggcctctnatctatgctgcatccacaggccatgacnccagcccaggttcagtgcaaggtgggtctgggacagagttcattcncaccatcagcagccctgcagtcngaaagttntttagattaagtttatacgtgtacagtctaagtaattaaagtacgtgggtacggtacggttcggaacggtaaagggacgtaaagggttaacgaaactacgaaaacgttacttggtaacgtctaacgactacttattcgttcgttcc

SEQ ID NO: 415249 - DNA, 550 bp, Homo sapiens
  misc_feature: GZ8MTXP01B73FJ.3.55.E11.1.454.CMB.2.raw
  modified_base (204)..(204): a, c, t, g, unknown or other
  modified_base (289)..(289): a, c, t, g, unknown or other
  modified_base (400)..(400): a, c, t, g, unknown or other
  modified_base (524)..(524): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttagcctggtaccagcagaaacctggccaggctccagcctcctnatctatgctgcactcccaacccgagggccacgttggtaactcccccgaagtccccccaagggtttcaggtcggctaagggtcggggtctggggaacagtagttcatttccncaccatcagcagcctgctagtctagaagttatttgacttaagttttacttactgtcaagtctaagtaactaaatactgggttacgacgttcgaaccgaaaggacaaaggttagaaatcaaacgnttggtgactgacacttatcgttcgtc

SEQ ID NO: 415250 - DNA, 526 bp, Homo sapiens
  misc_feature: GZ8MTXP01BPK4T.3.55.E11.1.454.CMB.2.raw
  modified_base (203)..(203): a, c, t, g, unknown or other
  modified_base (286)..(286): a, c, t, g, unknown or other
  modified_base (314)..(314): a, c, t, g, unknown or other
  modified_base (343)..(343): a, c, t, g, unknown or other
  modified_base (349)..(349): a, c, t, g, unknown or other
  modified_base (359)..(359): a, c, t, g, unknown or other
  modified_base (363)..(363): a, c, t, g, unknown or other
  modified_base (367)..(367): a, c, t, g, unknown or other
  modified_base (386)..(386): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccacctgtctgtgtctccgaggggaaangccacctctcctgcagggccagtcagagtatagcagcaacttgcctggtaccagcagaacctggccaggctcccaggcctccnatctatgctgcatccacaggccatgacncccagccccaggttcagtgctagtggtcngggacngattcattcncacntcancagcctagcagtcagaatntttagacttaagtttacttactgtacagtctaagtataagtacgtgggtgtacgttcggaacgtaaagggaccaaagggttaagaaactacgaaaacgttacgttggtaaggcttaagaccaccgttattccgttgttcc

SEQ ID NO: 415251 - DNA, 539 bp, Homo sapiens
  misc_feature: GZ8MTXP01EQTQV.3.55.E11.1.454.CMB.2.raw
  modified_base (203)..(203): a, c, t, g, unknown or other
  modified_base (375)..(375): a, c, t, g, unknown or other
  modified_base (509)..(509): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccacctctcctgcagggccagtcagagtatagcagcaacttagcctggtaccagcagaacctggccaggctcccaggcctcctcatctatgctgcatccaccagggccacgttggtactccccagccccaggttcagtggcaaggtgggtctggggacagagttcagttcncaccatcagcagcctgcagtctagaagtattttgacttaatttattactgtcagtcagttataataacgtggtaggtacgttcggaacgaagggaccaaagggttaagaaatacaaacgttacttaggtcggtntcggtaccaccgttattaacgttgttaacc

SEQ ID NO: 415252 - DNA, 567 bp, Homo sapiens
  misc_feature: GZ8MTXP01D93X9.3.55.E11.1.454.CMB.2.raw
  modified_base (206)..(206): a, c, t, g, unknown or other
  modified_base (288)..(288): a, c, t, g, unknown or other
  modified_base (423)..(423): a, c, t, g, unknown or other
  modified_base (438)..(438): a, c, t, g, unknown or other
  modified_base (444)..(444): a, c, t, g, unknown or other
  modified_base (514)..(514): a, c, t, g, unknown or other
  modified_base (552)..(552): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggcctcccagatgccactggagaagtggtgatgacgcagtctccagccaccctgtctgtgtctccgaaggggaaanacgcccaccctctcctgcagggccagtcagagtatagcagcaacttgcctggaccagcagaacctgcaggctccagcctccnatctatgctgcactcccgaccgagggcccagttcggtactccccgagccccctagggttcaggtcggctaaggtgggtcgtggggaacaggtacgttcattcacaccatcagcacgcctagctagtcagtaagtntttagacttaatttntacgtntacagtactagttaataaagttacgtgggtacggtacgttcgggaacgtaaagggacctaaagggttaanaaaactacgaaaacgttcttggtaacgctcgacacttnttccgttcgttaacc

SEQ ID NO: 415253 - DNA, 575 bp, Homo sapiens
  misc_feature: GZ8MTXP01DZUED.3.55.E11.1.454.CMB.2.raw
  modified_base (204)..(204): a, c, t, g, unknown or other
  modified_base (273)..(273): a, c, t, g, unknown or other
  modified_base (292)..(292): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagcccaccctctcctgcagggccagtcagagtattagcagctaacttagcctggtaccagcaagaaccnggccaggctcccaggctcncatctatgctgcactccaccaggccacgtgtactcccagcccctaggttcagtggcaagggtcgggtcgtgggactagtacgttcattctacacctatcagcagcctagcctagtctagtaaagttcttttagaacttaaatttttacttacgttagtacaaggtactaagttaattaaagtacgtggggttacggtacgtttacgggaaccgtaaaggggacctaaaggttaaacgaaaattacgaaaacgttacttggtggctgacacttatcgttgttcc

SEQ ID NO: 415254 - DNA, 550 bp, Homo sapiens
  misc_feature: GZ8MTXP01C4LVL.3.55.E11.1.454.CMB.2.raw
  modified_base (204)..(204): a, c, t, g, unknown or other
  modified_base (214)..(214): a, c, t, g, unknown or other
  modified_base (309)..(309): a, c, t, g, unknown or other
  modified_base (405)..(405): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctntcctgcagggccagtcagagtatagcagcaacttgcctggtaccagcagaaacctggccaggctcccaggcctctcatctatgctgcatccaccnggccatggtactccagccccaggttcagtggcaagggtgggtctggggacagggtacgttcagttctcacctatcagcagcctgcagtctagaatntttgacttaagtttattactgtacagtctaagtaataaagtacgtgggtacgacgttcggaaccgaaagggaccaaaggttaagtaaagtacttaaaacgcgttaggtaacgggcttcggcctacttacttccgttgtttaaccc

SEQ ID NO: 415255 - DNA, 547 bp, Homo sapiens
  misc_feature: GZ8MTXP01ATP4Q.3.55.E11.1.454.CMB.2.raw
  modified_base (203)..(203): a, c, t, g, unknown or other
  modified_base (294)..(294): a, c, t, g, unknown or other
  modified_base (381)..(381): a, c, t, g, unknown or other
  modified_base (424)..(424): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggcctcccgaggcctcctnatctatgctgcatcccaccgagggccatggtactcccagcccccagggttcaggtggcaaggtgggtctggggacagtgttcattcncaccatcagcagcctgcagtcagaagtatttgacttaagtttntacttgtacagtcagtattaaatacgtgggtaggtacgttcgggaacaaaggggacaaagggttaagaaacgtcgaaaacgttacgttggtaaggctaaggacaccttagttccttgttaacc

SEQ ID NO: 415256 - DNA, 557 bp, Homo sapiens
  misc_feature: GZ8MTXP01DNIO8.3.55.E11.1.454.CMB.2.raw
  modified_base (205)..(205): a, c, t, g, unknown or other
  modified_base (291)..(291): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaanagccaccctctcctgcagggccagtcagagtattagcagcaacttagcctggtaccagcagaaacctggccaggctccagctcctnatctatgctgcatccaccgaggccacgtgtactcccagccccaggttcagtgctaaggtgggtctgggacagtagttcattctacaccatcagcagcctgactagtcgtagtaagtattttagacttaaagtttttacttacgttagtcaaggtactaagttaataaacttaacgtgggttacgggtacgttcgggaactaaaggggacctaaagggttaagaaattacaaaacgcgttaggtggctgcacttattccgttgttcc

SEQ ID NO: 415257 - DNA, 666 bp, Homo sapiens
  misc_feature: GZ8MTXP01B1RON.3.55.E11.1.454.CMB.2.raw
  modified_base (205)..(205): a, c, t, g, unknown or other
  modified_base (285)..(285): a, c, t, g, unknown or other
  modified_base (291)..(291): a, c, t, g, unknown or other
  modified_base (317)..(317): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaangcccacctctcctgcaggccagtcagagtatagcagcaattagcctggtaccagcaagaacctggccagctccagctctnatctangctgcatccacgaggccatggtaccnccgagcccgtaggtcaggtcgcgtaaggtcgggtcgtagggaactagtacgttctacgttctaccaacctagtacgacgccgtaacgtccgtaggtactagttacgtaaggtaaagtttagttttacgtaactttaaagttttaacgtttacgttagtaacgtaacggtacttaaagtttaaattaaaacggttaaccggttggggttaaccggtaaccgggttaacgggaaaccgggtaaaacggggttaaaccgtaaaagggttaaacgtaaaacgtaacggttaaaaaccgttacggttacggtaacggacctaacgaaccgtaccttacgttccgttcgttaacc

SEQ ID NO: 415258 - DNA, 630 bp, Homo sapiens
  misc_feature: GZ8MTXP01B2P4G.3.55.E11.1.454.CMB.2.raw
  modified_base (205)..(205): a, c, t, g, unknown or other
  modified_base (292)..(292): a, c, t, g, unknown or other
  modified_base (433)..(433): a, c, t, g, unknown or other
tcagagacgcactccacgaccggtgctcgatttagcactcgcacgttggggtttgggggaggaactgctcagttaggacccagacggaaccatggaagccccagcgcagcttctcttcctcctgctactctggctcccagatgccactggagaagtggtgatgacgcagtctccagccacctgtctgtgtctccgaaggggaaancgcccaccctctcctgcacgggccagtcagagtatagcagcaattgcctggaccagcaagaacctggccaggcctccgaggcctccncatctatgctgcactcccacgacggccacgttcggactcccgagccccgtaggttcaggtggcgtaagggtcgggtcgtaggggaactagggtacttcactttcacacctatcagcacgtcctagctagtctagtaagttntttagaactttaagtttactagtgacgaagtacttaagttaaattaaacgtacgtgggttacggtaaccgggttcggaaaccggtaaaacggggttaaccgtaaaagggttaaacgaaaaacgttaaccggaaaaacggttgttcgggttaaggacccttaacgacccgaacttactttccggttcgttttaacccc

SEQ ID NO: 415259 - DNA, 569 bp, Homo sapiens
  misc_feature: GZ8MTXP01DCARA.3.55.E11.1.454.CMB.2.raw
  modified_base (204)..(204): a, c, t, g, unknown or other
  modified_base (213)..(213): a, c, t, g, unknown or other
  modified_base (265)..(265): a, c, t, g, unknown or other
  modified_base (313)..(313): a, c, t, g, unknown or other
  modified_base (327)..(327): a, c, t, g, unknown or other
  modified_base (338)..(338): a, c, t, g, unknown or other
  modified_base (343)..(343): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccatggagaagtggtgatgacgcagtctccagccaccctgtctgtgtctaccgaggggaaangccaccctntcctgcagggccagtcagagtgttagcaactacttagccctaggtaccaaanagaaacctggccaaggcctccaggctcctcatcatgatgcataccaanaggccaatggcacncacgcgacgtnagtgngagtggtcgtggacgagtactcactctcacactcacgacacgactacgtactactagtagtagttagtatagtttattacgttgtacgtagacgacgtacgtacgacgtacgtacgtcctcctaccgtacgttcggtacgggacgggtaacggttaacggtaggtaggttaacgttacgttaaacgtaacgtacggtcggtcgtcgttacgtaaccgttaacgtcg

SEQ ID NO: 415260 - DNA, 545 bp, Homo sapiens
  misc_feature: GZ8MTXP01CMPI9.3.55.E11.1.454.CMB.2.raw
  modified_base (203)..(203): a, c, t, g, unknown or other
  modified_base (290)..(290): a, c, t, g, unknown or other
  modified_base (382)..(382): a, c, t, g, unknown or other
tcagagacgcactccacgaccggtgctcgatttagcactcgcacgttgggtttggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttagcctggtaccagcagaaacctggccaggctcccaggcctcctnatctatgctgcatcccaccagggccatggtactccccagcccccagggttcaggtggcaagggttgggtctggggaacaggtagttcattcncaccatcagcagccctgcagtctagaagtattttgacttaagttttattacttgtacagtctaagttattaaataacgtgggtaggtaccgttcggaaccgtaaagggacctaaagggttagaaatcgaaaacgttcttggtggctgctaccattcttgttcc

SEQ ID NO: 415261 - DNA, 610 bp, Homo sapiens
  misc_feature: GZ8MTXP01AH8SV.3.55.E11.1.454.CMB.2.raw
  modified_base (202)..(202): a, c, t, g, unknown or other
  modified_base (287)..(287): a, c, t, g, unknown or other
tcagagacgcactccacgaccggtgctcgatttagcactcgcacgttgggtttgggggaggaactgctcagttaggacccagacggaaccatggaagcccagcgcagcttctcttcctcctgctactctggctcccagatgccactggagaagtggtgatgacgcagtctccagccacctgtctgtgtctccgaggggaaancgccacctctcctgcagggccagtcagagtattagcagcaacttgcctggtaccagcaagaacctggccaggctccaggctcctnatctatgctgcactcccacgacgggccacgtggtactccccgagcccccctagggttcaggtcggcgtaagggttggggtctggggaactaggtacgtttcattctcacatcagcagctgctagtctaggtaaatcttttgactaaagttttacttactggtactaggtctaagttaattaaacgttaacgttggggtacgggtaccggtttcgggaacccgtaaagggggttacccgtaaaagggttacgaaaaacgttaccgaaaacggttggttacggtaacgggaccttaacgacctaccgttattccgttaagttccc

SEQ ID NO: 415262 - DNA, 552 bp, Homo sapiens
  misc_feature: GZ8MTXP01EAEJ6.3.55.E11.1.454.CMB.2.raw
  modified_base (204)..(204): a, c, t, g, unknown or other
  modified_base (352)..(352): a, c, t, g, unknown or other
  modified_base (420)..(420): a, c, t, g, unknown or other
  modified_base (523)..(523): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcaagaaacctggccaggcctcccaggcctcctcatctatgctgcactcccaccgaggccacgtggtactcccgagcccccaggtcttagnggctaaggtgggtcgtgggacaggtacgttcattctacaccatcagcagcctgctagtctagaagttntttgacttaagttttacttactgtacagtctaagttaataaattacgtgggtaggtacggttcggaacgaaagggactaaaggttaagaaatacgaaacgttnttggtggctgaccacttattcgttgttcc

SEQ ID NO: 415263 - DNA, 565 bp, Homo sapiens
  misc_feature: GZ8MTXP01ELZ0M.3.55.E11.1.454.CMB.2.raw
  modified_base (206)..(206): a, c, t, g, unknown or other
  modified_base (390)..(390): a, c, t, g, unknown or other
  modified_base (444)..(444): a, c, t, g, unknown or other
  modified_base (540)..(540): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggcctcccagatgccactggagaagtggtgatgacgcagtctccagcccaccctgtctgtgtctccgaggggaaanagccaccctctcctgcagggccagtcagagtattagcagcaacttagcctggtaccagcaagaaacctggccaggctcccgaggcctcctcatctatgctgcactccaccagggccatcggtactcccagccccctaggttcaggtcgctaagggtgggtctaggggacagtacgttcagttcncaccatcagcagcctgctagtctagtaagtattttgacttaagttttatacgtntacgagctaagttaataaagttacgtgggtacggtacgttcgggaacgaaagggttaccaaaggggttacaaagttacaaaacggttcttaggtgntaacgcacttagttccgttgttccc

SEQ ID NO: 415264 - DNA, 583 bp, Homo sapiens
  misc_feature: GZ8MTXP01EIPYH.3.55.E11.1.454.CMB.2.raw
  modified_base (205)..(205): a, c, t, g, unknown or other
  modified_base (267)..(267): a, c, t, g, unknown or other
  modified_base (276)..(276): a, c, t, g, unknown or other
  modified_base (281)..(281): a, c, t, g, unknown or other
  modified_base (367)..(367): a, c, t, g, unknown or other
  modified_base (394)..(394): a, c, t, g, unknown or other
  modified_base (429)..(429): a, c, t, g, unknown or other
tcagagacgcactccacgaccggtgctcgatttagcactcgcacgttggggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtattagcagcaacttgcctggacagcagaacngcagctccngctcnatctatgctgcactcccaccgacgggcctacgtcggtactcccgagtcccccgtaggttcaggtcggcgtaagggttcggggtcgnggggaacctaggtacgtttcagtttcncactatcagtcacgcctgctagtctagtaacgttntttagacttaaagttttactacgtgttacaagtcgtaagttaattaaacgtacggttgggtacggtaccggttcggaacggtaaagggaccgtaaaaggttaacgaaacttacgaaacgttcgttaggtgactgaccacttattcgttcgtaac

SEQ ID NO: 415265 - DNA, 543 bp, Homo sapiens
  misc_feature: GZ8MTXP01AX1NK.3.55.E11.1.454.CMB.2.raw
  modified_base (202)..(202): a, c, t, g, unknown or other
  modified_base (210)..(210): a, c, t, g, unknown or other
  modified_base (356)..(356): a, c, t, g, unknown or other
  modified_base (367)..(367): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctccagatgccactggagaagtggtgatgacgcagtctccagccaccctgtctgtgtctccaggggaaangccacctntcctgcagggccagtcagagtattagcagcaaacttagcctggtaccagcagaaacctggccaggctcccaggctctcatctatgctgcatccacagggccactggtatcccagccccaggttcagtgcaaggtgggtctgggacngagttcattcncaccatcagcagcctgcagtctagaaagtatttttgacttaaagtttattaactgttacaagctaagttataaataacgtgggtaggtaacggtttcggaaccaaagggggaccaaagggttagaaaatcaaaaaccggttattgggtaaggccttggactaccatttccgttgtc

SEQ ID NO: 415266 - DNA, 566 bp, Homo sapiens
  misc_feature: GZ8MTXP01DRUZZ.3.55.E11.1.454.CMB.2.raw
  modified_base (204)..(204): a, c, t, g, unknown or other
  modified_base (534)..(534): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccacctgtctgtgtctccgaggggaaancgccaccctctcctgcagggccagtcagagtattagcagacaacttagcctggtaccagcaagaaacctggaccaggcctcccgaggcctcctcatctatgctgcactccaccgaggccagtcgtactcccagtcccctaggttcaggtcggctaagggtcgggtcgtagggactaggtacgttcattctacacctatcagcagcctagctagtctagaacttatttagaactttaaatttattacgtgtacagtactaagtaattaagtacgtgggtacgtacgttcggaaccgtaaaggacgtaaagttaagaaactacgaaacgttnttaggtgactcgacacttagttcttgttaacc

SEQ ID NO: 415267 - DNA, 605 bp, Homo sapiens
  misc_feature: GZ8MTXP01E1A9N.3.55.E11.1.454.CMB.2.raw
  modified_base (204)..(204): a, c, t, g, unknown or other
  modified_base (456)..(456): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgcccaccctctcctgcagggccagtcagagtattagcagcaacttagcctggtaccagcaagaaacctggccaggcctcccaggcctcctcatctatgctgcactcccgaccgagggcccagttcggtaactccccgagtccccccgtaagggtttcaagggttcggccgtaagggttcggggtccgtagggggaactaggtacgtttccagtttccacacctatcagcacgctgctagtctagtaagtntttacgacttaaattttatacgtgtacaagtctaaagttacttaaagtacgtgggtacggtaccgttcgggaaccgtaaagggaccaaagggttacaaacgtaacgaaagttcgttggtcggctaaggccacgttattccttgttaacc

SEQ ID NO: 415268 - DNA, 624 bp, Homo sapiens
  misc_feature: GZ8MTXP01CHWGZ.3.55.E11.1.454.CMB.2.raw
  modified_base (203)..(203): a, c, t, g, unknown or other
  modified_base (290)..(290): a, c, t, g, unknown or other
  modified_base (380)..(380): a, c, t, g, unknown or other
tcagagacgcactccacgaccggtgctcgatttagcactcgcacgttgggtttggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaattagcctggtaccagcagaaacctggccaggctcccaggcctcctnatctatgctgcatccaccaggccactggtactcccagccccctaggttcaggtggctaagggtgggtctggggacaggtagttcagttcncaccatcagcagcctgcagtctagaacgtattttagacttaagttttatttaaccgttgttacctaaggtacctaaggttaaattaaagtaaacgttggggttacggtaaccggtttcgggaaccccgaaaagggggttacccgtaaaagggggttaactaaaaacgttccgaaaaaacggttacgttagggttaacgggaccttaacggacccgtaacccgttagttccgttaacgtttcccg

SEQ ID NO: 415269 - DNA, 515 bp, Homo sapiens
  misc_feature: GZ8MTXP01DHXKX.3.55.E11.1.454.CMB.2.raw
  modified_base (202)..(202): a, c, t, g, unknown or other
  modified_base (212)..(212): a, c, t, g, unknown or other
  modified_base (284)..(284): a, c, t, g, unknown or other
  modified_base (313)..(313): a, c, t, g, unknown or other
  modified_base (363)..(363): a, c, t, g, unknown or other
  modified_base (407)..(407): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccacctgtctgtgtctccaggggaaangcccaccctntcctgcagggccagtcagagtatagcagcaattagcctggtaccagcaagaactggccaggctccagctccnatctatgctgcatccacaggccatgtacnccagccccaggttcagtggctaaggtgggtctgggacagtagttcattcncacatcagcagcctgctagtctagagtatttgacttaaagtttnttactgtacagctaagtaataaatacgtggtagtacgttcgggaaccaaaggggaccaaagggttaacgaaatcgaaaacgcttgtggctaagctacattcgttcgtc

SEQ ID NO: 415270 - DNA, 580 bp, Homo sapiens
  misc_feature: GZ8MTXP01ALSWL.3.55.E11.1.454.CMB.2.raw
  modified_base (203)..(203): a, c, t, g, unknown or other
  modified_base (378)..(378): a, c, t, g, unknown or other
  modified_base (405)..(405): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccacctgtctgtgtctccgaggggaaangccacctctcctgcagggccagtcagagtatagcagcaacttgcctggtaccagcagaacctggccaggctcccaggcctctcatctatgctgcatccaccgagggccacgtggtactcccgagtccccaggttcagtggcaaggttgggtctaggggacaggtacgttcattcncacatcagcagcctgcagtctagaatntttgacttaagttttatactgtacagtctaagttaataaattacgtgggttacggtaccggttcgggaaccgtaaaggggaccgtaaagggttaaacgtaaaacgttaccgaaaaacggttacgttgggtaacgggcttaacgggacctaaccttagtttccgttcggtttaacc

SEQ ID NO: 415271 - DNA, 632 bp, Homo sapiens
  misc_feature: GZ8MTXP01C4EB2.3.55.E11.1.454.CMB.2.raw
  modified_base (204)..(204): a, c, t, g, unknown or other
  modified_base (450)..(450): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtattagcagcaacttgctggtaccagcaagaacctggccaggcctcccgaggcctcctcatctatgctgcactccacgaggccagtggtactcccagccccctaggttcaggtcggcgtaaggggttgggtcgtggggaactagggtacgttccaagtttcctacccaaccctatccgaagccgagtccctagacctagtaccgtaggtaaagttnttttagactttaaagttttacttactgtacagtactaagttaataaacgtacgttagggtacggtaaccggttccgggaacgtaaaacggggttaccgtaaaagggttaacgtaaaaacgttacgaaaaacggttcttacgggtggacttcggaacctaaccttagttccttcgtttaaccc

SEQ ID NO: 415272 - DNA, 626 bp, Homo sapiens
  misc_feature: GZ8MTXP01DJC10.3.55.E11.1.454.CMB.2.raw
  modified_base (207)..(207): a, c, t, g, unknown or other
tcagagacgcactccacgaccggtgctcgatttagcactcgcacgttggggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccgagggggaaancgcccaccctctcctgcagggccagtcagagtatagcagcaacttagcctggtaccagacagaaacctggccaggcctcccaggcctctcatctatgctgcactccaccagggccacgtcggtactcccagtcccccgtaggttcaggtggcgtaagggtgggtcgtgggactaggtacgttcatttccacaccatcacgcacgcctgctagtactagtaagttatttagactttaaagttttactttacttggtacagtactaagttaagttaaacttacggttagggttacggtaccggtttcggggaaaccgtaaagggggttaaccgtaaaagggttaaagtaaaacgtaaccgttaaaaacgttacggttacgggtaaggtacctggacctaccgttacttccttgtttaaccc

SEQ ID NO: 415273 - DNA, 651 bp, Homo sapiens
  misc_feature: GZ8MTXP01AOKZD.3.55.E11.1.454.CMB.2.raw
  modified_base (205)..(205): a, c, t, g, unknown or other
  modified_base (298)..(298): a, c, t, g, unknown or other
  modified_base (405)..(405): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaancgcccaccctctcctgcagggccagtcagagtattagcagcaacttagcctggtaccagcaagaaacctggccaggcctcccgaggcctcctnatctatgctgcactcccgaccgagggccagtcggtactccccgagcccccaggttcaggtcggctaagggtcgggtctaggggaccaggtacttcattcacacctancgagcacgtctagactagtacgtagtaacgttactttacgtaactttaagtttacttacgtgtaacaagtacgtaaagttaaattaaacgttacgggtcggggttacggtaaccgggttaccgggaaaccggtaaacggggttaaaccgtaaaagggttaaacgtaaaaccgttaaccgaaaacgggttacggttcgggtaacggtacctaacggaccctaaccgttacgttccgttaacgttccc

SEQ ID NO: 415274 - DNA, 579 bp, Homo sapiens
  misc_feature: GZ8MTXP01DDHUW.3.55.E11.1.454.CMB.2.raw
  modified_base (205)..(205): a, c, t, g, unknown or other
  modified_base (240)..(240): a, c, t, g, unknown or other
tcagagacgcactccacgaccggtgctcgatttagcactcgcacgttgggtttgggattcacgttgcagatgtaggtccctgagactctcctgtgcagcctctggattcaccttcagtagatatgctatgtattgggtccgtcaggctccaggcaaggggctggagtgggtggcagttatgtcacatgataggaaagaaaaaatntacgcagactcctgaaggtcattcacatctcaganacattccaacacaccctgtatttgacaaatgaacagcctagaagaaactgaacgacacggtctatctatttactgtgacgagagatcgacgtccggaacgagaaatcgaaaccgttacgggtcggtaaacccttccgacgtactacggtcggggaccaacgggtaccctggtccaccgtctcctacacgccctaccaccgacggcccactccgtccctccccggtcgccaccctccaccgtacgacgccgaccgtcgtcggggccacgcggccggccgcggcgttcgtccgtgttaccgacggttacctccgttcgaagtcgcgttcgtcgttcgcggg

SEQ ID NO: 415275 - DNA, 593 bp, Homo sapiens
  misc_feature: GZ8MTXP01DR1SS.3.55.E11.1.454.CMB.2.raw
  modified_base (204)..(204): a, c, t, g, unknown or other
  modified_base (293)..(293): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccacctgtctgtgtctccgaggggaaancgcccaccctctcctgcagggccagtcagagtatagcagacaacttagcctggtaccagcaagaacctggccaggcctcccaggcctcncatctatgctgcactccaccaggccagtcggtactcccagcccctaggttcaggtggctaagggttgggtcgtggggaactaggtagttcatttccaccactatcagcagccctagcagtctagtaagtattttgacttaaattttagttactgtactaagtactaagtaattaaacgttacgtgggttacgggaccgttcgggaaccgtaaacggggaacctaaagggttaaagtaaactaacggaaaacgttaacgttggtaaggtctaacggctaacgttacttcgttcgtttaacc

SEQ ID NO: 415276 - DNA, 601 bp, Homo sapiens
  misc_feature: GZ8MTXP01BUGE0.3.55.E11.1.454.CMB.2.raw
  modified_base (204)..(204): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtattagcagcaacttagcctggtaccagcagaaacctggaccaggcctcccgaggcctcctcatctatgctgcactccaccgagggccacgtcggtacctcccgacgtcccccgtagggtttcaggtcggacgtaagggttcggggtcgtagggactaggtacgttctacgttcacaccatccagcagcctagcagtctaggtaagttatttagacttaagttttacttacgtgtactagtacaagttaataaagtacgtgggtaggtacgtacggaaccgaaagggacctaaagggttagtaaacgtaaccgaaaacggttcgttacggtaacggtctaacggtacacgttacttcgttcgttaacc

SEQ ID NO: 415277 - DNA, 634 bp, Homo sapiens
  misc_feature: GZ8MTXP01EXC37.3.55.E11.1.454.CMB.2.raw
  modified_base (206)..(206): a, c, t, g, unknown or other
  modified_base (440)..(440): a, c, t, g, unknown or other
  modified_base (481)..(481): a, c, t, g, unknown or other
tcagagacgcactccacgaccggtgctcgatttagcactcgcacgttggggtttgggggaggaactgctcagttaggacccagacggaaccatggaagccccagcgcagcttctcttcctcctgctactctggctccagatgccactggagaagtggtgatgacgcagtctccagcccacctgtctgtgtctaccgaggggaaacncgccaccctctcctgcgagggccagtcagtagtatagcagactaacttacgcctaggtaccagaccaagaaaccctggacccaggcctaccgacggtcctcctacatctatgctgcactcccgaccgacgggccctacgttcggtaactcccgaacgtccccgtacgggtttcaagggtcggaccgtaagggttcgggtcgtagggacaggtacgttacagtttcacctaacgntacgacggcacgtccgtagctaaggtctagaaattgtttanacttaaagtttcttaacgtggtacaagtactaaggtaacttaaagtacggtgggttacggtaccggttcgggaacgtaaacggacgtaaaggttaaacaaacgtaacgaaagttcgttggtaacgtcgaactacacttattcgttgttaaccc

SEQ ID NO: 415278 - DNA, 630 bp, Homo sapiens
  misc_feature: GZ8MTXP01CBF79.3.55.E11.1.454.CMB.2.raw
  modified_base (205)..(205): a, c, t, g, unknown or other
  modified_base (297)..(297): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaancgccaccctctcctgcagggccagtcagagtatagcagcaacttagcctggtaccagacaagaaacctggccaggcctcccgaggcctcctnattctatgcctgcactcccaccgagggcccacgttcggtaactcccccgaagtccccctaagggttcaggttcggccgtaaagggttgggggtcgtaggggaaaccctagggtaccttccgaacttcctaccaccatcaaggccaagacgtagggacgccgtagtaagttatttgactaggttgttaagttctgtcgtaggtcttagttcggttactctaccgttcggttctacgttcgttgggacccggtagggggacccgtaaggggttcggaacgttaacgttaaccgaaacggtacgtggtacggccgttagaacccgttaacctaacg

SEQ ID NO: 415279 - DNA, 671 bp, Homo sapiens
  misc_feature: GZ8MTXP01CQA7Y.3.55.E11.1.454.CMB.2.raw
  modified_base (204)..(204): a, c, t, g, unknown or other
  modified_base (295)..(295): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgcccaccctctcctgcagggccagtcagagtatagcagctaacttgcctggtaccagacagaaacctggccaggctcccgaggcctcctnatctatcgctgcatcccaccgagggcctagtcggtactcccgagccccgtaggttcaggtggccgtaagggttggggtccgtaggggaccagggtacgttacatttccaccgacctagtcgaacggctaacgtcccgtggtacctaaggttaccgtaggttaaagtttacttttagtaactttaaagttttttacttaaccgttgttacgtaagtactaaaggtttaattaaacgttacggttgggttacgggttaaccggttcgggaaaccggtaaacggggaaccgtaaaagggttaaacgtaaaacgttacggaaaacggttacgttagggtcggtacgtcgaccgtacccttagttccgttaacgttaaccc

SEQ ID NO: 415280 - DNA, 735 bp, Homo sapiens
  misc_feature: GZ8MTXP01DQEDQ.3.55.E11.1.454.CMB.2.raw
  modified_base (143)..(143): a, c, t, g, unknown or other
  modified_base (197)..(197): a, c, t, g, unknown or other
  modified_base (205)..(205): a, c, t, g, unknown or other
tcagagacgcactccacgaccggtgctcgatttagcactcgcacgttgggtttgggattcacgttgcagatgtaggtccctgagactctcctgtgcagcctctggattcaccttcagtagatatgctatgtattgggtccgtnaggctccaggcaaggggctggagtgggtggcagttatgtcacatgataggaaanaaaaaatnttacgcagactcccgtagaaggtcattcacatctcaagagaacaattccaaacacaccctgtattgacaaatagaacagcctagaagaaactagaacgacacggtacttaagtacttatttacgtgtgacgtagagatacgacggtacccggaaacgaacgaaatcggtaaaccgttaacgggtaacggtaaacccttccgaaacggtaaccgtaccggtcgggggacccgaaacggggtaacccctggtaccctaccgtcctacccgttacgacgtcccctaccgaaccgaaccgggacccctacgttccccgggttcccctttaccccccggggtacggtcccctaaacccccgttccccgtaaccgaaaccggcgtaccccgtaacccgttcggggtaccgggggaccaccggaccgggccccgggtcccgttcggggccttcgggtcccggtacggttaccgaacgggttaacccttcccggtttaaccggcggtttcggccgtttcctcggttcgggaaccgggg

SEQ ID NO: 415281 - DNA, 575 bp, Homo sapiens
  misc_feature: GZ8MTXP01DIEZE.3.55.E11.1.454.CMB.2.raw
  modified_base (204)..(204): a, c, t, g, unknown or other
  modified_base (213)..(213): a, c, t, g, unknown or other
  modified_base (280)..(280): a, c, t, g, unknown or other
  modified_base (286)..(286): a, c, t, g, unknown or other
  modified_base (414)..(414): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccacctgtctgtgtctccgaggggaaangccaccctntcctgcagggccagtcagagtatagcagcaacttagcctggaccagcagaactgcagctccagctcnatctangctgcactccaccgagggccaagtcggtactcccgagtcccctagggttcaggtggctaagggttgggtcgtggggaactagtacgttcattcacaccatcagcagtcctgctaagtctagaaagttnttttagacttaaagttttacttacttggtacagtactaagttaattaaagtacgttgggtacggtacggttcgggaaccgtaaaggggaccaaagggttaacgaaaatacgaaaacgttacgttagggtaacgctcggaccacttacttcgttaacgttcc

SEQ ID NO: 415282 - DNA, 588 bp, Homo sapiens
  misc_feature: GZ8MTXP01CL9GH.3.55.E11.1.454.CMB.2.raw
  modified_base (410)..(410): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagcgccaccctctcctgcagggccagtcagagtatagcagcaacttagcctggtaccagcaagaaacctggccaggcctcccgaggcctcctcatctatgctgcactcccaccgagggccacgtcggtactccccgagccccctagggttcaggtcggcgtaagggttcggggtcgtaggggaacctagggtacgttctacgtttccnccaccctatcagtcacgtccctagcgtagtcgtagaagttatttgactttaaatttattactgtacagtactagttaataaagttacgtgggtacggtaccgttggaaccgaaagggacgaaaggttaagaaactcgaaaacgttagttggtggactcggctaccgttatcgttcgtc

SEQ ID NO: 415283 - DNA, 554 bp, Homo sapiens
  misc_feature: GZ8MTXP01A6QDJ.3.55.E11.1.454.CMB.2.raw
  modified_base (205)..(205): a, c, t, g, unknown or other
  modified_base (297)..(297): a, c, t, g, unknown or other
  modified_base (303)..(303): a, c, t, g, unknown or other
  modified_base (366)..(366): a, c, t, g, unknown or other
  modified_base (421)..(421): a, c, t, g, unknown or other
  modified_base (520)..(520): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaanacgcccaccctctcctgcagggccagtcagagtatagcagcaacttagcctggtaccagacagaacctggccaggcctccgaggtcctcctnatctangctgcactccacgagggccagtggtactcccagccccaggttcaggtggctaagggtgggtcnggggacagtcgttcattctacacctatcgaagcagcctagctagtctagtaagtntttagacttaaattttatactggtacagtctaagtattaagtacgtgggtacgtacgtcggaacgaagggttaccaaaggttacaaacgtacaaacggnttggtcgctaacgctacgattccgttgttaaccc

SEQ ID NO: 415284 - DNA, 529 bp, Homo sapiens
  misc_feature: GZ8MTXP01EVHWQ.3.55.E11.1.454.CMB.2.raw
  modified_base (204)..(204): a, c, t, g, unknown or other
  modified_base (371)..(371): a, c, t, g, unknown or other
  modified_base (383)..(383): a, c, t, g, unknown or other
  modified_base (411)..(411): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcagaacctggccaggctccaggcctcctcatctatgctgcactcccaccgagggccacgtggtactccccgagcccctaggttcaggtggcaaggtgggtctggggacngtagttcattcncaccatcagcagctagctagtctagatntttagacttaatttattactgtacagtctaatataatacgtggtagtacgttggaaccgtaagggaccaaaggttaagaaatacaaacgttacgttgtggctggctacatcttgttcc

SEQ ID NO: 415285 - DNA, 577 bp, Homo sapiens
  misc_feature: GZ8MTXP01DKKPA.3.55.E11.1.454.CMB.2.raw
  modified_base (205)..(205): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaangccaccctctcctgcagggccagtcagagtatagcagcaacttgcctggtaccagcagaaacctggccaggcctcccaggcctctcatctatgctgcactcccaaccgagggccagtcggtactcccgagcccccaggttcaggtcggcgtaagggttcgggtcgtaggggacctaagggtacgtttcactttccacacctatcgaacgccagtccctagactagttctaggaaagttattttagactttaaagttttacttacgtgtacagtactaagtaataaagtacgtgggtagtacgttcggaacgaaagggactaaaggttaaagaaatcgaaaacgttcttggtgactcgctacattcttgttcc

SEQ ID NO: 415286 - DNA, 736 bp, Homo sapiens
  misc_feature: GZ8MTXP01BHYRX.3.55.E11.1.454.CMB.2.raw
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaagcgcccaccctctcctgcgagggccagtcagagtatagcagctaacttagcctggtaccagacaacgaaaccgtcggaccgacggcctaccccgacggtcccttaccctctaacttcctagtcgtacctcgacctaacttaccccgaacccggaccggggtaccctaccggttacgggttaaccctaccccgacggtaccccccgtagggtttcgagggtcgggaccgtaaaggggttccgggggtcgttacgggggaactaacggggttacgttacgttacttacctaccaacccgtataccgacggacctacggtcccgttacgggccttaaagttcgtaaaggtaacgtttacgttttagtaacctttaaagtttttacttacgttagtacctaggtaactaaggttaaattaaacggttaacgtgggttacgtaccgttcgtaacggaaccgttaaaggggaaccttaaaggtaaacgtaaacttaccgaaagttaccgtgtacgctacgcttacctgttccttaacg

SEQ ID NO: 415287 - DNA, 752 bp, Homo sapiens
  misc_feature: GZ8MTXP01BMHPY.3.55.E11.1.454.CMB.2.raw
  modified_base (258)..(258): a, c, t, g, unknown or other
  modified_base (281)..(281): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccatggagaagtggtgatgacgcagtctccagccacctgtctgtcgtctccgaggggaaacacgccaccctctcctgcagggccagtcagatattagcagcaacttagctggaccngacagaactgcagctccagctcnatctatcgctgactagcccaacccgaggggcctaacgtcgggttactaccccgaggccccctagggttaccaggtcggccgtaaacgggttggggtcgttacgggggaaccctaggggttaaacgtttcccgaaactttttcccgtaacccgtaacccgagttaccccgtaaaggggtccaaacccggtcccgtttacggcccgttaacggttacgttaacggtaaacgggttaacgttttacgttaacgtttaaacgttttaacgttttaacgtttattaaccgtaacggtaacgtaaacgttaattaaaacgtttaaacgttagggttacgggttaaccgggtttacccggtaaccgggtaacggggttaaacccgggaaacgggttaacgggaaacggtaagttaacgttaaaacgaaaccgttaacgttaggaacgttacgtacggaaccgtaacgttcgtttcccg

SEQ ID NO: 415288 - DNA, 597 bp, Homo sapiens
  misc_feature: GZ8MTXP01ADUAZ.3.55.E11.1.454.CMB.2.raw
  modified_base (206)..(206): a, c, t, g, unknown or other
  modified_base (266)..(266): a, c, t, g, unknown or other
  modified_base (279)..(279): a, c, t, g, unknown or other
  modified_base (282)..(282): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaacngcccaccctctcctgcagggccagtcagagtatagcagcaacttgctgacagcagaaccngcagctccagccnctnatctatgctcgcactcccaccgagggccagtcggtactcccgacgccccgtaggttcaggtcggtacgtaagggttcgggtcgtaggggactaggtacgtttcattccctacgacctatacgacggcacgccgtggcctagtctaggtaaacttcgttttacgactttaagttttactaacgttgtacaagtctaagtaattaagtacgtgggttacgacggttcggaaccgaaagggttaccgtaaaggaagtaaacgtacgaaaacgttagttcggaaggtccaacggctacccgttattccgttcgtttccc

SEQ ID NO: 415289 - DNA, 668 bp, Homo sapiens
  misc_feature: GZ8MTXP01EYGPP.3.55.E11.1.454.CMB.2.raw
  modified_base (215)..(215): a, c, t, g, unknown or other
  modified_base (399)..(399): a, c, t, g, unknown or other
tcagagacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtcctnaggctccgaggcaaggggctgggagtgggtgcagttatgtcacatgataggaaagaaaaaatattaacgcagactccctagaaggtcgattcacatctccagagacaattccaaacaacaccctgtactttcgactaaatgaacagaccctagaacgaactagaagacacggctatctattacngtagcgagagtatacaggtaccggaacgacgaaagtacggaacgttacgggggtacggttaaacccgttccgaacgtaacttaccggtgggggacccgaacgggggtaaaccccgtcgggtacccaacccggttcctcccgttacgaccggtaccccttcccgaaaccccgaaccgggggttacccccttacgggttccccggttccccctttccccccgttaaccgggcccctaacccccggttcccttaacccgaaacggtaacccg

SEQ ID NO: 415290 - DNA, 611 bp, Homo sapiens
  misc_feature: GZ8MTXP01B8X40.3.55.E11.1.454.CMB.2.raw
  modified_base (205)..(205): a, c, t, g, unknown or other
  modified_base (304)..(304): a, c, t, g, unknown or other
  modified_base (410)..(410): a, c, t, g, unknown or other
  modified_base (443)..(443): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaancgccaccctctcctgcgagggccagtcagagtattagcagcaacttagcctggtaccagcaagaaacctggccaggcctaccgaggcctcctcatctangctgcctatcccacgagggccctacgtggtactcccgagtcccccgtaggttcagggtcggccgtaagggttcgggtctggggacagtacgttcattcctacactntcagctagccctagccgtagtcgtagtaagttnttttagacctttaaattttcgttacttgtacagtactagttaattaaattacgtggggttcgtaccggttcgggaaccgtaaaggggaccctaaagggttaacgtaaaactacggaaacgttacgttcggtaagggctaacggccctacttacgttccgttcgtttcc

SEQ ID NO: 415291 - DNA, 653 bp, Homo sapiens
  misc_feature: GZ8MTXP01BEGOR.3.55.E11.1.454.CMB.2.raw
  modified_base (204)..(204): a, c, t, g, unknown or other
  modified_base (292)..(292): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangcccacctctcctgcagggccagtcagagtattagcagctaacttgcctggaccagcaagaaacctggccaggctcccaggcctcctnatctatgctgcactcccgaccgagggcccacgttcggtaacctccccgaagtccccctagggtttcaggtcggcaagggttcggggtcgtaggggaacctagggtacgtttcaacgtttcctaccaacctatccgaacgccacggccctaggctagttctaggaaacgttagttttagactttaagttttattcgttagtaccaagtactaagttaaattaaattaacggttcgggttacggtaccggtttacggaaccggtaaacggggttaaccgaaagggttaaacgaaaacgtaacgaaaacgttaacgttggttaacggcttaacgacctaaccgttacgttcgttaacgtttccc

SEQ ID NO: 415292 - DNA, 703 bp, Homo sapiens
  misc_feature: GZ8MTXP01AP92W.3.55.E11.1.454.CMB.2.raw
  modified_base (203)..(203): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaancgccaccctctcctgcagggccagtcaagagtattagcagactaactgcgtgtaccagacaagaaacctggaccgacggcctacccgaggccctacctcattctatcgactcgacctacgtcccgaaccgacgggaccctacgttacggtaactccccgacggccccgtaggtttcgaggtcggacgtaagggttcggggtcgtaggggaaccgtaggtacgttcctaatcccttaccaaccgtagtccgaagtccgaaccggtctacgtcgtaacggttcgtagtaagtttactttttgaacctttaaagtttacttacgttgttaccgagttaccgtaagtttaactaaacgttaacgggttcgggtacggttaccggttaacgggaaccggtaaagggttaaacccgttaaagggaaacgtaaaacgaccgttaaaaccggttgttacgggtaaggacctaaggaaccctacttacgtaacccgttttcgtaacccg

SEQ ID NO: 415293 - DNA, 662 bp, Homo sapiens
  misc_feature: GZ8MTXP01CAMZY.3.55.E11.1.454.CMB.2.raw
  modified_base (215)..(215): a, c, t, g, unknown or other
  modified_base (283)..(283): a, c, t, g, unknown or other
  modified_base (289)..(289): a, c, t, g, unknown or other
  modified_base (320)..(320): a, c, t, g, unknown or other
  modified_base (340)..(340): a, c, t, g, unknown or other
  modified_base (352)..(352): a, c, t, g, unknown or other
  modified_base (376)..(376): a, c, t, g, unknown or other
tcagagacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtcctnaggctccgaggcaagggggctgggaggtggggtggctagttatgtcacatgataggaaagaaaaaatnttacgnagactcctagaaggtcattcacatctcaganacaattaccaacaacacctntattcacaaatnaacagacctagaacaactagaaanaccgacggactatactatttactggtacgacgaagagactacgaacggtaccggaacgaacgaaatcggtaaaccgttacgggggtaacgttaaaccccgttaccaaggtaaacccgtaccggtacgggggacccgtaaccggggtaaaccccttggggtacccctaacccggtccctaaccgttccgaccggtccccttacccgaacccgaacgggttccccttacgttcccgggttccctacccccgttcggacccctacccgttccctaaccgaacgaacccg

SEQ ID NO: 415294 - DNA, 670 bp, Homo sapiens
  misc_feature: GZ8MTXP01BN82X.3.55.E11.1.454.CMB.2.raw
  modified_base (205)..(205): a, c, t, g, unknown or other
  modified_base (274)..(274): a, c, t, g, unknown or other
  modified_base (279)..(279): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaancgcccacctctcctgcgaggccagtcagatatagcagcaacttagctggacagcagaactgcagctccngctcncatctatgctgcactccaccgacggccacgtgtactcccgagccccgtaggttcaggtggcgtaacgggtgggtcgtgggaactaggtacgtttccgaactttccgtacaaccctagtacgacgtaccaagtcccgttaggacccttagtccgtaagttaaagtttagttttacgaactttaaacttttaacgtttacgttacgttactaaggtacttaaagttaaagtttaaacgttaacggttcggggttaacgggtaccggtttcgggaaacccggtaaaggggttaaaccgtaaagggttaaacggtaaaacgtaaccgttaaaaacggttcgttacggtaacgggtcccttaaggaccctaccttacgttccgttgtttaaccccg

SEQ ID NO: 415295 - DNA, 643 bp, Homo sapiens
  misc_feature: GZ8MTXP01B81WO.3.55.E11.1.454.CMB.2.raw
  modified_base (205)..(205): a, c, t, g, unknown or other
  modified_base (334)..(334): a, c, t, g, unknown or other
tcagagacgcactccacgaccggtgctcgatttagcactcgcacggttggggtttgggggaggaactgctcagttaggacccagacggaaccatggaagccccagcgcagcttctcttcctcctgctactctggctccagatgccatggagaagtggtgatgacgcagtctccagccacctgtctgtgtctaccgaaggggaaancgccacctctcctgcagggcagtcagatatagcagacaacttgctggtaccagcaagaacctggaccaggcctcccgaggcctctcatctatgctcgacactcccaacgacgggccacgtggtaacccnccgacgtcccgtaggtgaggtcggacgtaagggtcgggtcgagggaactagtacttactacttcacactatacagacacgtccgtagacgtagtacgtaagttaattatttacgtaatttaaaggtttacttacgtacgtaactaagtacgtaaagttaaacgttaaacgttacggtacgggtaacggtaaccgggtaaccggaaaccggaaagggttaaaccgtaaaggttaaacgtaaaacgtaaccgaaaacggttcgttacggtaacgacgtaacgtacctacgttacgttccgttcgttaaccg

SEQ ID NO: 415296 - DNA, 711 bp, Homo sapiens
  misc_feature: GZ8MTXP01CPCCA.3.55.E11.1.454.CMB.2.raw
  modified_base (204)..(204): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgcccaccctctcctgcagggccagtcagagtatagcagctaactgcctggtaccagacagaaacctggccaggcctcccgaggcctcctcattctatcgctcgcactcccgaccgagggccctacgttcggtaactccccgaggtccccctagggtttcagggttcggcgtaagggttcggggtccgtagggggaacctagggttacggtttcctaagtttccgaccctaacctagttaccacgggtccaacggtccccgttaggaccctaaggttcccttaggtaaacgtttacgtttttacggtaaacctttaaagtttttttaacttaccgttaggttaacctaacgtacgttaaagtttaaagttaaacgttacggttaggggtacgggttaaccgtttccggggaaacccgtaaaggggaaaccgtaaagggttaaagaaaacgttcgaaaaacgttcgttaggtaacgctaacgacctacgttattcgttcgtttaacc

SEQ ID NO: 415297 - DNA, 658 bp, Homo sapiens
  misc_feature: GZ8MTXP01A5YD3.3.55.E11.1.454.CMB.2.raw
  modified_base (256)..(256): a, c, t, g, unknown or other
  modified_base (273)..(273): a, c, t, g, unknown or other
  modified_base (386)..(386): a, c, t, g, unknown or other
  modified_base (431)..(431): a, c, t, g, unknown or other
tcagagacgcactccacgaccggtgctcgatttagcactcgcacgttgggtttgggctgagctgggttttcctcgttgctcttttaagaggtgtccagtgtcaggtgcagctggtggagtcgtgggggagcgtggtccagcctgggaggtccctgagactctcctgtgcagcctctggattcaccttcagtagatatgctatgtagttgggtcctcaggctccgaggcaagggggctgggagtgggtgctagttangtcacatgataggaaanaaaaaaatattacgacagacctccccgtggaacgggtcgattccaaccatcctaccgaagacgaccaaacttccaaacaaaccacccttgtaactttcgaccaaaatgaaacngacctagaagaactgaaacgacacggacttatctaattactggtnacgtagacgatccgaagtcccggaaagtacgaaatcgtaactacggggggtacgttaaaccttccgaagtaacctacggcggggtaccaaacggggaaccccttgggtacctaacccggtctaaccccgttacgaccggtccccttacccgaaaccgtaccgggccccacgttcccggtccccttacccccgtggcccctaaccccgttcctaacccgaacgtcccg

SEQ ID NO: 415298 - DNA, 571 bp, Homo sapiens
  misc_feature: GZ8MTXP01BM8HG.3.55.E11.1.454.CMB.2.raw
  modified_base (203)..(203): a, c, t, g, unknown or other
  modified_base (280)..(280): a, c, t, g, unknown or other
  modified_base (291)..(291): a, c, t, g, unknown or other
  modified_base (299)..(299): a, c, t, g, unknown or other
  modified_base (338)..(338): a, c, t, g, unknown or other
  modified_base (380)..(380): a, c, t, g, unknown or other
  modified_base (413)..(413): a, c, t, g, unknown or other
  modified_base (443)..(443): a, c, t, g, unknown or other
  modified_base (558)..(558): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccacctgtctgtgtctccgaggggaaangcccacctctcctgcagggccagtcagtagtattagcagctaacttagccgtaggtaccagacagaaacctggaccnggcctacccgngcctcctnatctatgctcgctactccgacccgaggccacgtggtacncccgagccccgtaggttcaggtcgcgtaagggttcggggtcnggggactagggtactttcacgtttcacccactntcagctacgctacgctaggtctaggaattntttagtactttaagtttattacgtgtacagtactaagttattaacgtagtggtacgtacgtcggaacaagggttacaaaggttacgaaatcgaaacgcttggcgactcgctaacnttccgttcgtttc

SEQ ID NO: 415299 - DNA, 648 bp, Homo sapiens
  misc_feature: GZ8MTXP01A3109.3.55.E11.1.454.CMB.2.raw
  modified_base (203)..(203): a, c, t, g, unknown or other
  modified_base (299)..(299): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccacctgtctgtgtctccgaggggaaancgccaccctctcctgcagggccagtcaagagtattagcagactaacttagcctggaccagacaacgaaaccgtggccaggcctcccgaggcctccncatctatgctgcactcccacgaggcctacgtcggtactcccgagtccccgtagttcgaggtcggctaagggttcgggtccgtagggaccaggtacgttcacgttcctaccgaacctagtcaacgcctaacgtccgtacgctacgttcgtagtaaagttacttttagaactttaaatttacttacgtagtacgtagtactaagttaactaaacgttacgtcgggggttacgtaccgggttcgggaaacccggtaaagggaccgtaaagggttaaacgtaaaacgtaacgttaaaaccgttcgttacggtaacggactaacgacccgtaccttacgttcttccgtttaacc

SEQ ID NO: 415300 - DNA, 713 bp, Homo sapiens
  misc_feature: GZ8MTXP01EJX7T.3.55.E11.1.454.CMB.2.raw
  modified_base (203)..(203): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctccagatgccatggagaagtggtgatgacgcagtctccagcccaccctgtctgtgtctccgaggggaaancgcccacctctcctgcagggccagtcagagtattagcagcaacttagcctggtaccagcaagaaacctggacccaggcctccaggcctacctcatctatgctagcactcccgaaccgtagggccctaacgttcggtaactccccgaagtcccccctaggggtttcagggtcggaccgtaagggtcgggtcgtaggggaaccaggtacgtttctaagttccctacaccctatacgacgacgtacgtcccgttaggcctaagttccgttaagaaagttattttttagacctttaaagtttttatttaaccgttagttaccgaagtacctaaaggtttaaattaaaggttaaccgttaggggttacgggttaaccggtttcggggaaaccccgtaaagggggttaaaccctaaaagggggttaaacaaaacgttaaccgaaaaaccgggttaacttaggggttaacggaaccttaacggaccctaacttaggtttccctttggttttaacccc

SEQ ID NO: 415301 - DNA, 657 bp, Homo sapiens
  misc_feature: GZ8MTXP01EJ9JG.3.55.E11.1.454.CMB.2.raw
  modified_base (268)..(268): a, c, t, g, unknown or other
  modified_base (274)..(274): a, c, t, g, unknown or other
  modified_base (575)..(575): a, c, t, g, unknown or other
tcagagacgcactccacgaccggtgctcgatttagcactcgcacgttgggtttgggctgagctgggttttcctcgttgctcttttaagaggtgtccagtgtcaggtgcagctggtggagtcgtggggggaggcgtggtccaggcctgggaggtccctgagactctcctgtgcagcctctggattcaccttcagtagatatgcttatgtattgggcctcagggcctaccgagggcgaagggggtctgggaggtgggggtgctaggttangtacanagtagaataaggaaaagtaaaaaatatacgcaagacctccgtaggtaaggtcattacacatcctaccaagacaactaactaccaaacactaccctgtaatttacgactaaagtacgaaacacgtaaccctaggaacgtaaaccgtaggaaacgtaccacggtactacttacttattacgtagtagacgaagagaactcgacgtaccgggaagaacgtaaatcgaaccgtacggggtcgttaaaccctcgacgtaccgtacgtcgggaccgacgggtacccgtcggactaccgtctcccgtnaccgcccttacgaccgtaacggccccttagttccccggtccctccccgtcgcccctacccttccgtaacccgaagtaacccg

SEQ ID NO: 415302 - DNA, 552 bp, Homo sapiens
  misc_feature: GZ8MTXP01BB6T1.3.55.E11.1.454.CMB.2.raw
  modified_base (203)..(203): a, c, t, g, unknown or other
  modified_base (258)..(258): a, c, t, g, unknown or other
  modified_base (284)..(284): a, c, t, g, unknown or other
  modified_base (535)..(535): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccacctgtctgtgtctccgaggggaaancgccaccctctcctgcgagggccagtcagatatagcagcaacttagctggtaccngcaagaactgccaggctccgagctcnatctatgctgcactccacgaggccacgtggtactccgagcccctaggttcagtcggctaagggtgggtctgggacaggtacgttcattcacacatcgagcagcctgctagtctagtagttatttgaacttaagtttattacgttgtacagtactaagttaataaacgtacgtgggtacggtacgttcgggaacgtaaggggactaaagggataaacgtacgaaacgttacttggtcggctcggacaccttnttaacgttcgtttaacc

SEQ ID NO: 415303 - DNA, 772 bp, Homo sapiens
  misc_feature: GZ8MTXP01A6RI7.3.55.E11.1.454.CMB.2.raw
  modified_base (184)..(184): a, c, t, g, unknown or other
  modified_base (197)..(197): a, c, t, g, unknown or other
  modified_base (206)..(206): a, c, t, g, unknown or other
  modified_base (236)..(236): a, c, t, g, unknown or other
  modified_base (241)..(241): a, c, t, g, unknown or other
tcagagacgcactccacgaccggtgctcgatttagcactcgcacgttgggtttgggattcacgttgcagatgtaggtccctgagactctcctgtgcagcctctggattcaccttcagtagatatgctatgtattgggtccgtcaggctccaggcaaggggctggagtgggtgcagttatgtcanatgataggaaaanaaaaaaatntacgcagactcctgaaggtcattcacatcncaganacaattccaaacacacctgtattgacaaatgaaacagcctagaacgaactgaacgacacgctatctatactgtgcgagagatcgacggtaccggaacgaacgtaaatcggtaaaccgttacgggtcggttaaaccccttcccgaaaggtaccttaaccgggtcgggggacccctaaaccggggtaaccccttgggtacccaaccccggttccttccccttaccgaccggacccccttacccgaaaccccggaaaccgggggccccctaacggttccccgggtttccccctttaacccccccgggttcgggaccccctaccccctttaccccgtaacccgaaacggtaacccggcccctaacccggttccggggtccggggggacccctaaccgggaaccgggtcccccgggccccggttcgggggaacccttcgggccccggtttacgggacccgttaaacggggttacccttaacccggtttcccgggtaacggttccggtaccgttccgttccggttaacgggccgggg

SEQ ID NO: 415304 - DNA, 749 bp, Homo sapiens
  misc_feature: GZ8MTXP01AMUSQ.3.55.E11.1.454.CMB.2.raw
  modified_base (206)..(206): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccgaaggggaaancgcccaccctctcctgcgagggccagtcagagtatagcagcaacttgcctaggtaccagcaagaacctggaccaggcctacccgaggcctcctcactctatcgctgcactccgaccgacgggcctacgttcggactcccgaggtcccctagggttcgagggtcggacgtaagggttcggggtcgtagggggaacctacggttacctttccaccgttcctacccaacctactccgaacggtccaacggtacgttacggggacgtacccgttaaggtaaacggtttacgttttcggaacgttaaggtttacgggtttaacgtttaccggttaggttaaccggttaaggggtttacctttaacggtttacgggtttaacccttccggttaacccggtttcgggtttaccgtacgggtttccgggtttacggggacccgggtaacggggggttaaacccgtaagggggttacggaaacggttaacgttaaccggaaaacggttacggttgggttcggtaccgttacggtaacccttaaccgttaacg

SEQ ID NO: 415305 - DNA, 839 bp, Homo sapiens
  misc_feature: GZ8MTXP01A4DPN.3.55.E11.1.454.CMB.2.raw
  modified_base (203)..(203): a, c, t, g, unknown or other
tcagagacgcactccacgaccggtgctcgatttagcactcgcacgttgggtttgggggaggaactgctcagttaggacccagacggaaccatggaagccccggcgcagcttctcttcctcctgctactctggctcccagatgccactggagaagtggtgatgacgcagtctccagccaccctgtctgtgtctccgagggaaancgccaccctctcctgcagggccagtcagagtattagcagctaacttacgccgtaggtaccaggaccaaacggaaaccctgggacccgacgggtccctaccccgacgggtccctccccttcaactttcctaagtcggccttcgaccaaccgtaccccgacccggacggggtaccctaacgtcggtaacctccccgaggtcccgtacggtttacgaggttgggaccgtaggggttcggggtacgtaacggggtaaacctaaaaggttctactttccgtacctaacccgtattacccgaaggacctacggtccccgttaggaccgtaacggtttacgtaacggttaaacggtttatttttacggtaaaccttttaaaagtttttaccttaaacgggtttcgtaaccggttaagttaccgttaaaggtttaaatttaaacgttaaaccgggttcggggttaacgggtaacccggggtttaaccgggaaccccggtaaaaggggggtaaaccctaaaagggggttaaacgtaaaaccggttaaccgaaaaaacgggttaccgttggggttacccgggttccgttaacgggacccttaaccggtacgtttcccttacggtttaacccgtttcccttaacccg

SEQ ID NO: 415306 - DNA, 637 bp, Homo sapiens
  misc_feature: GZ8MTXP01C8DO1.3.55.E11.1.454.CMB.2.raw
  modified_base (205)..(205): a, c, t, g, unknown or other
  modified_base (215)..(215): a, c, t, g, unknown or other
  modified_base (219)..(219): a, c, t, g, unknown or other
  modified_base (260)..(260): a, c, t, g, unknown or other
  modified_base (291)..(291): a, c, t, g, unknown or other
  modified_base (298)..(298): a, c, t, g, unknown or other
  modified_base (439)..(439): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaangcccaccctntccngcagggccagtcagtagtatagcagacaacttgcctggacngacagaacctggccaggcctccgaggcctcncatctangctgcactccacccgtaggacctacgtcggtacctcccgacgtccccgtaggttaccaggtcggacctaagggttcgggtcgtagggactaggtacgtctattcgcacatcacgcgacgctggactagtcgtagtaaagtntttaacgactttaaattttacgttacttagtaccgtagtacgttaaagttaaagtaaacgttacggttgggttaccggtaaccggtttaccgggaaacccgtaaacggggttaaactaaaacgggttaagtaaaaccgtacgttaaaacgttgttacggtaacgacttcgacctacgttatttccgttgtttaacccg

SEQ ID NO: 415307 - DNA, 558 bp, Homo sapiens
  misc_feature: GZ8MTXP01EHH2Q.3.55.E11.1.454.CMB.2.raw
  modified_base (203)..(203): a, c, t, g, unknown or other
  modified_base (289)..(289): a, c, t, g, unknown or other
  modified_base (427)..(427): a, c, t, g, unknown or other
  modified_base (432)..(432): a, c, t, g, unknown or other
  modified_base (503)..(503): a, c, t, g, unknown or other
  modified_base (518)..(518): a, c, t, g, unknown or other
  modified_base (528)..(528): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccacctgtctgtgtctccgaggggaaanacgccaccctctcctgcagggccagtcagagtatagcagcaacttagcctggtaccagcaagaactggccaggctcccagcctctnatctatgctgcactcccaccgagggcctagtcggtactcccgagtccccctaggttcaggtggcgtaagggttgggtcgtggggaactggtagtttcattctacacctatcagctagcctggctagtcgtagaagttntttanactttaaatttatactgtcagtactaagtataagtacgtggtgtacgtcgaacgtaaaggactaaaggaanaaactacgaaaacgngttggaaggntaacgctaaccttgttaaccgttgttaacc

SEQ ID NO: 415308 - DNA, 735 bp, Homo sapiens
  misc_feature: GZ8MTXP01AR1ZS.3.55.E11.1.454.CMB.2.raw
  modified_base (205)..(205): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaangcccaccctctccgtgcgagggccagtcagagtatagcagcaacttagcctggtaccagacaagaaccgtcggaccgacggccctaccgacgtcctcctacactctatcgctcgacacctacccgaccggacggcctacggttacgtacctaccccgacggtacccccgtagggttacgacgggtaggaccgtaagggggttacgggttcggtaggggaaccgtacgggtacttcgtaacgttcctaacccaaccgtactaccggaagcccgtaccggtcctaacgggtacgttaaccgttacggtaaagttaaaagtttcgttttaacgtaaccttttaaattttacgttacgtacgttaacgtaggtaacctaaagtttaacgtaaacggttacgtggggttaacgtaccggttaccggggaaacggaaaacgggttaagtaaacgggttaaactaaacgtaacccggttaaaagttcgttacggtaacggactaaccgaactacgttagttaaccttcgtttaaccc

SEQ ID NO: 415309 - DNA, 723 bp, Homo sapiens
  misc_feature: GZ8MTXP01BN4SR.3.55.E11.1.454.CMB.2.raw
  modified_base (206)..(206): a, c, t, g, unknown or other
  modified_base (297)..(297): a, c, t, g, unknown or other
  modified_base (321)..(321): a, c, t, g, unknown or other
tcagagacgcactccacgaccggtgctcgatttagcactcgcacgttggggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaangcccaccctctcctgcgagggccagtcagagtattagcagcaacttgcctggtaccagacagaaacctggccaggctcccgaggcctcctnacgtctatgctgacatcccaccgnggcctacgtcggtactcccgagtccccgtaggttcaggtcggactaacgggttcgggtcgtaggggaacctagggtactttaccgtacttttaccgtacccaacctacttaccgaagtccgaacgggtccccttagggtaccctaaggggtttacctaaaggggtaaactttacgtttttagggaaacctttaaagttttttaactttaacgttacggtacctaagtaccgttaaaggtttaaaccttaaagttaaccggttgggggttaccggttaccgggttccggaaaaccggtttaaacggggaaacccgtaaaagggttaacgaaaaacgttccgaaaaacggttacttggggttaacgcgtaacggacccttaaccttcgtttccgttgttaaccc

SEQ ID NO: 415310 - DNA, 696 bp, Homo sapiens
  misc_feature: GZ8MTXP01A5X3M.3.55.E11.1.454.CMB.2.raw
  modified_base (202)..(202): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccacctgtctgtgtctccgagggaaancgccaccctctcctgcagggccagtcagagtatagcagctaacgttagcctaggtaccagacaagaacctggaccaggcctcccgaggtcctcctcatctatgctgctactcccgaccgacggccacgtcggtactcccgagcccccgtaggttcacggtcggaccgtaagggtcggggttccgtggggtaaccgtaaggttaccgtttactacgttcctaccacccgtataccgaacgccgacgtcctacgcgtacgtccgtaagtaagttacgtttactaactttattttaacgttacgttacgttaccgtaaggtacttaagttaaacgttaaacgttaacggttaggggttacgggtaaccggtttccggggaaaccgtaaacgggggttaaaccgtaaagggttaaacgtaaaagttaccgaaaaaccggttgttacgggtaacgggtacgttaacggcctaaccgttaccgttcgttcgtttaacccg

SEQ ID NO: 415311 - DNA, 817 bp, Homo sapiens
  misc_feature: GZ8MTXP01E2FB7.3.55.E11.1.454.CMB.2.raw
  modified_base (207)..(207): a, c, t, g, unknown or other
tcagagacgcactccacgaccggtgctcgatttagcactcgcacgttggggtttggggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanacgccaccctctcctgcagggccagtcagagtatagcagcaacttagcctggtaccagcacgaaacctggccaggcctcccacggcctcctcatctatgcctgcactcccaaccgacgggccctacgttcgggtactccccgagcccccgtaaggggtttcaagggttcggggcgttaaaggggttcgggggttccgttgggggaaacgtaaacggtacggtttcctaagtttccctacctaacccgtagtacctacggccctaacggtccccgtcggtaccgtaacggtttaccgtaacggttaaaacgggtttactttttaacggacccttttaaaacggtttttaactttaccgttaccgggttaccgtaaaggttaccccgtaaaggtttaaacgtttaaaaacgtttaaaccgggttcggggtttaccgggggtaaacccggtttcccgggggaaaccccgggtaaacgggggttaaaccccggtaaaaggggttaaaccggtaaaaacgttaaccccgttaaaaaaccggaaccggttttacggggtcgggtaccggttaaccggaccctaccccgttaagtttccccgttggtttaacccccg

SEQ ID NO: 415312 - DNA, 603 bp, Homo sapiens
  misc_feature: GZ8MTXP02F0U78.3.55.E11.1.454.CMB.2.raw
  modified_base (204)..(204): a, c, t, g, unknown or other
  modified_base (388)..(388): a, c, t, g, unknown or other
  modified_base (420)..(420): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttagcctggtaccagcaagaaacctggccaggcctcccaggcctcctcatctatgctgcactcccaccgagggccacgtggtactccccgagccccaggttccagtggcaggttggggtctggggacaggtagttcatttcncaccatcagcagcctgctagtctagaaagttntttagacttaaattttacttactgtacagtactaagttaattaaagtaacggttgggtacggtaccggttaccggaaaccggtaaaaggggaaaccgtaaaagggtaaacgtaaaacgttaaccgaaaaacgtaacgtaggtaacggtacgtacggacctaaccgtacttccgttacgttacc

SEQ ID NO: 415313 - DNA, 500 bp, Homo sapiens
  misc_feature: GZ8MTXP02F3H4V.3.55.E11.1.454.CMB.2.raw
  modified_base (202)..(202): a, c, t, g, unknown or other
  modified_base (365)..(365): a, c, t, g, unknown or other
  modified_base (393)..(393): a, c, t, g, unknown or other
tcagagacgcactccacgaccggtgctcgatttagcactcgcacgttgggtttggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccacctctcctgcagggccagtcagagtatagcagcaacttagcctggtaccagcagaaacctggccaggctcccaggctcctcatctatgctgcatccaccagggccactgtatcccagccccaggttcagtggcagtgggtctgggacagagttcattcncaccatcagcagcctgcagtctgaagtntttgctaatttattactgtcagctagtataataactggtagtacgttcggaccaaagggaccaaaggtaagaaatacaaacgactagaaggctagcacactcgtatc

SEQ ID NO: 415314 - DNA, 542 bp, Homo sapiens
  misc_feature: GZ8MTXP02G2QWB.3.55.E11.1.454.CMB.2.raw
  modified_base (202)..(202): a, c, t, g, unknown or other
tcagagacgcactccacgaccggtgctcgatttagcactcgcacgttgggtttggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangcccaccctccctcgcacgggccgacgtcagagtattagcagcaacttaagcctcggttaccgacgcagaaaccgtacggccgacggacgtccccacggctcctccatctatgctgtcatccaccacgggccgactggtatcccacgcaccggttcagtaggcagtggggtctggggacagagttcagttctcaccatcagcagcctgcacgtctgaagtatttgtcaaattttagttacttagtcagcaataatataaacgtgggttggacgtttcggacaacggacgaacgtaagaaatacaaaccgaacgtgttggctgacgccaatcttgctttac

SEQ ID NO: 415315 - DNA, 525 bp, Homo sapiens
  misc_feature: GZ8MTXP02HKQ70.3.55.E11.1.454.CMB.2.raw
  modified_base (398)..(398): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagcccaccctctcctgcagggccagtcagagtattagcagcaacttagcctggtaccagcagaaacctggccaggctcccaggctcctcatctatgctgcatcccacagggccatggtatcccagccccaggttcagtggcaggtgggtctggggacagagttcattctcaccatcagcagctgcagtctgagtntttgcttaatttattactgtactagcagtataataacgtggtagtacgttcggacctaaaggggacctaaaggtaagaaactacgaaaacgaaccgtgtaacggctacgaccacacttactcgtacc

SEQ ID NO: 415316 - DNA, 534 bp, Homo sapiens
  misc_feature: GZ8MTXP02HNYXM.3.55.E11.1.454.CMB.2.raw
  modified_base (203)..(203): a, c, t, g, unknown or other
  modified_base (400)..(400): a, c, t, g, unknown or other
  modified_base (414)..(414): a, c, t, g, unknown or other
tcagagacgcactccacgaccggtgctcgatttagcactcgcacgttgggtttggggaggaactgctcagttaggacccagacggaaccatggaagccccagcgcagcttctcttcctcctgctactctggctcccagatgccactggagaagtggtgatgacgcagtctccagcccaccctgtctgtgtctccaggggaaanagccaccctctcctgcagggccagtcagagtattagcagcaacttagcctggtaccagcaagaaacctggccaggctcccaggctcctcatctatgctgcatccaccagggccactggtactcccagccccaggttcagtggctagtgggtctgggacagtagttcattctcacatcagcagcctgcagtctgaatntttgactaaatttnttactgttacagtcaagttataataacgtggtaggacttacgggacgaaaggggtaccaaagggtaagaaaacttcgaaaaaccgtagtggaacggtctaggccaactactcttagttcc

SEQ ID NO: 415317 - DNA, 503 bp, Homo sapiens
  misc_feature: GZ8MTXP02JFVBY.3.55.E11.1.454.CMB.2.raw
  modified_base (202)..(202): a, c, t, g, unknown or other
  modified_base (289)..(289): a, c, t, g, unknown or other
  modified_base (373)..(373): a, c, t, g, unknown or other
  modified_base (397)..(397): a, c, t, g, unknown or other
  modified_base (467)..(467): a, c, t, g, unknown or other
tcagagacgcactccacgaccggtgctcgatttagcactcgcacgttgggtttggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaacctggccaggctcccaggctcctnatctatgctgcatcccacagggccatggtactcccagccccaggttcagtggcagtgggtctgggacagagttcattctcaccntcagcagcctgcagtctagaagtntttgactaatttatactgtcagtcagtataatacgtggtagtacgttcggaccgaagggaccaaaggtanaaatcgaaaacgactggtgctagacacatctcgttc

SEQ ID NO: 415318 - DNA, 541 bp, Homo sapiens
  misc_feature: GZ8MTXP02HIJ61.3.55.E11.1.454.CMB.2.raw
  modified_base (205)..(205): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaangccaccctctcctgcagggccagtcagagtattagcagcaacttagcctggtaccagcagaaacctggccaggctcccaggcctcctcatctatgctgcatcccaccagggcccacgtggtactccccgagcccccagggttcaggtggcaggttgggtctggggacaggtagttcattctcaccatcagcagcctgcagtctagagtattttgacttaaatttatttactgtacagtctagtaataatacgtggtaggtacgttcggaccgaagggacctaaaggtagaaactacgaaaacgtacgtagtaaggctacgacacgtactctagtcc

SEQ ID NO: 415319 - DNA, 556 bp, Homo sapiens
  misc_feature: GZ8MTXP02GEOE9.3.55.E11.1.454.CMB.2.raw
tcagagacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtccgtcaggctccaggcaaggggctggagtgggtggcagttatgtcacatgatggaaagaaaaaatattaacgcagactccctgaaggtcgattcaccatctccagagacaattccaaacaacaccctgtattgacaaatgaacagcctgagaactgaagacacgctatctaattactgtgcgagagatcagtccgagacgaatgactacggtgtaaccttcagactacgtggggaccagggaaccctggtaccaccgtctacctcgacgccctaccaaccgaacgggcccctagttccggtccctttccccccgaggccccaacccctcccgtaccaaaacgccg

SEQ ID NO: 415320 - DNA, 524 bp, Homo sapiens
  misc_feature: GZ8MTXP02IFQC2.3.55.E11.1.454.CMB.2.raw
  modified_base (251)..(251): a, c, t, g, unknown or other
  modified_base (335)..(335): a, c, t, g, unknown or other
  modified_base (387)..(387): a, c, t, g, unknown or other
  modified_base (415)..(415): a, c, t, g, unknown or other
  modified_base (474)..(474): a, c, t, g, unknown or other
tcagagacgcactccacgaccggtgctcgatttagcactcgcacgttgggtttgggctgagctgggtttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtccgtcaggctccaggcaaggggctggagtgggtgcagttangtcacatgatggaaagaaaaaatattacgcagactccctgaaggtcgattcaccatctcagagacaattccaaacaacaccctntattgacaaatgaacagcctgagaactgaaagacaacggctatactattaangtagcgagagatcagtcgacgacgaaanagacgtacgtacgtactacacgactacgtaggacgacgacgtacgcgacgtctctcacnccaccaccacgaccgactcgtccgtcccgtcgccacctcctaccacgacg

SEQ ID NO: 415321 - DNA, 522 bp, Homo sapiens
  misc_feature: GZ8MTXP02HDK9B.3.55.E11.1.454.CMB.2.raw
  modified_base (202)..(202): a, c, t, g, unknown or other
  modified_base (288)..(288): a, c, t, g, unknown or other
  modified_base (384)..(384): a, c, t, g, unknown or other
  modified_base (390)..(390): a, c, t, g, unknown or other
tcagagacgcactccacgaccggtgctcgatttagcactcgcacgttgggtttggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtatagcagcaacttagcctggtaccagcagaaacctggccaggctccaggctcctnatctatgctgcatccacaggccactgtatcccagccccagttcagtgcagtgggtctgggacagagttcattctcaccatcagcagcctgcagtcngaagtnttttgactaattttattactgtcagtcaagtataataacgtgggtaggacgtttcggaccgaaaaggggaccaaaggtaagaaaactacaaaacggaacttgaaggcctaggaccaacctataccgttctac

SEQ ID NO: 415322 - DNA, 485 bp, Homo sapiens
  misc_feature: GZ8MTXP02HZGYQ.3.55.E11.1.454.CMB.2.raw
  modified_base (201)..(201): a, c, t, g, unknown or other
  modified_base (288)..(288): a, c, t, g, unknown or other
tcagagacgcactccacgaccggtgctcgatttagcactcgcacgttgggtttggggaggaactgctcagttaggacccagacggaaccatggaagccccagcgcagcttctcttcctcctgctactctggctcccagatgccactggagaagtggtgatgacgcagtctccagccacctgtctgtgtctccaggggaaanagccaccctctcctgcagggccagtcagagtattagcagcaacttagccctggtaccagcagaacctggccaggctccaggctcctnatctatgctgcatccaccagggccactgtatcccagccccaggttcagtgcagtgggtctgggacagagttcagttctcacatcagcagcctgcagtctgagattttgctagtttattactgtcagcagcgtagcaactgcctctcaccgttcggacggaggaccaggtcgagataacgaaacgactgagctagcac

SEQ ID NO: 415323 - DNA, 549 bp, Homo sapiens
  misc_feature: GZ8MTXP02G3R3T.3.55.E11.1.454.CMB.2.raw
  modified_base (203)..(203): a, c, t, g, unknown or other
  modified_base (293)..(293): a, c, t, g, unknown or other
  modified_base (447)..(447): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccacctgtctgtgtctccgaggggaaancgccaccctctcctgcagggccagtcagagtattagcagcaacttgcctggtaccagcaagaacctggccaggcctcccgaggcctcctnatctatgctgcatcccaccgagggccacgtggtactcccgagcccctaggttcaggtcggctagggttgggtctaggggacaggtagttcactttcaccacctatcagcagtccctagccagtctagaagtattttagacttaatttattactntacagtactagtaataatacgtggtacgtacgttacggacgaaacggacaaaggtaacaaatacgaaacgacgtagtaaggctacgacactctactcgttac

SEQ ID NO: 415324 - DNA, 628 bp, Homo sapiens
  misc_feature: GZ8MTXP02HRXLJ.3.55.E11.1.454.CMB.2.raw
  modified_base (216)..(216): a, c, t, g, unknown or other
  modified_base (281)..(281): a, c, t, g, unknown or other
  modified_base (322)..(322): a, c, t, g, unknown or other
tcagagacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattccaccttcagtagatatgctatgtattgggtcctnaggctccaggcaaggggctgggagtggggtggcagttatgtcacatgataggaaaagaaaaaatnttacgacagactccctaggaaggtcgattcacatctcaganacaatccaaacaacacctgtattcgacaaatgaacagcctagagaactagaaagaccacggactatactattactgtgacgagagatcgaaggtaccggaacgaaacgaaatcggaaacgtacgggttacggttaaacccttccgaagtaaccgttacggacgggggacccaacgggggaaccccgttgggtaccctaccggttcccttccctaccgtacgcccctacccgaacccgaacggggccccctaagtcccggtccctttcccccgacggtccccacccctttcccaccgaaacggcccg

SEQ ID NO: 415325 - DNA, 556 bp, Homo sapiens
  misc_feature: GZ8MTXP02F7J5S.3.55.E11.1.454.CMB.2.raw
  modified_base (259)..(259): a, c, t, g, unknown or other
  modified_base (357)..(357): a, c, t, g, unknown or other
tcagagacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcacgctcaatggccactacgtggactgggtccgccaggctccgagggaagggctggagtgggttggccgttntagagacacaactaacagtgacaccgcaacaatacgccgcgtctgtgaaaggcagattcaccatctacaaagagatgattcaagagaactcactttanctagacaatgaaacagcctagaacgaaaccgacgaacacggccgtactattattgtgtcaatagactagatacaacgacggtgtacctggtatcgcggtggtctacgtgggccgagggaccctggtaccaccgtctcctcacgccctaccaccgaacgggcccctagtccggtcccttcccccgtcggcccgcccgtcg

SEQ ID NO: 415326 - DNA, 600 bp, Homo sapiens
  misc_feature: GZ8MTXP02IKM9A.3.55.E11.1.454.CMB.2.raw
  modified_base (203)..(203): a, c, t, g, unknown or other
  modified_base (212)..(212): a, c, t, g, unknown or other
  modified_base (287)..(287): a, c, t, g, unknown or other
  modified_base (404)..(404): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccacctgtctgtgtctccgaggggaaangccaccctntcctgcagggccagtcagagtatagcagcaacttagcctggtaccagcagaaacctggcaggctcccagctcctnatctatgctgcatcccacgaggccacgtgtactccagcccctaggttcagtggctaggtgggtctgggacaggtagttcagttctacactatcagcagcctgccagtctagtaagtnttttagacttaaattttacttactgttacaagtctaaagttaataaagttaaacgttgggttaaggtaaccggtttacgggaaacccgaaaagggggtaaaacccaaaagggttaaaagaaaacgttacgaaaaaaaccggtacgttaggtaacgggccttaacggaccaaaccgtaatttccgttagtttaaccc

SEQ ID NO: 415327 - DNA, 539 bp, Homo sapiens
  misc_feature: GZ8MTXP02GXSS0.3.55.E11.1.454.CMB.2.raw
  modified_base (204)..(204): a, c, t, g, unknown or other
  modified_base (389)..(389): a, c, t, g, unknown or other
  modified_base (422)..(422): a, c, t, g, unknown or other
  modified_base (502)..(502): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgccaccctctcctgcagggccagtcagagtattagcagcaacttagcctggtaccagcagaaacctggccaggcctcccgaggctcctcatctatcgctgcatccaccgagggccacgtggtactccccgagccccgtaggttcaggtggctaggttgggtcgtgggacagtagttcatttcncaccatcagcagccctgcctagtctagaagttnttttagactaaattttcttactggtaccaggtactagtaataatacgtggtacgtacgttcgacgtaagggacaaggtanaaactacgaaacgatgcgctacgacacgatctacgtc

SEQ ID NO: 415328 - DNA, 597 bp, Homo sapiens
  misc_feature: GZ8MTXP02GMMUF.3.55.E11.1.454.CMB.2.raw
  modified_base (203)..(203): a, c, t, g, unknown or other
  modified_base (283)..(283): a, c, t, g, unknown or other
  modified_base (289)..(289): a, c, t, g, unknown or other
  modified_base (369)..(369): a, c, t, g, unknown or other
  modified_base (394)..(394): a, c, t, g, unknown or other
  modified_base (428)..(428): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctcgaggggaaangccacctctcctgcagggccagtcagagtatagcagcaacttgcctggaccagcagaaacctggccaggctccagctccnatctangctgcactcccaaccgaggggccctaacgtggtaactcccccgagccccgtaaggttccaggtggactaggttggggtcnggggaacaggtacgttcaatttccncaccatcgagcagccctgcctagtctagaaattntttgattaaatttacttagtgtacagtactaagttaaataaacgttacgtggtaacggtaccgttacggaaccggtaaaacgggtaaacctaaaaggtaaacgtaaaacgtaccgaaaaacgtacgtaggtaacggtacgtacgacctaccgtacgttccgtacgtacc

SEQ ID NO: 415329 - DNA, 598 bp, Homo sapiens
  misc_feature: GZ8MTXP02F9NST.3.55.E11.1.454.CMB.2.raw
  modified_base (277)..(277): a, c, t, g, unknown or other
  modified_base (347)..(347): a, c, t, g, unknown or other
  modified_base (399)..(399): a, c, t, g, unknown or other
tcagagacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtcctcaggctccaggcaaggggctggagtgggtggcagttatgtcacatgataggaaagaaaaaatntacgcagacctcctagaaggtcattcaccatctacagagacatccaaacaacacctgtattcgacaaatnaacagcctagacgaactagaaagacgacgactatctattactgtgacgaganatcgacgtccggaagaacgaaagtacgaacgtaacgggtacgttaaacccttcgaaggtaacctacggtcggggaccgaacggggaacccttgggtaccctacggttcctccctacgaccgccctaccgaaccgacgggaccccagttcccggtccctttcccccgaggcccctacccctccgtacccgaacgtacccg

SEQ ID NO: 415330 - DNA, 517 bp, Homo sapiens
  misc_feature: GZ8MTXP02GEJ8L.3.55.E11.1.454.CMB.2.raw
  modified_base (203)..(203): a, c, t, g, unknown or other
  modified_base (211)..(211): a, c, t, g, unknown or other
  modified_base (307)..(307): a, c, t, g, unknown or other
  modified_base (402)..(402): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccacctntcctgcagggccagtcagagtatagcagcaacttgcctggtaccagcagaaacctggccaggcctcccaggcctcctcatctatgctgcatccacnggcctatgtactccagcccaggttcagtggcaggtgggtcgtggggacaggtacgttcatttcctacaccatccagcagcctgccagtctgaatntttagctaaatttatactgtacagctagtataataacgtggtacgtacgttcgacgaaacgggacaaaggtagaaaactcgaaaacgtatgtaagtctacgacactatctagttc

SEQ ID NO: 415331 - DNA, 647 bp, Homo sapiens
  misc_feature: GZ8MTXP02IX6GN.3.55.E11.1.454.CMB.2.raw
  modified_base (203)..(203): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccagcctccgagcctcctcatctatcgctgactactcccaccgacggcctacgtggtacctcccgacgccccgtaggtccaggtcggctaggggttcgggtcggtagggactaggtacgttctatttccaccaccgtactcacgacgtacgtcctcgcctacgttacgtagtaacgttattttacgactttaaattttactttacgttacgtacgtaagtactaagttaaacttaaagttaaacggttgggttacggtaccgggtttaccggaaccggtaaacgggtaaaccgtaaagggttaaaactaaacttaaacgaaaaccgtacgttacggtaacgtacgtacggacctacgtaacttcgtacgtttacc

SEQ ID NO: 415332 - DNA, 591 bp, Homo sapiens
  misc_feature: GZ8MTXP02HAQI7.3.55.E11.1.454.CMB.2.raw
  modified_base (204)..(204): a, c, t, g, unknown or other
  modified_base (294)..(294): a, c, t, g, unknown or other
  modified_base (315)..(315): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttgcctggtaccagcaagaaacctggaccaggcctcccgaggcctcctnatctatgctgcactccaccgngggccacgtggtactcccagtccaggttcaggtcggcaggttgggtcgtgggggactaggtagttcattcctacacctatcgagcacgcctgctagtctagtaagtatttagacttaagtttattactagtcagtactaagtaataaagtaacgttgggttacggtacggtttacggaaccgtaaacggggtaccgaaaagggttaaacgaaaacgttaccgaaaaacggtacgttaggtaacggacctacggacctactacgttactacgtttcc

SEQ ID NO: 415333 - DNA, 560 bp, Homo sapiens
  misc_feature: GZ8MTXP02HDVFW.3.55.E11.1.454.CMB.2.raw
  modified_base (204)..(204): a, c, t, g, unknown or other
  modified_base (289)..(289): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttagcctggtaccagcagaaacctggccaggctcccaggctccnatctatgctgcactcccaccgagggccagtggtactccccagccccctaggttccaggtcggctaggtgggtctggggacaggtagttcagtttcctacaccatcagcagcctgccagtctagtaagtattttagacttaaatttatttactgtacaagtactaagttaataaagtaacgttggtagggtaccgttcggaaccgaaagggaaccaaagggtaaagaaatacgaaaacgtacgtgtaacggctacgacacgactctcgttcc

SEQ ID NO: 415334 - DNA, 565 bp, Homo sapiens
  misc_feature: GZ8MTXP02H8V2P.3.55.E11.1.454.CMB.2.raw
  modified_base (204)..(204): a, c, t, g, unknown or other
  modified_base (296)..(296): a, c, t, g, unknown or other
  modified_base (418)..(418): a, c, t, g, unknown or other
tcagagacgcactccacgaccggtgctcgatttagcactcgcacgttgggtttggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaangccaccctctcctgcagggccagtcagagtattagcagcaacttagcctggtaccagcaagaaacctggccaggcctcccgaggcctccctnatctatgctgcatccaccgagggccactggtactcccagccccaggttcagtggcaggttgggtctggggacaggtacgttcagtttctacacctatccagcacgccctgcagttcagaatntttgactttaaagtttacttactgtacagctagtaataagtaacgtggtagtacgttcggaccgtaagggacctaaaggtaagaaaacttacgaaaacggtactggtaacggacttaggaccctaaactcgttcgttacgtttaccc

SEQ ID NO: 415335 - DNA, 526 bp, Homo sapiens
  misc_feature: GZ8MTXP02FM9KN.3.55.E11.1.454.CMB.2.raw
  modified_base (204)..(204): a, c, t, g, unknown or other
  modified_base (288)..(288): a, c, t, g, unknown or other
  modified_base (378)..(378): a, c, t, g, unknown or other
  modified_base (410)..(410): a, c, t, g, unknown or other
  modified_base (488)..(488): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccacctctcctgcagggccagtcagagtatagcagcaacttgcctggtaccagcagaaacctggccaggcctccaggcctccncatctatgctgcatcccaccgagggccactggtactccccagccccaggttcagtggcaggttgggtctggggacaggtagttcatttcncaccatcagcagcctgctagtctagaaagttnttttgacttaatttacttactgtacagctaagtataataacgtggtacgtacgtacggacgaaagggaccaaaggtanaaactacgaaaacgactagtgctagaccacatctagtc

SEQ ID NO: 415336 - DNA, 562 bp, Homo sapiens
  misc_feature: GZ8MTXP02JK1XN.3.55.E11.1.454.CMB.2.raw
  modified_base (203)..(203): a, c, t, g, unknown or other
  modified_base (293)..(293): a, c, t, g, unknown or other
  modified_base (379)..(379): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggcctcccaggcctcctnatctatgctgcatccaccagggccactggtactccccgagcccccaggttcagtggcaggtgggtctggggacagagttcatttcncaccatcagcagccctgcagtctagaagtattttgactaaattttattacttgtacagtactagtaacttaaagtacgtgggttaggtacgttcgggaccgaaacggggaccaaagggtaacgaaaacgtacgaaaaccggtaacttggtaaggactacggaccactactacttacgtttacc

SEQ ID NO: 415337 - DNA, 521 bp, Homo sapiens
  misc_feature: GZ8MTXP02IHEUK.3.55.E11.1.454.CMB.2.raw
  modified_base (203)..(203): a, c, t, g, unknown or other
  modified_base (364)..(364): a, c, t, g, unknown or other
  modified_base (393)..(393): a, c, t, g, unknown or other
tcagagacgcactccacgaccggtgctcgatttagcactcgcacgttgggtttgggggaggaactgctcagttaggacccaaacggaaccatggaagccccagcgcagcttctcttcctcctgctactctggctcccagatgccactggagaagtggtgatgacgcagtctccagccaccctgtctgtgtctccagggggaanagccacctctcctgcagggccagtcagagtattagcagcaacttagcctggtaccagcagaacctggccaggctcccaggctcctcatctatgctgcatccacagggccactggtactcccagccaggtcagtgcaggtggctggggacagagttcattcncaccatcagcacgcctgcagtctgaagtntttgactaattttatactgttcagctagtataatacgtggtgtacgttcggacgtaaacgggacaaaggtagaaaactacgaaacgtaacgtgtacggaactcggacacgattcgtacgttacttacg

SEQ ID NO: 415338 - DNA, 599 bp, Homo sapiens
  misc_feature: GZ8MTXP02F36LW.3.55.E11.1.454.CMB.2.raw
  modified_base (204)..(204): a, c, t, g, unknown or other
  modified_base (396)..(396): a, c, t, g, unknown or other
  modified_base (402)..(402): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcaagaaacctggccaaggctcccgaggcctcctcatcctatcgctgcacgtccaccgagggccactcggtactccccagcccctaggttcagtcggctacggtggggtctaggggactagtacgttcatttccncactancacgcacgctgctagtacgtagtagttatttagacttaatttactactgtacaagtactaagtaataacgtaacgtgggttacggtacggttaccgggaaccggaaaacggggtaaacctaaagggtaaacgaaacgtaaaccgtaaaacggtacgtaggtaacggtacgacgtacctacgtacttcgttacgttcc

SEQ ID NO: 415339 - DNA, 588 bp, Homo sapiens
  misc_feature: GZ8MTXP02IRTMP.3.55.E11.1.454.CMB.2.raw
  modified_base (253)..(253): a, c, t, g, unknown or other
  modified_base (277)..(277): a, c, t, g, unknown or other
  modified_base (283)..(283): a, c, t, g, unknown or other
  modified_base (389)..(389): a, c, t, g, unknown or other
tcagagacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtcctcaggctccaggcaaggggctgggagtgggtggcagttangtcacatgatggaaagaaaaaatnttacgnagactccctgaaggtcgattcaccatctccagagacaattccaaacaacacctgtatttcgacaaatgaacagcctgagaactagaagacacggctatctattacngtgcgagagatcgagtccggaacgacgaaatagactacggtaggttaacccttacgaacgactaccgtacggggaccgaacggggaaccctagggttaccaccgtccttccgtaccacgtccctacccaaccgaaccggggcccctaagtcccggtccttccccccgtggcccaacccctccctacccgaacggacccg

SEQ ID NO: 415340 - DNA, 511 bp, Homo sapiens
  misc_feature: GZ8MTXP02F4F1O.3.55.E11.1.454.CMB.2.raw
  modified_base (203)..(203): a, c, t, g, unknown or other
  modified_base (361)..(361): a, c, t, g, unknown or other
  modified_base (371)..(371): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagcccaccctctcctgcagggccagtcagagtattagcagcaacttagcctggtaccagcagaaacctggccaggctcccaggctcctcatctatgctgcatccaccagggccactgtatcccagccccaggttcagtgcaggtgggtctgggacagngttcatttcncaccatcagcagcctgcagtctagaagtattttgactaatttattactgtcagcagcgtagcaatggcctctcaccgttcgggccggtagggaccaaggggtcgaagactaacgaaaacgaactggtaggctcgacaacc

SEQ ID NO: 415341 - DNA, 567 bp, Homo sapiens
  misc_feature: GZ8MTXP02HDPIU.3.55.E11.1.454.CMB.2.raw
  modified_base (206)..(206): a, c, t, g, unknown or other
  modified_base (294)..(294): a, c, t, g, unknown or other
  modified_base (330)..(330): a, c, t, g, unknown or other
  modified_base (419)..(419): a, c, t, g, unknown or other
  modified_base (504)..(504): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccgagggggaaangccaccctctcctgcagggccagtcagagtattagcagcaacttagcctggtaccagcagaaacctggccaggcctcccaggcctccnatctatgctgcactccaccgagggccacgtggtacncccagcccctaggttccaggtggctaggtgggtccgtggggacaggtacgttcattctcacatcagcagccctgccagtctagtaagtnttttgacttaaattttattactgtactagctaagtataagtacgtggtagtacgttacggacgaaaggggtacctaaagggtaanaaaacgtacgaaaacgtacgttaggtaacggtactacggacctaactactttcggtctttacc

SEQ ID NO: 415342 - DNA, 588 bp, Homo sapiens
  misc_feature: GZ8MTXP02FXXI1.3.55.E11.1.454.CMB.2.raw
  modified_base (204)..(204): a, c, t, g, unknown or other
  modified_base (291)..(291): a, c, t, g, unknown or other
  modified_base (375)..(375): a, c, t, g, unknown or other
  modified_base (379)..(379): a, c, t, g, unknown or other
  modified_base (406)..(406): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccaggggaaanagccaccctctcctgcagggccagtcagagtatagcagcaacttagcctggtaccagcagaaacctggccaggctcccaggcctccncatctatgctgcactccaccagggccacgtggactcccagcccctaggttcagtggcaggtgggtctgggacagtgttcattcncacntcagcagcctgctagtctagaaacgtnttttagacttaaatttacttacttgtacagtctaagttaataagttaacgtggggtacgtaacggtttccggaaccggtaaaggggtaaacccgtaaagggttaaacgaaaacgtaccgtaaaaacggtaccgttaggtaacggtacctacggaccctaaccgtattccgttacgtttaacc

SEQ ID NO: 415343 - DNA, 522 bp, Homo sapiens
  misc_feature: GZ8MTXP02I7DPX.3.55.E11.1.454.CMB.2.raw
  modified_base (203)..(203): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctcccaggcctcctcatctatgctgcatccaccagggccactgtactcccagccccagttcagtggcaggtgggtctgggacaggagttcatttctacaccatcagcagccctgcagtctagagtatttgacttaatttattactgtacagtctaagtataataacgtggtaggacgttcggaccgaagggaccaaagggtagaaactacgaaaacgactagtggacacgtcaccgatctattac

SEQ ID NO: 415344 - DNA, 679 bp, Homo sapiens
  misc_feature: GZ8MTXP02G6BPB.3.55.E11.1.454.CMB.2.raw
  modified_base (252)..(252): a, c, t, g, unknown or other
  modified_base (257)..(257): a, c, t, g, unknown or other
  modified_base (277)..(277): a, c, t, g, unknown or other
  modified_base (283)..(283): a, c, t, g, unknown or other
tcagagacgcactccacgaccggtgctcgatttagcactcgcacgttgggtttgggctgagcgtgggtttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtcctcaggctccaggcaaggggctggagtgggtggcagttangtcanatgataggaaagaaaaaatnttacgnagactccctagaaggtcgattcacatctaccagagacaattccaaacaacaccctgtaattgacaaatgaaacagacctgagaactgaaagacaggactatctaattactgtgcgagagacttcaggtacccggaacgacgaaaagtgaacgttacggtacggttaaacccttcctaaggaaccgtacgtacgggggacccgaacggggtaaacccctgggttacccgaacccggttccttacccttaccgtaaacggcccccgttacccaaaaccccggtaaaaccgggggtcccccaaccgtttacccgggggtttaacccctttacccccccggtcggggtacccccgttaaaccccctttcccccggtaacccctaaacggtaaacccccgg

SEQ ID NO: 415345 - DNA, 643 bp, Homo sapiens
  misc_feature: GZ8MTXP02IUZ2T.3.55.E11.1.454.CMB.2.raw
  modified_base (205)..(205): a, c, t, g, unknown or other
  modified_base (295)..(295): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccacctgtctgtgtctccgagggggaaancgccaccctctcctgcagggccagtcagagtattagcagcaacttagcctggtaccagcagaaacctggccaggcctcccaggcctcctnatctatcgctgcactcccaccgagggcccacgttggtactccccgagtccccgagggttccagggtcggacgtagggttcggggtcgtacgggggaaccaggttacgtttcctaagtttcctactaaccgattacgagacaggacgtgggacgtcccgtagggtacgttagtttgtacttaggttttaattaccgttagtacgacggtactaaggttacgttacggttacttaacgtaaccttaaacccggttcggaacccggtacgggggtaccaaaccgggtacgtaggtaacgtaacgttaacgcgtaacgtgtacgtacgtacggactaccgtagttacgttcg

SEQ ID NO: 415346 - DNA, 761 bp, Homo sapiens
  misc_feature: GZ8MTXP02FJY3F.3.55.E11.1.454.CMB.2.raw
  modified_base (204)..(204): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtatagcagcaacttgcctggtaccagcagaacctggccaggcctcccgaggcctcctcatctatgctgcactcccacccgaggggcccaacgtcggtactcccccgaggccccccgtaggggtttccaagggttcggggacctaggggttcgggggttcctaggggggaaacctaagggtaacgttttccaaattttcccgtaccctaaccctacttacccgaacggtccaacggtcccgttcgaccgtaacggttaccgtaggtaaaaggttattttttacggaacctttaaaagtttttaactttaaccgttacggtttacctaaggtaccttaaaggtttaaattaaaacgtttaaaaccggttaggggttacggggtaaaccgggtttacccggggaaccccggtaaaacgggggtaaaccccgtaaaagggggttaaacgtaaaacgttaccgaaaaaccggtaaccgttagggtaacggtacgttacggaccctaaccgtacgttaccgttacggtttccc

SEQ ID NO: 415347 - DNA, 719 bp, Homo sapiens
  misc_feature: GZ8MTXP02IEQ8W.3.55.E11.1.454.CMB.2.raw
  modified_base (206)..(206): a, c, t, g, unknown or other
  modified_base (277)..(277): a, c, t, g, unknown or other
  modified_base (297)..(297): a, c, t, g, unknown or other
  modified_base (336)..(336): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccacctgtctgtgtctccgaaggggaaacncgccaccctctcctgcgagggccagtcagagtatagcagcaacttgcgtgtacagcaacgaactcgaccgnggcctccgacggtctacctnatctatgctgcactccaccgacggtccacgtcggtaccncccgaggtcccccgtaaggttccgaggtacggacggtggggttcgggtcgggtacgggacgtacggttacgtttaccgtactttcctacccaacgttactacgtaaacgccaacgggtcccttaggaccctagttacgtaagggttaaagttacttttaggtaaccttttaaagttttactttacgttaccgttactaaggaccttaaagtttaaagttaaacgtttacggttaggggtaccgggttaaaccggtaccggttaaaacgggaaaacggggttaaaccgaaaagggttaaaacaaaacgttaaaccgaaaacggtaacgttccggtaaggtaccgtaacggaccctaaccggtactttccggtttaactttcccg

SEQ ID NO: 415348 - DNA, 528 bp, Homo sapiens
  misc_feature: GZ8MTXP02HATC4.3.55.E11.1.454.CMB.2.raw
  modified_base (204)..(204): a, c, t, g, unknown or other
  modified_base (291)..(291): a, c, t, g, unknown or other
  modified_base (304)..(304): a, c, t, g, unknown or other
  modified_base (424)..(424): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtattagcagcaacttagcctggtaccagcaagaaacctggaccaggctcccagctccnatctatgctgcanccaccagggccatgtactccagccccaggttcagtgcagtgggtctgggacaggagttcatttcacaccatcagcagcctgcagtctagaagtatttatataatttaatttaattgttanagatataataaataagtaggtagtacgtacggacgaaacggaaacgaaacgtaaagaaacgtaacgaaaacgaacgtagtaagtcgacgacacactactacgtc

SEQ ID NO: 415349 - DNA, 594 bp, Homo sapiens
  misc_feature: GZ8MTXP02G67YY.3.55.E11.1.454.CMB.2.raw
  modified_base (204)..(204): a, c, t, g, unknown or other
  modified_base (295)..(295): a, c, t, g, unknown or other
  modified_base (315)..(315): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttagcctggtaccagcaagaaacctggccaggcctccccgaggcctcctnatctatgctgcatcccacgnggccacgtgtactccagcccctaggttcagtcggctaggttgggtcgtgggaactagtagttcatttccacgacctataccgagcacgccctgcgtacgttcgtagtaaagttgttttacgactttaaagttttattacgtagttacgtagtataagttaattaagtaacgttggtacggtacgtttcggaacgtaaacggggaccgtaaaaggtaacgaaaacgtacgaaaacggtacttaggtaacggactagacctaccgtactcctacgtttacc

SEQ ID NO: 415350 - DNA, 599 bp, Homo sapiens
  misc_feature: GZ8MTXP02IVB5D.3.55.E11.1.454.CMB.2.raw
  modified_base (205)..(205): a, c, t, g, unknown or other
  modified_base (299)..(299): a, c, t, g, unknown or other
  modified_base (337)..(337): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaaanacgccaccctctcctgcagggccagtcagatatagcagcaacttagcctaggtaccagcaagaaacctggaccaggcctcccgaggtcctcctnatctatgctgcactcccaaccgagggcctacgtgtacncccgagccccgtaggttcaggtcggctaggttggtcgtgggacaggtcttcattcacacctatcagcagccctgcctagtctagtagttattttagactttaaatttacttacgtgtacagtactaagttaaataagtaacggttgggtacggtacgttaccgggaacgtaaaacggggtactaaaagggtaaagtaaacgtaaccgtaaaacgtaacgtgtaacggtactaggacctaaaccgtcgttacttacgtttacc

SEQ ID NO: 415351 - DNA, 646 bp, Homo sapiens
  misc_feature: GZ8MTXP02HKYCA.3.55.E11.1.454.CMB.2.raw
  modified_base (204)..(204): a, c, t, g, unknown or other
  modified_base (449)..(449): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccacctctcctgcagggccagtcagagtattagcagcaacttgcctggaccagcaagaaacctggccaggcctcccgaggcctcctcatctatcgctgcactcccaccgaggccacgtggtactccccgagccccgtaggttcaggtcggctaggttcggggtcgtaggggaactaggtagtttctagttcctaccgaacctatccgaagccaacgtccctgactagttactaggtaaacgttntttttagaacctttaattttacttactaggtacctaagtactaaagttaaacttaaacgttaacggttcggggttacggtaaccggtttaccggggaaaccgaaaacgggggtaacctaaaaggggttaaacaaaacttaaccgaaaacgtacgtaggtaacggactacggacctaacgtactttacgtcgttaccc

SEQ ID NO: 415352 - DNA, 586 bp, Homo sapiens
  misc_feature: GZ8MTXP02GDDJK.3.55.E11.1.454.CMB.2.raw
  modified_base (206)..(206): a, c, t, g, unknown or other
  modified_base (315)..(315): a, c, t, g, unknown or other
  modified_base (424)..(424): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccgagggggaaangcccaccctctcctgcagggccagtcagagtatagcagcaacttgcctggtaccagcagaaacctgggaccaggctcccgaggcctcctcatctatgctgcatcccacncgggccagtcggtactcccgagcccctaggttcaggtggcaggttgggtctggggacaggtagttcagtttccacaccctatccagcacgcctgctagtctagaagttnttttagacttaaattttacttactgttacgagtactagttaaataagtaacgttgggtacggtacgttacggaccgtaaaaggggacctaaagggttaacgaaacgttacgaaaacgtactaggtaacggaccttcgaccacctagttccttcggtttaccc

SEQ ID NO: 415353 - DNA, 622 bp, Homo sapiens
  misc_feature: GZ8MTXP02I1CKQ.3.55.E11.1.454.CMB.2.raw
  modified_base (205)..(205): a, c, t, g, unknown or other
  modified_base (295)..(295): a, c, t, g, unknown or other
  modified_base (396)..(396): a, c, t, g, unknown or other
  modified_base (428)..(428): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccacctgtctgtgtctccgagggggaaangccaccctctcctgcagggccagtcagagtatagcagcaacttgcctggtaccagcaagaaacctggccaggcctcccgaggtcctcctnatctatgctgcactccaccgagggccacgtcggtactccccgagcccctaggttcaggtcggactagggttgggtcgtgggactaggtacgttcatttccncaaccatcagcacgcctgcagtctagaagttntttgactttaaatttacttacgtgtacagtactaagttaattaaacgtaacgttgggtacggtacggttacggaaccggaaacggggtaaacctaaaggggtaaacgtaaaacgtaaccgtaaaaaaccggttagttaacgggtcgggtaaccgtacggtacctaacccgtaactttccgttaacggttttccc

SEQ ID NO: 415354 - DNA, 567 bp, Homo sapiens
  misc_feature: GZ8MTXP02GN8YE.3.55.E11.1.454.CMB.2.raw
  modified_base (203)..(203): a, c, t, g, unknown or other
  modified_base (306)..(306): a, c, t, g, unknown or other
  modified_base (341)..(341): a, c, t, g, unknown or other
  modified_base (528)..(528): a, c, t, g, unknown or other
tcagagacgcactccacgaccggtgctcgatttagcactcgcacgttgggtttgggggaggaactgctcagttaggacccagacggaaccatggaagccccagctcagcttctcttcctcctgctactctggctcccagataccaccggagaaattgtgttgacacagtctccagccaccctgtctttgtctccaggggaaanagccacctctcctgcagggccagtcagagtgttagctaactacttagcctggtaccaacagaactggccaggctcccagctctcatctatgatgcatccaacnggccatggcatcccagccagttcagtgccagtggntaggggacagacttcgactctacaccatcagcacgctagacgtcctagaacgtagtttgacttaagtttatacgtgttaccagactaggcgtagacctaacgtcggccttcgttaccgtaggtttccgggacggggtaagggacctaaaggggtcggaaagtacgtaaacgaaaacggtacgtaggnggtactcggaccacctagtcctacggttccttactaccg

SEQ ID NO: 415355 - DNA, 582 bp, Homo sapiens
  misc_feature: GZ8MTXP02IN5KY.3.55.E11.1.454.CMB.2.raw
  modified_base (204)..(204): a, c, t, g, unknown or other
  modified_base (392)..(392): a, c, t, g, unknown or other
  modified_base (527)..(527): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccaggggaaanagccaccctctcctgcagggccagtcagagtatagcagcaacttagcctggtaccagcagaacctggccaggctcccagcctcctcatctatgctgcatcccacccgaggccacgtggtactcccacgcccctaggttccaggtcggcaggttggggtcgtaggggacaggtagttcattcctcaccntccagcagccctgacctagtctagaagttagttttacgactttaaattttactttacgttgttaccaagtactaagttaattaaattaacgtgggttacgacggtttacggacgaaagggtaccaaagggtaaanaaaacgttcgaaaaccgtagtaggaaggctagaccaacgtacttcttacgtttcc

SEQ ID NO: 415356 - DNA, 683 bp, Homo sapiens
  misc_feature: GZ8MTXP02JQHCA.3.55.E11.1.454.CMB.2.raw
tcagagacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtcctcaggctccaggcaaggggctggagtgggtggcagttatgtcacatgataggaaagaaaaaatattaacgcagactcctgaaggtcgattcacatctccagagacaattccaaacaacaccctgtatttcgacaaatgaaacagacctagagaaactaggaaacgaacacggactaatctaattactgtagacgagagatcaaggtaccggaacgaaacgaaatagaacgtaacggtacggtaaaccttccgaagtaacctacgtacgggggacccgtaaagggggaaaccccttgggtacccgaacccggttcccttaccccgttaccgaaccggtccccttaaccccaaacccggtaaacccgggggacccccctaaaggttacccccggggtttccctttacccccccccgtaggggttacccccaaaccccccgtttccccttaaccccgaaaacgggtaaccccg

SEQ ID NO: 415357 - DNA, 568 bp, Homo sapiens
  misc_feature: GZ8MTXP02F8LX2.3.55.E11.1.454.CMB.2.raw
  modified_base (203)..(203): a, c, t, g, unknown or other
  modified_base (415)..(415): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctccaggcctctcatctatgctgcactccacagggccactggtactcccagcccctaggttcagtggctaggttgggtcgtggggacaggtagtttcaatttcacaccatcagcagcctagcctagtctagaaagttntttagacttaatttacttacgtgtactagactagtaattaagtacgtggtacggtacgtacggaaccgtaaagggaacgtaaaggtaaactaaacgtaacgtaaaacgtacgtaggtaacgtactacgacctaactacgttcgttacgttacc

SEQ ID NO: 415358 - DNA, 538 bp, Homo sapiens
  misc_feature: GZ8MTXP02HSVVS.3.55.E11.1.454.CMB.2.raw
  modified_base (203)..(203): a, c, t, g, unknown or other
  modified_base (290)..(290): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaanagccaccctctcctgcagggccagtcagagtattagcagcaacttagcctggtaccagcagaaacctggccaggctccaggctcctnatctatgctgcatccacaggccactggtactccagccccaggttcagtgcagtgggtctgggacaggtagttcagttctacacctatcagcagcctgctagtctagagtattttagacttaaattttattaatgtacagctaagtaataatacgtggtacggtacgttacggaccgaagggtaccaaaggtaagaaaactacgaaaaccgtattaggcggtactacggcaaccgtactcgttagtccc

SEQ ID NO: 415359 - DNA, 528 bp, Homo sapiens
  misc_feature: GZ8MTXP02I37RK.3.55.E11.1.454.CMB.2.raw
  modified_base (204)..(204): a, c, t, g, unknown or other
  modified_base (293)..(293): a, c, t, g, unknown or other
  modified_base (314)..(314): a, c, t, g, unknown or other
  modified_base (387)..(387): a, c, t, g, unknown or other
  modified_base (416)..(416): a, c, t, g, unknown or other
  modified_base (494)..(494): a, c, t, g, unknown or other
  modified_base (508)..(508): a, c, t, g, unknown or other
  modified_base (511)..(511): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtattagcagcaacttagcctggtaccagcagaaacctggccaggcctcccaggcctcctnatctatgctgcatcccaccgnggcccacgtggtacctcccagccccgtaggttcaggtgctaggttgggtcgtggggacaggtagttcatttcncaccatcagcagcctgcagtctagaattnttttagacttaatttacttatgtcaagctagttaactaagtaacgtggtagtacgttcggacgaagggacaaggtaanaactacgaaacgtntgngctgacacgtatctgtc

SEQ ID NO: 415360 - DNA, 613 bp, Homo sapiens
  misc_feature: GZ8MTXP02FP86H.3.55.E11.1.454.CMB.2.raw
  modified_base (203)..(203): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccacctgtctgtgtctccgaggggaaangccaccctctcctgcagggccagtcagagtatagcagcaacttgcctaggtaccagcagaaacctggccaggcctccccaggtcctcctcatcctatcgctgcactccaccgagggcccactggtactccccgagccccgtaggttcaggtcggctaggtgggtcgtaggggactagtagttcacgtttctacgacctatccgagcacggtccctagcctagttctagaaagttatttacgaacttaaattttacttacgtcttacaagtactaagttaattaattaacggttggtacgggtacgttaccgggaacgtaaaacgggggaactaaaggggttaaacaaaacgttaaccgaaaacgtaacgttggtaacggcctaaggacccacttagtccgtttcttaccg

SEQ ID NO: 415361 - DNA, 672 bp, Homo sapiens
  misc_feature: GZ8MTXP02I4MIL.3.55.E11.1.454.CMB.2.raw
  modified_base (205)..(205): a, c, t, g, unknown or other
  modified_base (296)..(296): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtatccagcccacctgtctgtgtctccgaaggggaaancgcccaccctctcctgcagggccagtcagagtatagcagctaacttgcctggtaccagcagaaacctggaccaggcctccgaggtcctccncatctatcgctgcactcccgaccgaggccacgtggtacctccgagcccctaagggttccaggtcggcgaggttcgggtccgtaggggacctaggtacgttactactttacctacaacctacgtacgacgtccgacgtcccgttagaccgtaagttaccgtaaggtaaacgttttagttttaacgtaacttttaaagtttacgttacgtacgttacgtaagttacgttaaagttaaacgttaaacgttacgggttacggggttaccggtaaccgggttacggaaaccggtaaacgggtaaaccgtaaaggtaaacgtaaacgtaacgtaaaacggtagtacgaacgtacgtacgacctacgtacttccgttacgttc

SEQ ID NO: 415362 - DNA, 567 bp, Homo sapiens
  misc_feature: GZ8MTXP02IP7L4.3.55.E11.1.454.CMB.2.raw
  modified_base (205)..(205): a, c, t, g, unknown or other
  modified_base (401)..(401): a, c, t, g, unknown or other
  modified_base (429)..(429): a, c, t, g, unknown or other
  modified_base (521)..(521): a, c, t, g, unknown or other
  modified_base (542)..(542): a, c, t, g, unknown or other
tcagagacgcactccacgaccggtgctcgatttagcactcgcacgttggggtttgggggaggaactgctcagttaggacccagacggaaccatggaagccccagcgcagcttctcttcctcctgctactctggctcccagatgccactggagaagtggtgatgacgcagtctccagcccacctgtctgtgtctccgaggggaaanacgccaccctctcctgcagggccagtcagagtattagcagactaacttagcctaggtaccagcagaaacctggccaggcctcccgaggcctcctcatctatgctgcactccaccgagggcctacgtggtactcccgagccccgtaggttcaggtggctagggttgggtcgtgggacagtagttcattctacacctntcagcagtcctgcctagtctagaagttnttttagacttaaattttacttacttagttcaagtctaagttaacttaagtaacgtgggtagtacgttacggacgtaaagggaccaaggtaanaaactacgaaaacgcgttagnggactacgactacagttctacgttc

SEQ ID NO: 415363 - DNA, 697 bp, Homo sapiens
  misc_feature: GZ8MTXP02G706L.3.55.E11.1.454.CMB.2.raw
  modified_base (204)..(204): a, c, t, g, unknown or other
  modified_base (300)..(300): a, c, t, g, unknown or other
  modified_base (341)..(341): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtattagcagcaacttagcctaggtaccagcaagaaacctggaccaggcctacccgaggtcctcctnatctatgctcgctactccaccgagggccacgtggtaacccnccgacgtcccgtagtcgaggtcggcgtagggttcgggtcggtagggtactaggtacgttctacgttccacctaactataccgacgtcgacgtccgtagactagttacgtaaggttaattacgtttagtaacctttaaagtttacgttacgtacgttactaacgtaactaaaggttaaacttaaacggttaacgggttgggttaaccgggttaaccggttaaccgggaaaaccgggtaaaacgggtaaaccggtaaaaggggtaaaactaaaacgtaaaccggaaaaaccggttacggttacgggtaaccgtacgtaaccgtaccgtaaccgtttacgttaccgttacgtttacccg

SEQ ID NO: 415364 - DNA, 620 bp, Homo sapiens
  misc_feature: GZ8MTXP02HNKFZ.3.55.E11.1.454.CMB.2.raw
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaagacgcccaccctctcctgcagggccagtcagagtatagcagcaacttagcctaggtaccagacaacgaaacctggaccaggcctccgaggtcctctcactctatgctgccatccccaacgacggcctaacgtcggtactcccgagccccgtaggtcaggtgctagggtgggtcgtaggggacagtgttactattccacacctgtaccaggacacggcccttagacctagttacgtagtaaagtttcttttaggaacttttaaattttaacgtttacgtaggtactaagtacttaaagttaattaaacgttacggtagggtacgggtacgttacgggaactaaaaggggtacgtaaaaggtaaagaaactacgaaaacgtacgtaggtcgtactacgtacaaccgtcttctacgttc

SEQ ID NO: 415365 - DNA, 640 bp, Homo sapiens
  misc_feature: GZ8MTXP02JV4FC.3.55.E11.1.454.CMB.2.raw
  modified_base (204)..(204): a, c, t, g, unknown or other
  modified_base (390)..(390): a, c, t, g, unknown or other
  modified_base (396)..(396): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtattagcagcaacttgcctggtaccagcagaaacctggaccaggcctcccgaggcctcctcatctatgctgcactcccaccgacgggccacgtcggtactcccgagcccctaggttcaggtggctaggtcgggtcgtgggactaggtagttcattcncacctntcagcacgtccctgcgtagtcgtagtaacgttatttttacgactttaaattttacgttacctttagtacctaagtactaaagttaagttaaacgttaacggttggggttacggtaaccggtttccgggaaacccggttaaaaggggaacccgtaaaaggggttaaacgaaaacgttaacgaaaaccggtaacgttcggtaacgggtacttacggacctaaccgtatttaccgttacgtttaccc

SEQ ID NO: 415366 - DNA, 627 bp, Homo sapiens
  misc_feature: GZ8MTXP02HDA5X.3.55.E11.1.454.CMB.2.raw
  modified_base (204)..(204): a, c, t, g, unknown or other
  modified_base (315)..(315): a, c, t, g, unknown or other
  modified_base (443)..(443): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagcccacctctcctgcagggccagtcagagtattagcagcaacttagcctggtaccagcagaaacctggccaggctacccaggcctcctcatctatgctgcactccaccgnggccactggtactccccagccccctaggttcaggtcggcaggtggggtctggggactaggtacgtttcaacgtttcctacaaccgtatcgaacgccgagcccttggcctaagttccgtagtaaagttntttttacggactttaaattttattaaccgtgtacagtactaaggttaactttaagtaacgtggggttacggtacgtttaccggaaccgaaaaggggtaccctaaaagggtaacgtaaaaacgtaccgaaaaacggtacgttaggtaacggacttacggacctaaccacttcgttacgtttcccg

SEQ ID NO: 415367 - DNA, 542 bp, Homo sapiens
  misc_feature: GZ8MTXP02FKD0N.3.55.E11.1.454.CMB.2.raw
  modified_base (204)..(204): a, c, t, g, unknown or other
  modified_base (288)..(288): a, c, t, g, unknown or other
  modified_base (308)..(308): a, c, t, g, unknown or other
  modified_base (353)..(353): a, c, t, g, unknown or other
  modified_base (367)..(367): a, c, t, g, unknown or other
  modified_base (373)..(373): a, c, t, g, unknown or other
  modified_base (400)..(400): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccacctctcctgcagggccagtcagagtatagcagcaacttagcctggtaccagcagaaacctggccagctccaggctcctnatctatgctgcatcccaccngggccactggtactccccagccccaggttcagtgcaggtgggtcnggggacagtagttnatttcncaccatcagcagcctgcagtctgaatntttgacttaaatttatactgtacagactaagttataaattaacgtgggttaggacgttccggaacgtaaacgggaccaaagggtaacaaaacgttaacgaaaacgacgtagtaacggactacgacctactatctagttaccc

SEQ ID NO: 415368 - DNA, 642 bp, Homo sapiens
  misc_feature: GZ8MTXP02JM46E.3.55.E11.1.454.CMB.2.raw
  modified_base (204)..(204): a, c, t, g, unknown or other
  modified_base (446)..(446): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanacgcccaccctctcctgcagggccagtcagagtatagcagacaacttagcctaggtaccagacagaaaccgtggccacggcctcccgaggcctcctcatctatgctgcactacccaccgacggccacgtcggtacctcccgagtccccgtaggttcaggtcggcgtaggtcgggtgtagggactaggtcttcatttccacaaccctagtacagcgactccctagactagtactagaaagttnttttacgaattaaactttattacgtgtacagtaactaagttaataaacggttaacgtgggttaggtaacccggttacggaaaccggtaaaagggtaaacctaaaggggttaaaacaaaacgtaaaccggaaaaaccgttaaggttacggtaacgtaccgttaacgacccgtacctacggttaccttcggtttaacc

SEQ ID NO: 415369 - DNA, 658 bp, Homo sapiens
  misc_feature: GZ8MTXP02HQKYD.3.55.E11.1.454.CMB.2.raw
  modified_base (204)..(204): a, c, t, g, unknown or other
  modified_base (310)..(310): a, c, t, g, unknown or other
  modified_base (539)..(539): a, c, t, g, unknown or other
  modified_base (559)..(559): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccacctgtctgtgtctccgaaggggaaancgccaccctctcctgcacgggccagtcagagtattagcagcaacttagccctggtacccagcaaacggaaaccctgggacccaggccctacccgaggcctcccgtnactctatcgctgacctactaccccaaccgacgggtcccacgttacgggtaacctcccccgaaggtccccccgtaaagggttccgaaggttcgggacgtaggggttcggggtcctagggggaacctaggtacgtttcactttccaccaacctagccagccacgccctaggactagtcgtaagtaaagttacgttttagaactttaaagttttactttacgagttacaagnttaaagtaaataagttacgnggttaggtaccgtacggaccgtaaaagggacctaaaggtaataaaacacgaaaacgtaacgttgaacggactacggactaaccgtcgttacgttacgtc

SEQ ID NO: 415370 - DNA, 629 bp, Homo sapiens
  misc_feature: GZ8MTXP02IYX5Q.3.55.E11.1.454.CMB.2.raw
  modified_base (417)..(417): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaagagccaccctctcctgcagggccagtcagagtattagcagcaacttagcctggtaccagcagaaacctggccaggcctcccgaggcctccctcatctatgctgcactcccaccgagggcccacgtggtacctccccagccccaggttcagtggcagttggggctggggacagtagttcattcacacccatcagcagccctgcagtctagaagtnttttagactttaaattttacgttacttcggtactaaggtactaagttaataaacgttaacgttggggttacggtaccggtttaccgggaccgtaaaacgggggaaaccctaaaaggggtaaacgtaaaacgttaccgaaaaaccggtaccggtttaggtaaccggttaccgacggtaacccaacccgttaactttccgtttaacgtttaccc

SEQ ID NO: 415371 - DNA, 582 bp, Homo sapiens
  misc_feature: GZ8MTXP02GTK5N.3.55.E11.1.454.CMB.2.raw
  modified_base (279)..(279): a, c, t, g, unknown or other
tcagagacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtccgtcaggctccaggcaaggggctggagtgggtggcagttatgtcacatgataggaaagaaaaaaatnttaacgcagactccctagaaggtcgattcaccatctaccagagacaaattccaaacaacaccctgtatttcgacaaatgaaacagacctagagaactgaaagaccacggactatactattactgtgacgagagatcgaaggtcccggaagacgaaatcgacgtacggtacggtaaccttcgaagactacgtggggaccagggaaccctggaccaccgtctcctcagccctaccgacgtaacgggcccctaagtcccggtcccttcccccgtacggccccaccccgtccctaccgaacgacccg

SEQ ID NO: 415372 - DNA, 562 bp, Homo sapiens
  misc_feature: GZ8MTXP02FV6FO.3.55.E11.1.454.CMB.2.raw
  modified_base (276)..(276): a, c, t, g, unknown or other
  modified_base (290)..(290): a, c, t, g, unknown or other
tcagagacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtcctcaggctccaggcaaggggctgggagtgggtgcagttatgtcacatgatggaaagaaaaaatntacgcagactcccngaaggtcgattcaccatctccagagacaattccaaacaacaccctgtattcgacaaatgaaacagcctagacgaactgaaagaccacggtactatcttaattactgtgacgtagagatcgagtaccgagaacgaatgactacggtacgtaaccttcaagtactacgtggggacagggaccctggaccaccgtctccacgacgccctacaaccgacgggaccccagttcccggtcccttcccccgaggacccctacccttccaccgaagcccg

SEQ ID NO: 415373 - DNA, 583 bp, Homo sapiens
  misc_feature: GZ8MTXP02HY5OT.3.55.E11.1.454.CMB.2.raw
  modified_base (205)..(205): a, c, t, g, unknown or other
  modified_base (270)..(270): a, c, t, g, unknown or other
  modified_base (288)..(288): a, c, t, g, unknown or other
  modified_base (431)..(431): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaancgcccaccctctcctgcgagggccagtcagagtatagcagcaacttgctggtaccagcaagaacnggcaggctccagctcctnactctatgctgcactcccaccgagggcccacgtggtacctcccgagtcccccgtagttccaggtcggctagggttcgggtcgtacggggactaggtacgttcattcctacaccatccgagcacgcctagccagtctagaactntttagacttaatttattactgtacgatcgtaagttaataacgtacgttgggtacgaccgtttacgggacaaacggggttaaccgaaaggttaacgaaaactacgaaaacgaccgttaggtcggactacggactaccgtattacctcgtttcc

SEQ ID NO: 415374 - DNA, 596 bp, Homo sapiens
  misc_feature: GZ8MTXP02I3LZG.3.55.E11.1.454.CMB.2.raw
  modified_base (204)..(204): a, c, t, g, unknown or other
  modified_base (404)..(404): a, c, t, g, unknown or other
  modified_base (415)..(415): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagcccaccctctcctgccagggccagtcagagtatagcagcaacttgcctggtaccagcagaaacctggccaggctccccaggcctcctcatctatgctgcatccaccaggcccactggtactccccagccccaggttcaggtgcaggttgggtcgtggggacaggtagttcagtttcctcacctatcagcagcctgccngtctagaagtnttttagacttaattttacttacgtgttactagtacgtagttaataaattaacgtagggtaggtacggtttccggaaccggtaaaacggggtaaccgtaaacgggtaaaagaaaacgttaaccgaaaacggtaacgttaggtaacggtcgtacgacctaccgtacttacgttacgtttaccc

SEQ ID NO: 415375 - DNA, 648 bp, Homo sapiens
  misc_feature: GZ8MTXP02HD92Z.3.55.E11.1.454.CMB.2.raw
  modified_base (204)..(204): a, c, t, g, unknown or other
  modified_base (294)..(294): a, c, t, g, unknown or other
  modified_base (337)..(337): a, c, t, g, unknown or other
  modified_base (411)..(411): a, c, t, g, unknown or other
  modified_base (451)..(451): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccgagggaaancgccaccctctcctgcagggccagtcagagtattagcagcaacttgcctggtaccagacagaaacctggccaggcctcccaggcctcctnactctatgctgactactcccaaccgagggcccacgtcggtacnccccgagcccccgtaggttccaggtcggctagggtgggtcgtggggaacaggtacgttcacgttcctcaacctntaccacgcctacgccctgccgtagttcgtaagtaacgttntttacgactttaaattttacgttacgtgttacgaatacgtaagttaaattaaagtaacggttgggtacgggtaaccgtttccgggaaaccgtaaaacgggggtaaacctaaaagggttaaacgaaaacgttaacccgaaaaacggtacgttacgggtaacggcgttacggacctaactaacgttcttaacgtttccc

SEQ ID NO: 415376 - DNA, 538 bp, Homo sapiens
  misc_feature: GZ8MTXP02FFSWF.3.55.E11.1.454.CMB.2.raw
  modified_base (203)..(203): a, c, t, g, unknown or other
  modified_base (363)..(363): a, c, t, g, unknown or other
  modified_base (384)..(384): a, c, t, g, unknown or other
  modified_base (413)..(413): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccacctctcctgcagggccagtcagatatagcagcaacttagcctggtaccagccaagaaacctggcccaggcctcccgaggcctcctcatctatgctgcactcccaccgagggccacgtggactccccagcccctaggttcaggtgcgaggtgggtcngggacaggtagttcatttccncacatcagcagcctgcagtactgtaagtntttagacttaatttattactgtacagactaagtaataatacgtggtacgtacgtacggacgaacggacgtaaaggtaagaaactacgaaaacgaacgtaggtcgctacgacaccatactcgttac

SEQ ID NO: 415377 - DNA, 714 bp, Homo sapiens
  misc_feature: GZ8MTXP02HDPTH.3.55.E11.1.454.CMB.2.raw
  modified_base (206)..(206): a, c, t, g, unknown or other
  modified_base (358)..(358): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccgaaggggaaangcccaccctctcctgcagggccagtcagagtattagcagacaacgttgccctggtaccagacaacgaaaccgtggacccaggcctccccgaggtcctccctacatcctatcgctcgccactccccaccggacgggcccacgttacggtaccnccccgagccccgtaagggttccaggtcggggactaggggttcggggttcgtacgggggaactacggtagtttcctaacgtttcctaaccacccgtataccgagtccacgtccctggtcctagtcgtaagtaagttattttagaactttaaatttacttacgtgtacgtaagtcgttaaagttaaacgtaaagtaaacggttggggttaacgggtacggttaccggggaaacccggtaaaaggggtaaaccgtaaaagggtaaaacgtaaaacgttaaaccgggaaaaaccggttacgttagggaacgggtaccctaacgtaacccggtacctttaacgtcggtttaccgtttaccg

SEQ ID NO: 415378 - DNA, 633 bp, Homo sapiens
  misc_feature: GZ8MTXP02FYG9L.3.55.E11.1.454.CMB.2.raw
  modified_base (205)..(205): a, c, t, g, unknown or other
  modified_base (398)..(398): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaanacgccaccctctcctgcagggccagtcagagtattagcagacaacttagcctaggtaccagcaagaaacctggaccaggcctaccccgaggcctcctcatctatgctgcactcccaccgagggccacgtgtactcccgagccccgtaggttcaggtggacgaggttgggtcgtgggactagtagttcatttcncaccactacacgacacgcctcgctagtacgtagtaagtacccccccccccccccgtttagtacttaatttaactttaacttagtactagtacgtaagtaaattaaattaaacgttaggttacggtaacggttacgggtaaccggtaaaacggggaaacggtaaacggtaaagtaaaacgtaaacgtaaaacgtaaacgtagtaaggtacgtacgacaccgtacgtactacgttac

SEQ ID NO: 415379 - DNA, 558 bp, Homo sapiens
  misc_feature: GZ8MTXP02F0LQZ.3.55.E11.1.454.CMB.2.raw
  modified_base (204)..(204): a, c, t, g, unknown or other
  modified_base (286)..(286): a, c, t, g, unknown or other
  modified_base (318)..(318): a, c, t, g, unknown or other
  modified_base (428)..(428): a, c, t, g, unknown or other
  modified_base (507)..(507): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagctaacttgcctggtaccagcaagaacctggcagctccgagctccnatctatgctgcatcccacgaggccagtgtacncccgagcccctaggttcagtcggctaggtcgggtctggggacaggtacgttcaatttccgtacaaccgtataccgagccaggtccctagacctaagttcgtagtaaagtntttttacgacttaaattttattacgtgtacagtactagtataatacgtggtagtacgttcgacgaaggactaaggtaanaaacgtacaaaacgtactaggtaacgctacgactacctatctagtttaccc

SEQ ID NO: 415380 - DNA, 591 bp, Homo sapiens
  misc_feature: GZ8MTXP02IZR5G.3.55.E11.1.454.CMB.2.raw
  modified_base (203)..(203): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaancgccaccctctcctgcagggccagtcagagtatagcagacaacttgcctggtaccagcagaactggccagcctccccgaggcctcctcatctatgctgcactcccacccgacgggccctaacgtcggtactccccgacgccccgtaggtttccgaggtcggcgtagggttcggggtcgtggggacagtaccttcactctacaccatcagcacgagtggacgcgtagtaagttgtttgacttagttgttacgtttacgtgttagtaggttcttagttcgtttacctcgttaccgttcggttcacgttcgttacggaccggtaacggggtaactacggggtagaactacgtaaccgaaaacgtacgtcggtacggctagacctaccgtac

SEQ ID NO: 415381 - DNA, 585 bp, Homo sapiens
  misc_feature: GZ8MTXP02FM77D.3.55.E11.1.454.CMB.2.raw
  modified_base (204)..(204): a, c, t, g, unknown or other
  modified_base (383)..(383): a, c, t, g, unknown or other
  modified_base (403)..(403): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangcccaccctctcctgccagggccagtcagagtattagcagacaacttagcctaggtaccagcaacgaaacctggaccaggcctcccgaggcctcctcatctatcgctcgcctactacccacgacgggtcctacgtcggtactcccgagcccccgtaggttcagtgcgtaggtgggtcgngggacagtgttcagtttccnctaccatccgagcacgccctagctagtctagtaattactttagactttaagtttactactgtacagtactaagttacaaagttacgtgggtacgtacgtcggaaacagggaacaaaggttaaacgaaacttacgaaaacgtcgtaggtaacgtactcgaccctacgtagtcttacgtttacc

SEQ ID NO: 415382 - DNA, 605 bp, Homo sapiens
  misc_feature: GZ8MTXP02GP1DF.3.55.E11.1.454.CMB.2.raw
  modified_base (204)..(204): a, c, t, g, unknown or other
  modified_base (301)..(301): a, c, t, g, unknown or other
  modified_base (330)..(330): a, c, t, g, unknown or other
  modified_base (435)..(435): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaangccaccctctcctgcagggccagtcagagtatagcagcaacttagcctggtaccagcaagaaacctggccaggcctacccaggcctcctcatctatnctgcatcccaccgagggccacgtggtacncccgagccccctaggttcagtcggcaggtcgggtcgtgggactagtacgttctatttccgtccaacctatcgagtccaagcccttagcctagtctagaaacgttntttagacttaaattttcttactcggtacagtactaagttaacttaaagtaacgttgggtaggtacgttcgggaaccgaagggtaaccgaaaggtaaacgaaaacttaccgaaaacggtaactacgggtaacgtactacggacctaaccgtacttaccgttacgtttaccc

SEQ ID NO: 415383 - DNA, 759 bp, Homo sapiens
  misc_feature: GZ8MTXP02GJ3FX.3.55.E11.1.454.CMB.2.raw
  modified_base (189)..(189): a, c, t, g, unknown or other
  modified_base (216)..(216): a, c, t, g, unknown or other
  modified_base (286)..(286): a, c, t, g, unknown or other
  modified_base (392)..(392): a, c, t, g, unknown or other
tcagagacgcactccacgaccggtgctcgatttagcactcgcacgttgggtttgggctgagctgggttttcctcgttgctcttttaagaggtgtccagtgtcaggtgcagctggtggagtcgtgggggaggcgtggtccagcctgggaggtccctgagactctcctgtgcagcctctggattcaccttnagtagatatgctatgtattgggtcctnaggcctccgaggcgaaggggctgggagtgggtggctagttatgtcacatagataggaaaagtaaaaaatnttacgacaagacctacccgtaggaacgggtcaacttacacctatcctacgaagaacgaactaaacttaccaaaacaaacctaccctagtttaattcgaacctaaanacgtaaaccacgtaccttagaacgtaaactaggaaaacgaccgtacggactaacttacctaaagttactagtacgagaagaagtacgtacgtaccggtaaccggaaacgaaacggtaaaacgtacgggttaaaccgttaacgggggtttaaccggttaaaccctttaccgaaacgggtaccgttaaacccgggttcgggggaaccgtaaaccggggaaccccgttcgggtaccccgtaacccgtcgttccccttacgacccggtacccctaacccgaaccggtaaccgggacccttaaccggtccccggttaacccctttcccccggaacggtccccctaccccgtaccgtaccgaaccggtacccg

SEQ ID NO: 415384 - DNA, 609 bp, Homo sapiens
  misc_feature: GZ8MTXP02FKNLP.3.55.E11.1.454.CMB.2.raw
  modified_base (204)..(204): a, c, t, g, unknown or other
  modified_base (292)..(292): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcgagggccagtcagagtatagcagcaacttgcctggtaccagcagaacctggccaggcctccgaggcctcctnatctatgctgcactcccacgacggcctacgtggactccccgagcccctaggttcaggtggcgtaggttgggtccgtaggggactaggtacgttctattccaccgtaacctagtaccgacgtcaacgtcccttaggcctaggttacgtaggtaaagttcgttttagaacttaaattttactacgtgtacagtactaagtaacttaaagtacggttgggtacgtacgggttacggaacggtaaacgggacgtaaacggtaaagtaaacgtacgaaaacggtcgtaggtcgacgtacgacctactacgtcgtagttaccc

SEQ ID NO: 415385 - DNA, 623 bp, Homo sapiens
  misc_feature: GZ8MTXP02GY6ZH.3.55.E11.1.454.CMB.2.raw
  modified_base (206)..(206): a, c, t, g, unknown or other
  modified_base (240)..(240): a, c, t, g, unknown or other
  modified_base (298)..(298): a, c, t, g, unknown or other
  modified_base (304)..(304): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaagggggaaanacgcccaccctctcctgcagggccagtcagagtntagcagcaacttgcctggtaccagcaagaaacctggccaggcctcccgaggcctcctnatctangctgcactcccgaaccgacgggcctacgtggtacctccccgacgtccccgtagggttccacgggttcggcgtaacgggttcggggttccgtggggaaacctaggtacgtttcaacgtttctaccacctatcaacgcctacgccctagcctagttcctaagggtaacttacgttttagacctttaaaagttttacttaccgtggttacaggtactaaggttaataaacgtacgtgtagggtacgtcggacgaaacgggtacaaaggtaaacaaatacgaaaacgtacgttgaagtctacgacaacctgttacgtacttac

SEQ ID NO: 415386 - DNA, 508 bp, Homo sapiens
  misc_feature: GZ8MTXP02HJ981.3.55.E11.1.454.CMB.2.raw
  modified_base (204)..(204): a, c, t, g, unknown or other
  modified_base (278)..(278): a, c, t, g, unknown or other
  modified_base (373)..(373): a, c, t, g, unknown or other
  modified_base (376)..(377): a, c, t, g, unknown or other
  modified_base (385)..(385): a, c, t, g, unknown or other
  modified_base (410)..(410): a, c, t, g, unknown or other
  modified_base (412)..(412): a, c, t, g, unknown or other
  modified_base (414)..(414): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccagggggaaangccaccctctcctgcagggccagtcagagtattagcagcaacttagcctggtaccagcagaaacctggccagcnccagctcctcatctatgctgcatccaccaggccgactggtactccacgcccacgttcgagtggcagtgggtgtgggacgagagttcatctcacancanngctgcatntagagtattagtataatttattatntnanacataataataagtagtagtacgtacgacgaacggaacgaaacgaaagaaacaacgaaacgaagtagtaagtacgtacgacacactactacgtc

SEQ ID NO: 415387 - DNA, 607 bp, Homo sapiens
  misc_feature: GZ8MTXP02HJDU1.3.55.E11.1.454.CMB.2.raw
  modified_base (203)..(203): a, c, t, g, unknown or other
  modified_base (359)..(359): a, c, t, g, unknown or other
  modified_base (502)..(502): a, c, t, g, unknown or other
  modified_base (564)..(564): a, c, t, g, unknown or other
  modified_base (604)..(604): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccacctgtctgtgtctccgaggggaaancgccaccctctcctgcagggccagtcagagtattagcagcaacttagcctaggtacccagacaacggaaacctggacccaacggcctccccgaaggtcctacctcattctatcgcctgacctactcccgaacccgagggaccctacgtacggtacnccccgtagcccccgtaaggttccaggtcggactagggtggggtccgtaggggactaggtgttacactttctacaaccctatcccagccacgcccttggacctagttacaaggtattatttagacttaaatttttacttaacgngtaacgagtataaagttaataaacgtacgtggtacgtacgtacgacgaaaggactaaagaanaaactacgaaacgtagtgcgactacgaccactatccgttntac

SEQ ID NO: 415388 - DNA, 551 bp, Homo sapiens
  misc_feature: GZ8MTXP02GQT4O.3.55.E11.1.454.CMB.2.raw
  modified_base (204)..(204): a, c, t, g, unknown or other
  modified_base (213)..(213): a, c, t, g, unknown or other
  modified_base (287)..(287): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccgagggaaangccaccctntcctgcagggccagtcagagtatagcagcaacttagcctggtaccagcagaactggcaggctcccaggctcctnatctatgctgcatcccacaggccatggtactccccagccccaggttcagtggcagtgggtctgggacagacgttcattactcaccatccagcagccctagcagttcagaagtattttagcttaaatttattactgtcgagtctaagtataaagttacgtgggttacggtacgtttccggacgaaacgggtaacctaaagggttaaaacaaacgtaacgaaaacgtacgtggtaacgtctacgtacaccgtagttctacgttacc

SEQ ID NO: 415389 - DNA, 608 bp, Homo sapiens
  misc_feature: GZ8MTXP02GSJRV.3.55.E11.1.454.CMB.2.raw
  modified_base (204)..(204): a, c, t, g, unknown or other
  modified_base (317)..(317): a, c, t, g, unknown or other
  modified_base (334)..(334): a, c, t, g, unknown or other
  modified_base (433)..(433): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaanagccaccctctcctgcagggccagtcagagtattagcagcaacttagcctggtaccagcagaaacctggaccaggcctcccgaggcctcctcatctatgctgcatcccaccgngggcccacgtcggtacnccccgagccccgtaggttcaggtcggcgtagggttgggtcgtgggactaggacgttcagtttccacacagtcagcacgccctgcctgtctagtaaattntttacgatttaaatttcttaactgttacagactaagttaataaagttaacggttgggtacggtaacggttccgggaaacgtaaacgggggaaacctaaaggggttaaacgaaaacttacgaaaacgtaacgtggtaacggtactacggtacaaccctagttccgttacgtttacc

SEQ ID NO: 415390 - DNA, 724 bp, Homo sapiens
  misc_feature: GZ8MTXP02HTHN7.3.55.E11.1.454.CMB.2.raw
  modified_base (218)..(218): a, c, t, g, unknown or other
tcagagacgcactccacgaccggtgctcgatttagcactcgcacgttgggtttgggctgagctgggttttcctcgttgctcttttaagaggtgtccagtgtcaggtgcagctgggtggagtcgtggggggaggcgtggtccagcctgggaggtccctgagactctcctgtgcagcctctggattcaccttcagtagatatgctatgtattgggtcctnaggctccgaggcgaaggggctgggagtggggtggctagttatgtcacatagaagtaaggaaaagaaaaaaatattaacgacaacggtacctacccgtaggaacgggtcgtacttaccaacctatacctaccagaacgaactaaacttaccaaaacaaacctacctagttattacgaactaaaatagaacacgcctagacgaaacgtagaaagaccgaacgtactaattactaattacctaggttcgacggtaagaagtacgtacgaacgggtaccgggaaacgaaacgtaaaacgtacggaaccgtttaaaccggggttacggttaaaccctttaccgaaacggtaccgtaacgggtaccgggggaaccgaaaccggggtaccctacggtacccgtaacccgtctaccccgtaccgacgaccccctaaccgaaccggaaccggcccttaagtccccgttaacccgttccccgacgtcccaacccccgttccaaccgtaacgacccg

SEQ ID NO: 415391 - DNA, 703 bp, Homo sapiens
  misc_feature: GZ8MTXP02HVYTZ.3.55.E11.1.454.CMB.2.raw
  modified_base (202)..(202): a, c, t, g, unknown or other
  modified_base (514)..(514): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccacctgtctgtgtctcgaggggaangccaccctctcctgcgagggccagtcagagtatagcagctaacttgccctaggtaacccagaccaaacggaaacctcgggacccaacgggccctacccgacggccctccctactaactccttatcgcctggcctacgtaccccgaccgacgggtcccacggtacggtacctccccgaagtcccccgtagggtttccgaggtcgggtacgtacggggttcgggtccgtagggggactaagggtacgttttaccgacttacctaccaaccctagacctacggcacgtccctgtaccttattcgtacgtaagttntttaacgtacttaaattttacgttaccgtgttaacgaacgtagtaaagttaaagttaaaacgtacggttggggttaaacggtaccggttaacggaacgaaaacgggtaaaccgtaaaggtaaagaaacgttacgaaaaacggtcttaggtaacggtactaacgaccgtaactacgttactacgtttacc

SEQ ID NO: 415392 - DNA, 720 bp, Homo sapiens
  misc_feature: GZ8MTXP02IQVK3.3.55.E11.1.454.CMB.2.raw
  modified_base (204)..(204): a, c, t, g, unknown or other
  modified_base (298)..(298): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaanagccaccctctcctgcgagggccagtcagagtattagcagctaacttacgcctggtaccagacacgaaacctggccaggcctcccgaggctccnactctatcgctgacactacccgaccgtacgggcctaccgtcggtacctaccccgacgtccccgtacggttacgacggtgggcgtaggggttcgggtcggtaggggaacctaggttaacggtttacctacgtttaccctacccgtaaaccctagtccaaaggtcccaacggtccctagtcccgtaaggtccgttaagacggtttattttacgaaacttttaattttacttagtggttactaacggtacttaaaggttaacttaaacgttaacgggttcgggttacggtaaacgggtttacccggaaccggggtaaaacggttaaaaccggtaaaggttaaaacgaaaaccgtttaaccgaaaacggtacgttcggtaacgtactacccggaacttaacctacgttcccgtttaacgtttcccg

SEQ ID NO: 415393 - DNA, 712 bp, Homo sapiens
  misc_feature: GZ8MTXP02G7BZG.3.55.E11.1.454.CMB.2.raw
  modified_base (214)..(214): a, c, t, g, unknown or other
  modified_base (262)..(262): a, c, t, g, unknown or other
  modified_base (276)..(276): a, c, t, g, unknown or other
  modified_base (284)..(284): a, c, t, g, unknown or other
  modified_base (698)..(698): a, c, t, g, unknown or other
tcagagacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggagtccctgagactctcctgtgcagcctctggattcaccttcagtagatatgctatgtattgggtcctnaggctccgaggcgaaggggctgggaggtggggtggctagttatgtcanatgaataggaaaanaaaaaatntaacgacaacgtacctacccgtaggtaacgggtacactttaccgaacctactcctaccaagaacgaaaccctaacttaacccaaacctaaacctacccgtatttaactttaccgaaactaaaactacgaaacacgtaccgtaagagtaaactacggaaaacgaccgaacggtacttaacttacgttaaactttacgtacggtagaaccgaaggtaaacgtacttaccgggaaacggttaccccggggaataaaccgtaaaggtacggtaaccgttaaccgggttaacgttaaccctccgtaaagggtacctaccggggtacggggaccgtaacgggtacccggttacggcctaccggtcctacgtccacgcccctacgaacccgtacggacctcgtccgtccctccgcggcccncctcgaccacgacg

SEQ ID NO: 415394 - DNA, 626 bp, Homo sapiens
  misc_feature: GZ8MTXP02FY552.3.55.E11.1.454.CMB.2.raw
  modified_base (215)..(215): a, c, t, g, unknown or other
  modified_base (280)..(280): a, c, t, g, unknown or other
  modified_base (323)..(323): a, c, t, g, unknown or other
tcagagacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtcctnaggctccgaggcaaggggctgggagtgggtgcagttatgtcacatgataggaaaagtaaaaaatnttaacgacagacctcccgtagaagggtcatcacatctccaganacaatccaaacacacctagtattcgacaatgaacagcctagagaactgaaagacacgactatactattactgtgacgtagatatcgacggtaccggaagaaaccgaaataggaaccttaacgggtacggttaacccttacgaacgtaacgttaccggtcggggaccgaaacgggtaaccccgtgggtacctaccccggttctaccctacgtaccgacccctaccgaaacccggacgggtacccccagttaccccggtcccttacccccgtggaccccctaccccgtacacccgaacggacccg

SEQ ID NO: 415395 - DNA, 617 bp, Homo sapiens
  misc_feature: GZ8MTXP02JJA38.3.55.E11.1.454.CMB.2.raw
  modified_base (260)..(260): a, c, t, g, unknown or other
tcagagacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtcctcaggctccgaggcgaaggggctggaggtgggtgctagttatgtcanatgataggaaaagaaaaatatacgacaacgactccgtaggaacggtcattccacatcctacagacgaactaactaccaaaccaacctacctattattacgaactaaatagaaacacgacgttagacgaacgtaggaaacgacgacgtactatacttaattacgtgagacgtagagtaactcgaacggtaccggaacgaaacgtaatacggaactaacgggtacgtaacccttcgagtacgtacggcgggaccgacgggtacctggtacctacgtcctacctcgaccgtcccaccgaacgacccggacctacgtcccgttcccgtaccccgtcgacccctacctcccgacgaacgtcg

SEQ ID NO: 415396 - DNA, 626 bp, Homo sapiens
  misc_feature: GZ8MTXP02GOVJ9.3.55.E11.1.454.CMB.2.raw
  modified_base (204)..(204): a, c, t, g, unknown or other
  modified_base (289)..(289): a, c, t, g, unknown or other
  modified_base (385)..(385): a, c, t, g, unknown or other
  modified_base (389)..(389): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaggggaaancgccaccctctcctgcagggccagtcagagtatagcagcaacttgcctggtaccagcagaacctggccaggcctccaggcctccncatctatgctgcactcccaccgagggcccactggtactccccgagcccctaggttccaggtggcaggttcgggtcgtgggacagtagttcagttcncacntcagcagcctgctagtctagaacgtagttttcgaacttaaagttttactttacgtgttacctaagtcgttaaagttaacttaaagttaaccggttgggttagggtaaccggtttacgggaacccggtaaaagggggtaacccgtaaaaggggttaaaacgaaaacgtaaccgtaaaaacggtaaccgtagggtaacggtacgtacgtaccgaacctaacttccgttacgtttacccg

SEQ ID NO: 415397 - DNA, 649 bp, Homo sapiens
  misc_feature: GZ8MTXP02ID37M.3.55.E11.1.454.CMB.2.raw
  modified_base (198)..(198): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctccagatgccatggagaagtggtgatgacgcagtctcagccacctgtctgtgtctccgagggganagacgcccacctctctgcgaggccagtcagtgttgtagacagactaacgttcggcctacggtaccagcacgaccaaccgtcggaccacggtccctaccgaggtcctcctacactactatagtagtcgcctaacgtacccgaaccggaccgggacccctaaccggtacctacccgaccggacccgttacggtacgtaggtcggaccgtagggttcggggtcgtacggggactacgtacgtttccacgtttacccacctaaccgagtaccgaacgccgtaacgcgtacgacgtaacgtcgtagtacggtttacgtttcgtactttagttttactacgttagtactagtaactaagttaactaacgttacgtcgtactacgtcttacgtacggttcggaggtacggaacgtaggtagacgtaacgtaacgaaacgtcgtagtcgactcgaaccg

SEQ ID NO: 415398 - DNA, 571 bp, Homo sapiens
  misc_feature: GZ8MTXP02GFGS3.3.55.E11.1.454.CMB.2.raw
  modified_base (207)..(207): a, c, t, g, unknown or other
  modified_base (261)..(261): a, c, t, g, unknown or other
  modified_base (284)..(284): a, c, t, g, unknown or other
tcagagacgcactccacgaccggtgctcgatttagcactcgcacgttggggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccgagggggaaancgcccaccctctcctgcagggccaggtcagagtatagcagcaacttgctggacngcagaactggcagctccagctcnatctatgctgcactccacgaggcctagtcgtactcccgagcccctaggttcaggtggcaggttgggtcgtgggactaggtagttcagttccacaccatcagcacgcctagctagtactaggaaattattttagacttaaattttattactgtacagtactagttaataactaacgtgggtacggtacggttcggaacgtaagggtaaaccgtaaaggtaaagaaacgtacgaaaacgtacgttaggtaacggtacctaggtacccaccgtacttcgttacgtttacc

SEQ ID NO: 415399 - DNA, 543 bp, Homo sapiens
  misc_feature: GZ8MTXP02JMH5N.3.55.E11.1.454.CMB.2.raw
  modified_base (205)..(205): a, c, t, g, unknown or other
  modified_base (371)..(371): a, c, t, g, unknown or other
  modified_base (385)..(385): a, c, t, g, unknown or other
  modified_base (414)..(414): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaangccaccctctcctgcagggccagtcagagtatgcagcaattgctggtaccagcagaacctggccaggcctcccgaggcctcctcatctatgctgcactccaccagggccctacgtgtactccccgagcccccgtaggttcaggtggcaggtgggtcgtggggaacngtagtcagtttccncaccatcagcagcctagccagtcagagtntttagacttaatttattactgtcagactaagtaataatacgtggtacggtacgttcggaccgtaaaggacctaaagggtacaaactacgaaaacgtactgaacggtctacggactaccacttctcgttc

SEQ ID NO: 415400 - DNA, 650 bp, Homo sapiens
  misc_feature: GZ8MTXP02GAWJ8.3.55.E11.1.454.CMB.2.raw
  modified_base (202)..(202): a, c, t, g, unknown or other
  modified_base (283)..(283): a, c, t, g, unknown or other
  modified_base (297)..(297): a, c, t, g, unknown or other
tcagagacgcactccacgaccggtgctcgatttagcactcgcacgttggggtttgggggaggaactgctcagttaggacccagacggaaccatggaagccccagcgcagcttctcttcctcctgctactctggctcccagatgccatggagaagtggtgatgacgcagtctccagccaccctgtctgtgtctcgaggggaancgccaccctctcctgcgagggccagtcagagtatagcagactaacttgcctaggtaccagacaagaaacctggccaggccncccgaggcctcctnatctatgctgctactcccaccggacggcctacgtcggtactccccgagcccccgtagggttccaggtcggcgtagggtcggggtcgtaggggactaggtacgttcacttcctacacctatccagcacgcctagctagtacgtagtaagttatttacgactttaaagttttacttacgtacttacgaagtacgtaagttaaataacgttaacggtgggttaacggtaccggttaaccggaaacggtaaacggggaaaccgtaaaaggtaaacggtaaaacttaaccgggaaaaaccgtagttacggaacggtacgttaacggaccctaccgttaagttaccgtttcgtttaacc

SEQ ID NO: 415401 - DNA, 677 bp, Homo sapiens
  misc_feature: GZ8MTXP02IESTF.3.55.E11.1.454.CMB.2.raw
  modified_base (205)..(205): a, c, t, g, unknown or other
  modified_base (320)..(320): a, c, t, g, unknown or other
  modified_base (364)..(364): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaanacgcccaccctctcctgcgacgggccagtcagtagtattagcagactaacttacgcccgtaggtaccagacaacgaaacccgtgggcccacggccctacccgacggcctcccctnacttctatcgctgccactcccacccgacgggccctacgtgtacnccccagtcccccgtaggttcgaggtggccgtagggtcgggtcggtgggaccaggggttacgttcctacgtttccacctaaccctactaccgacgccacggtccctagcctacgttcgtaagtaagttattttagtaactttaaattttactttacgtgttacgtagtctaaagttaattaaacggttaacgttgggttacggtaccggtaccgggaaccgaacgggtaacgaaacgggtaaacgtaaaacgtaccgtaaaaacgtacgttacggaaggttactaggacccaactacgtttacctacgtttacc

SEQ ID NO: 415402 - DNA, 626 bp, Homo sapiens
  misc_feature: GZ8MTXP02ITM79.3.55.E11.1.454.CMB.2.raw
  modified_base (204)..(204): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccacctgtctgtgtctccgaaggggaaancgcccaccctctcctgcagggccagtcagagtatagcagcaacttgcctggaccagcagaaacctggccaggcctcccgaggcctcctcatctatcgctgcactcccaccgagggcccacgtcggtacctccccgagccccccgtaaggttccaggtcgggctagggttcggggtctaggggaactaggtacgttcctatttccgtacaacctatccgaacgccacgtccctgctacggtctagtaacgttattttagactttaatttacttacgtgttacagtactaagttaacttaaagttaacgtgggttacggtacggttaccggaaccgtaaacgggaaccgtaaaagggtaacaaaacgtaccgtaaaacgtacgttaggaacggtacctacggaccacgtactaccgtcgttacc

SEQ ID NO: 415403 - DNA, 592 bp, Homo sapiens
  misc_feature: GZ8MTXP02FLDQH.3.55.E11.1.454.CMB.2.raw
  modified_base (253)..(253): a, c, t, g, unknown or other
  modified_base (279)..(279): a, c, t, g, unknown or other
  modified_base (331)..(331): a, c, t, g, unknown or other
  modified_base (376)..(376): a, c, t, g, unknown or other
  modified_base (507)..(507): a, c, t, g, unknown or other
  modified_base (563)..(563): a, c, t, g, unknown or other
tcagagacgcactccacgaccggtgctcgatttagcactcgcacgttgggtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtagatatgctatgtattgggtcctcaggctccaggcaagggggccggagtgggtggcagttangtcacatgataggaaagaaaaaaatnttacgcagactccctagaaggtcgattcaccatctccagagacaattccaanaacaccctgtatttgaccaaaatgaaacagcctagagactgaaanacacggctaatactattaactgtagacgagagaatcagtaccggacgaacgaaaagtgaaccgtacggtaggttaaaccttccagtaacctaacgtcgggggaccacggggaaccctgggtaccacccgtntacccgtcacggccctaccgaccaacgggcccctagtccggtcccttaacccccgnggcccacccctcctacccaaagacgaccc

SEQ ID NO: 415404 - DNA, 580 bp, Homo sapiens
  misc_feature: GZ8MTXP02JA6F2.3.55.E11.1.454.CMB.2.raw
  modified_base (203)..(203): a, c, t, g, unknown or other
  modified_base (231)..(231): a, c, t, g, unknown or other
  modified_base (309)..(309): a, c, t, g, unknown or other
  modified_base (389)..(389): a, c, t, g, unknown or other
  modified_base (407)..(407): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagataccactgcacaaatagtgatgacgcagtctccagccaccctgtctgtttctccaggggaacngtctccctctcctgcagggccagtcagngtgtacaacaacacttagcctggtatcaaacagaaacctggaccaggcctcccgaggcctacctcatctatgattgtntcttcgtcgggtcacgttggtcctcccgaggtcaggttcagtggcagtggatcgtgggactagaacgttcacgctacacntcatcgagctcgcggtcngacgtctcgactagtcttatttctagttcaactgtaccgagttccggaccggtccgtaccgtggtaacctacggttccgggaacctacgggggtaaaccctaaggggtacggtactacgtaccgaaggtaacccgtaagttgtaacgggcttaacggcctaaccgtagtttcc

SEQ ID NO: 415405 - DNA, 586 bp, Homo sapiens
  misc_feature: GZ8MTXP02H1DET.3.55.E11.1.454.CMB.2.raw
  modified_base (319)..(319): a, c, t, g, unknown or other
  modified_base (335)..(335): a, c, t, g, unknown or other
  modified_base (394)..(394): a, c, t, g, unknown or other
  modified_base (425)..(425): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtatccagcccaccctgtctgtgtctccgagggggaaagagccaccctctcctgcagggccagtcagagtattagcagcaacttagcctggtaccagcagaaacctggccaggcctcccgaggcctcctcatctatgctgcactcccaccgngggcccacgtggtacncccagccccaggttcagtcgcgaggtgggctgggacaggtattctatctcaccagtccngcacgtccgtgacgtgtactaggtaaagttnttttagtaccttaaattttacttacgttgttacagtactaagttaataacgttaagttgggtacggtacggttacggaaccgaaacgggtaaccgtaaagggtaaacaaaacgtacgaaaacgtacgtggtaagcgtacgacactacgttcgttcgttacc

SEQ ID NO: 415406 - DNA, 596 bp, Homo sapiens
  misc_feature: GZ8MTXP02HWGEM.3.55.E11.1.454.CMB.2.raw
  modified_base (206)..(206): a, c, t, g, unknown or other
  modified_base (293)..(293): a, c, t, g, unknown or other
  modified_base (314)..(314): a, c, t, g, unknown or other
  modified_base (371)..(371): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccagggggaaagngcccaccctctcctgcagggccagtcagagtattagcagcaacttagcctggtaccagcagaactggccaggctcccgaggctcctnatctatgctgcactccaccgnggccacgtggtactcccgagccccaggttcaggtggctagggtgggtcgtggggacngtagttcatttctcaccatcagcacgctgctagtctagtagtattttgactttaaattttactttactgtacagtactaagttaattaaataacggttggggttacggtaaccggtttccggaaccggaaaacggggtaaccgaaaggggttaaacgaaaacgtaccgaaaacggtacgttggtaacggtcttacggacctaaccgtacttcgttacgtttaccc

SEQ ID NO: 415407 - DNA, 553 bp, Homo sapiens
  misc_feature: GZ8MTXP02IAEDF.3.55.E11.1.454.CMB.2.raw
  modified_base (203)..(203): a, c, t, g, unknown or other
  modified_base (212)..(212): a, c, t, g, unknown or other
  modified_base (290)..(290): a, c, t, g, unknown or other
  modified_base (374)..(374): a, c, t, g, unknown or other
  modified_base (382)..(382): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaangccaccctntcctgcagggccagtcagagtattagcagcaaacttgcctggtaccagcagaaacctggccaggctccaggcctcctnatctatgctagcatccacagggcccaatggtactccagccccaggttccagtggcagtggtcctgggacagtagttcactttcncaacccancacgacacgctcgactagtacgtagtagttatttagtaattaatttaacttacttagtacatacgtaataataataacgtaggtagtacggtacgacggaacggaacgtaaacgtaaagtaaacgtaacgaaacgtaacgtagtaacgacgtacgactactactactactc

SEQ ID NO: 415408 - DNA, 689 bp, Homo sapiens
  misc_feature: GZ8MTXP02FTY47.3.55.E11.1.454.CMB.2.raw
  modified_base (205)..(205): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaancgcccaccctctcctgccagggccagtcagtagtatagcagactaacttgccctaggtaccagcaagaaacctggccaggccctacccgaggtccctcctctactctagtcgcttgacctactcccgaccggacggggcccctaacggtcggtaacctccccgaggtacccccgtaggggtttccagggtccggcgtaggttcgggtccgtggggaactagttacgtctaatttccctacaacctagtccaagtccgaggtccctgcttaacgtcgtaagaaagttcttttaaacgactttaaaattttcgttactgtactaagtacgtaattaagttaaactaacggttggggtaaacggttacccgttaacggggaaccgaaaacgggtaccgtaaaagggtaaacgtaaaacgtaacccgaaaagtaccggttagtaacccggtgttaaacggcctaaccgtagttcccttaggtttaccc

SEQ ID NO: 415409 - DNA, 641 bp, Homo sapiens
  misc_feature: GZ8MTXP02HJ0JZ.3.55.E11.1.454.CMB.2.raw
  modified_base (204)..(204): a, c, t, g, unknown or other
  modified_base (301)..(301): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgagggggaancgcccaccctctcctgcgagggccagtcagtagtatagcagcaacgttgctggtaccagcaacgaaacctggccaggcctacccgaggccctccgtnactctatcgcctgaccactccacgacggccacgtgtactcccgagccccgtaggtcagtcggctagggttcggtcgtagggactaggtacgttctacttcctaccgactactccaaccaccgtgaccgtagggctaaggaaagtcgtttacgggtacggtttaccttttaattaccggtggttaaccatacgtaaatttcgttaggtacgttacctccgttacggtacgggtacgttacggaaccgaacggggtacctaaaggtacggtaaaactacggtaaaaacgtccgttgggtaaccgacggttaccgaaccgtacctacttcgtttacggttccc

SEQ ID NO: 415410 - DNA, 641 bp, Homo sapiens
  misc_feature: GZ8MTXP02HL2D0.3.55.E11.1.454.CMB.2.raw
  modified_base (205)..(205): a, c, t, g, unknown or other
  modified_base (295)..(295): a, c, t, g, unknown or other
  modified_base (337)..(337): a, c, t, g, unknown or other
  modified_base (419)..(419): a, c, t, g, unknown or other
  modified_base (456)..(456): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaangcccaccctctcctgcacgggccagtcagtagtattagcagctaactagccgtgtaccagcagaacctggaccaggcctccgagctcctnattcatcgctgctactcccacgacggcctacgtacggtaccncccgagtcccccgaggttcacggttggctaggggttggccggtggggaactaggtaccgttcaacgtttcctacgaaccctntaccgagtcacgtcctagcctagtcgtagtaagtttntttacggaacttttaaacgtttatttacgtagtacctaaggttataagttacttaaaggttacggtaggttacggtaccgttacgggacgttaaagggaaccgtaaaagggttaacaaaacgttaccgaaaacgtacgttcgggaacgtctacggaaacccttcgaaccgttgtttaccgttacc

SEQ ID NO: 415411 - DNA, 670 bp, Homo sapiens
  misc_feature: GZ8MTXP02FTFJR.3.55.E11.1.454.CMB.2.raw
  modified_base (204)..(204): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccatggagaagtggtgatgacgcagtctccagccaccctgtctgtgtctaccgaggggaaanacgccaccctctcctgcagggccagtcagagtatagcagcaacttgcctggtaccagcaagaaacctggaccaggcctcccgaggcctcctcatctatcactcgcactccacccgacgggccctacgtcggtactaccccgagtcccccggtaggttaccaggtcggtacgtagggttaggggttccgaggggactaggttacgttacctagtttccctaacacccgtatacgaacgccgaacgtcccgtggacctgggtaacttacggaaagtttagttttacgaactttaaatttttacgtacgttaggtacctaagtaacgtaaagttaacgttaagttaaacgttgggtaacggtacggtttaccggaaccgtaaacggggaaacctaaaggggtaaactaaaacgtaacgtaaaaccgagttagtcggaacgtcaaacctcggttactcgttacgtttacc

SEQ ID NO: 415412 - DNA, 625 bp, Homo sapiens
  misc_feature: GZ8MTXP02G4L9V.3.55.E11.1.454.CMB.2.raw
  modified_base (599)..(599): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagcccaccctgtctgtgtctccgaggggaaagacgcccaccctctcctgcgacgggccagtcagagtattagcagcaacttgcctaggaccagcaagaaacctggaccctaggcctacccgaggtcctcctacacttctatcgctacgccactcccacccgacgggccctacggtcggtacctaccccgagcccccgtagggttccaagggttcgggaccgtaggggttggggttccgtaggggaactaggttacgttactactttcgactacccattccagacagtccctaggccagttcgtagtaaagttcttttagacttaaattttacgttatgtacagactaagttataataggtggtacggtacgtacggaaccaaaggggtacaaaggttaaacgaaactaacgaaacgtagttacggngtacacgacactacgtccttgttacc

SEQ ID NO: 415413 - DNA, 677 bp, Homo sapiens
  misc_feature: GZ8MTXP02F8NRB.3.55.E11.1.454.CMB.2.raw
  modified_base (213)..(213): a, c, t, g, unknown or other
  modified_base (249)..(249): a, c, t, g, unknown or other
  modified_base (273)..(273): a, c, t, g, unknown or other
  modified_base (278)..(278): a, c, t, g, unknown or other
  modified_base (311)..(311): a, c, t, g, unknown or other
  modified_base (322)..(322): a, c, t, g, unknown or other
tcagagacgcactccacgaccggtgctcgatttagcactcgcacgttgggtttgggctgagctggttttcctcgttgctcttttaagaggtgtccagtgtcaggtgcagctggtggagtctgggggagcgtggtccagcctgggaggtccctgagactctcctgtgcagcctctggattcaccttcagtagatatgctatgtattgggtcctnaggctcaggcaagggctggagtgggtgctaggttangtcacatgatggaaagaaaaaatntacgnagacctcctgaaggtcgattcacatctcagtanacaatccaaanaacacctagtatttacgacaaatgaaacagaccttagagtaaccagaaacgacacggtactactcttaacgttactagtcggactaaggagtaactcgaacggttccggaacgtaaaccgaaaagttcggaaacgttaacgggtacggggttaaaccccctttacgaacgtaaaccgtttacggaccgggggtaccccgtaaacgggggtaaaccccttcggtacccgtaaacccgggttcctaaaccgttcgaccggtaccccttcccgaaaccggtaaccgggtccccaaacgttcccgggtaaccctttcccccgagggtccccctaacccgtttcccaacgtacaacccgg

SEQ ID NO: 415414 - DNA, 775 bp, Homo sapiens
  misc_feature: GZ8MTXP02GCJT9.3.55.E11.1.454.CMB.2.raw
  modified_base (205)..(205): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccgaaggggaaancgcccaccctctcctgcgagggccagtcagagtatagcagacaacttagcctaggtaccagacaacgaaaccgtggaccaggcctcccgaggcctcctcatctatcgctgcctactcccaaccgacgggcccctaacggttcggtacctaccccgagtcccccgtaggtttccgaggttcggacgtagggttcggggtcgtaggggaactaagggttacgttctaacgtttccacccaaccctagtaccgacgaccgtacgtccccgtagccgtaagttaccgttaaggtaaaacgtttagtttttaacggaaacctttttaaaagtttttaacctttaacggtacgtttaaccgtaaggttaaacccttaaaagtttaaaacgtttaaaaacgttaaacgggtttacgggggttaaaccgggttaacccgggtttaaacccggggaaacccggttaaaacgggggtaaacccgttaaaagggtaaaacgtaaaacgttaaacccgaaaaacggtacgttacggtaacggtacctacggaaacctaccgtaacttccgttacgtttaccc

SEQ ID NO: 415415 - DNA, 833 bp, Homo sapiens
  misc_feature: GZ8MTXP02GDU00.3.55.E11.1.454.CMB.2.raw
  modified_base (206)..(206): a, c, t, g, unknown or other
tcagagacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctaccgaaggggaaancgcccaccctctccgtgcgacgggccagtcagagttatagcagactaacgttgcttacggtaccagacaacgaaaccgtcggacccacggcctaccccgacggtccctcctacacttctatcgctacgcctactacccaacccgacgggaccctacgttacggtaccctaccccgaacggtaccccgttacggttaccgtagggttacggtacggtaacggggttcggggttccggtacggggtaaccgtaagggtttaccgtttctaacgtttacccgttacccaaacctacgttaccgtacgaccgtaacggttccccgtagtaccgtaacggttaccgttacgtaaacggtttatttttaacggtaaccgttttaaatttttaccgtttacgttaccggtttaagtaacgtaaacgttaaaggttaaacctttaaaagttaacggggtttcggggttaaacggttaacccgggtttaaccgggaaaccgggttaaaacgggaaacggttaaaacgggtaaaaacggtaaaacgttaaaaccggtaaaaaaccggttcggttaaacgggtaacggttacccgtacggttacccgaaacttaccgtttacggtttactttaacccg

SEQ ID NO: 415416 - DNA, 535 bp, Homo sapiens
  misc_feature: GZ8MTXP01AY5DU.8.43.D10.1.454.CMB.2.raw
  modified_base (283)..(283): a, c, t, g, unknown or other
  modified_base (363)..(363): a, c, t, g, unknown or other
  modified_base (505)..(505): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatcaaactggtccagcagaactgacaagcaccagccactgatttanagtacaaacaacagacactcctggacccctgcccggttctcacggcctccctccgttcggggccaaagctgccctagacnctgtcaggtgtgcagcctgaggacgaggctgagtattactgcctgctctattagtgggggtgggtccgttggggtgttcgggcggacggaccgaagctggaccgtcgtggtcacgccacggcgtccggccccttcggttccnctctccgtcccacctccttacgccgcgccg

SEQ ID NO: 415417 - DNA, 551 bp, Homo sapiens
  misc_feature: GZ8MTXP01BVXB0.8.43.D10.1.454.CMB.2.raw
  modified_base (219)..(219): a, c, t, g, unknown or other
  modified_base (328)..(328): a, c, t, g, unknown or other
  modified_base (370)..(370): a, c, t, g, unknown or other
  modified_base (380)..(380): a, c, t, g, unknown or other
  modified_base (530)..(530): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcaccagtggttactatccaaactggtccagcagaaacctggacaagcaccaggccactgatttatagtaacaaacaacagacactcctggacccctgcccggttntcaggcctccctccgttcggggccaaagctcgccctagaccnctgtcaggtntgcagcctgaggacgaggctgagtattacgtgcctgctctattagtggggtgggtccgttgggtgttcggcggagggaccgaagcgtgaccgtccgtaggtcacgcccgaacggccgtcgcccccgttcggttccactccgtcgtccccnccctccgttccgccgaacgcg

SEQ ID NO: 415418 - DNA, 586 bp, Homo sapiens
  misc_feature: GZ8MTXP01D78VU.8.43.D10.1.454.CMB.2.raw
  modified_base (286)..(286): a, c, t, g, unknown or other
  modified_base (362)..(362): a, c, t, g, unknown or other
  modified_base (417)..(417): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaactgttccagcagaacctggacaagcacccagccactgatttanagtacaaacaacagacactcctggacccctgcccggttctcagctccctccgtcggggccaaagctcgccctgacnctgtcgaggtgtgcagcctgaggacgaggctagagttactacgtcgccgtgcctnttaagttggttcgggggttcgggtccgtttggggtcggttcgggcgggacgggtaccgaagtcgtacggtacccgtcgacggtcacgcccgaacggttcgtcccgtccccgttcggttccttccgtcctcccgtaacccctccctccgttaccgtaaccgccgaaccgg

SEQ ID NO: 415419 - DNA, 544 bp, Homo sapiens
  misc_feature: GZ8MTXP01AW7CP.8.43.D10.1.454.CMB.2.raw
  modified_base (287)..(287): a, c, t, g, unknown or other
  modified_base (365)..(365): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaatggttcagcagaaacctggacaagcacccaggccactgattanagtacaaacaacagacactcctggacccctgcccggttctcacggctccctccgttcggggccaaagctgtcctgacnctgtcaggtgtgcagcctgaggacgagctgagtatactgctgctctattagtgggggtggtccgttgggtgttcgggcggagggacaaggctgaccgtccgtggtccacgcccgaagccgtacgcccccgttaggttccactcctccgttcccctacccgtccttcgaaccttcggccg

SEQ ID NO: 415420 - DNA, 586 bp, Homo sapiens
  misc_feature: GZ8MTXP01CNR0L.8.43.D10.1.454.CMB.2.raw
  modified_base (368)..(368): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaacctggacaagcacccaggccactgatttatagtacaaacaacagacactcctcggacccctgcccggttctcacggcctccctccttcggggccaaagctgccctgacnctgtcaggtgtgcagcctgaggacgaggctgagtattactgctgctctattagtgggggttggtccgtttgggtcggtttcgggcgggacggggaccaacggtcgtcggaacccggtccgtacgggtcacggccccgaaagggcccgtccggcccccgttcgggttccaccgttccctcggttccccaccccttcccttccgtaaccgccggaaccgg

SEQ ID NO: 415421 - DNA, 627 bp, Homo sapiens
  misc_feature: GZ8MTXP01C567E.8.43.D10.1.454.CMB.2.raw
  modified_base (289)..(289): a, c, t, g, unknown or other
  modified_base (311)..(311): a, c, t, g, unknown or other
  modified_base (368)..(368): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctcgcccagggtccaattctcagactgtggtgactcaggacgccctcactgactgtcgtccccaggagggacagtcactctccacctgtgcttccagcactggagcagtcacagtggttactataccaaactggtccagcagaactggacaagcacccagccactgattanagtaacaaacaacagacactcncgaccctcgcccgtctcaggcctcctccgttcggggaccaaacgctcgccctcgacncgtcgtcagggtgtgcagcctgaggacgaggctgagtattactgcctgctctattagtgggggttcgggtccgtttgggtcggttcggcggggacgggaccgaaacggtcgtcggtaacccgtccggttagggtaacccgaacggaccccgtaaacggcccgttcccggccccccgttcggggttcccttacccgtttcccgttcccgggtttccccccgtccccgttccccgttccggtaacccgaacgggtccccgg

SEQ ID NO: 415422 - DNA, 521 bp, Homo sapiens
  misc_feature: GZ8MTXP01DRJ2X.8.43.D10.1.454.CMB.2.raw
  modified_base (365)..(365): a, c, t, g, unknown or other
  modified_base (472)..(472): a, c, t, g, unknown or other
  modified_base (517)..(517): a, c, t, g, unknown or other
tcagctcgcgtgtccacgaccggtgctcgatttagactagcagtaaggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcaggctccctccttcggggccaaagctgccctgacnctgtcaggtgtgcagcctgaggacgaggctgagtattactgcctgctctattatggggtggtccgttgggtgttcggcggaggaccgaaagctgaccgtctaggtcncgccaagctcgccccttcggttcactctcgtcccgcctcttcgcncgcg

SEQ ID NO: 415423 - DNA, 529 bp, Homo sapiens
  misc_feature: GZ8MTXP01BURWG.8.43.D10.1.454.CMB.2.raw
  modified_base (361)..(361): a, c, t, g, unknown or other
  modified_base (371)..(371): a, c, t, g, unknown or other
  modified_base (525)..(525): a, c, t, g, unknown or other
tcagctcgcgtgtccacgaccggtgctcgatttagactagcagtaaggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactctgacccctgcccgttctcaggctcctccttcggggccaaagctgccctgacnctgtcaggtntgcagcctgaggacgaggctgagtattactgcctgctctattagtgggggtggtccgttgggtggttcgggcggagggaccaaggctggacccgtctaggtcacgcccgaaggctcgccccttcggcacctctcgttcccaccctccttccgcncgcg

SEQ ID NO: 415424 - DNA, 517 bp, Homo sapiens
  misc_feature: GZ8MTXP01A2Z4B.8.43.D10.1.454.CMB.2.raw
  modified_base (219)..(219): a, c, t, g, unknown or other
  modified_base (284)..(284): a, c, t, g, unknown or other
  modified_base (379)..(379): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtctccaggagggacagtcactctcacctgtgcttccagcactggancagtcaccagtgttactatccaaatggttccagcagaacctggacaagcaccagccactgattanagtacaaacacagacactctcggacccctgcccgttctcaggctcctcctgggccaaagctgccctgcactgtcaggtgtgcagcctgaggacgngctgagtattactgctgctctatagtggtggtccttgggtgttcggcggtaggaccagtcctgacccgtcgtaaggtcagcccaaggcctcgccccgttcggttccaactcctcgtccccgcccttcctcgccaacgg

SEQ ID NO: 415425 - DNA, 603 bp, Homo sapiens
  misc_feature: GZ8MTXP01B1FUZ.8.43.D10.1.454.CMB.2.raw
  modified_base (289)..(289): a, c, t, g, unknown or other
  modified_base (373)..(373): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccagcactggagcagtcaccagtggttactatccaaactggttccagcagaaacctggacaagcacccaggccactgatttanagtaacaaacaacagacactcctcggacccctgcccggttctcacggcctccctccgttcggggaccaaagctcgccctagacncgtgtcaggtgtgcagcctgagacggaggctgagttattactgcctgctctattagtgggggtggtccgtttgggtcggttcgggcggtacgggacccgaaggtcgtcggacccgttccgtagggtccgacgacccgaacggccgtcccgtccccccgttcgggttccttacccgttcccgtccggtttcccccgccccttcccgttaccgtaaccggaacccgtcccgg

SEQ ID NO: 415426 - DNA, 571 bp, Homo sapiens
  misc_feature: GZ8MTXP01BZVC0.8.43.D10.1.454.CMB.2.raw
  modified_base (290)..(290): a, c, t, g, unknown or other
  modified_base (372)..(372): a, c, t, g, unknown or other
  modified_base (490)..(490): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtaacaaacaacagacactcctcggacccctcgcccggttctcaggcctccctcgttcggggaccaaagctcgccctgacncgtgtccgaggtgtcgcagccctggaggacggaggctagagtattactgcctgctctattagtgggggtggtccgttgggtcgttcggcgggacgggacaagcgtgaccgtctggtcncggcccgaacggccgtccgcccccttcggttccttaccgttcgttccgttccccgcccctccgttaccgtaaccgcgccgg

SEQ ID NO: 415427 - DNA, 540 bp, Homo sapiens
  misc_feature: GZ8MTXP01A436L.8.43.D10.1.454.CMB.2.raw
  modified_base (290)..(290): a, c, t, g, unknown or other
  modified_base (368)..(368): a, c, t, g, unknown or other
  modified_base (522)..(522): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtacaaacaacagacactcctggacccctgcccggttctcacggctccctccttcggggccaaagctcgccctgacnctgtcaggtgtgcagcctgaggacgaggctgagtatactgcctgctctattagtgggggtgggtccgtttgggtggttcgggcggacgggaccgaagcgtgacccgtcgtaggtcacgcccaaggcgtcgccccttcggttcactctcgtcccncctccttccgcaacgccg

SEQ ID NO: 415428 - DNA, 533 bp, Homo sapiens
  misc_feature: GZ8MTXP01BKWG7.8.43.D10.1.454.CMB.2.raw
  modified_base (368)..(368): a, c, t, g, unknown or other
  modified_base (378)..(378): a, c, t, g, unknown or other
  modified_base (407)..(407): a, c, t, g, unknown or other
  modified_base (421)..(421): a, c, t, g, unknown or other
  modified_base (515)..(515): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcaccaggccactgatttatagtacaaacaacagacactcctggacccctgccccggttctcacggctccctccttcgggggccaaagctgccctgacnctgtcaggtntgcagccctgaggcgaggctgagtatacngcctgctctattanggggtggccgttgggtcgttcggcggagggaccaagcgtgaccgtctaggtcacgcccaaggcctcgcccccttcggttcacgtctcgtccccnccctccttcgccaacgcg

SEQ ID NO: 415429 - DNA, 560 bp, Homo sapiens
  misc_feature: GZ8MTXP01BYW8T.8.43.D10.1.454.CMB.2.raw
  modified_base (281)..(281): a, c, t, g, unknown or other
  modified_base (362)..(362): a, c, t, g, unknown or other
tcagctcgcgtgtccacgaccggtgctcgatttagactagcagtaagggggcaccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatcaaatgtccagcagaacctggacaagcaccagcactgatttanagtacaaacaacagacactcctggacccctgcccggttctcacggcctccctccgttcggggccaaagctcgccctagacnctgtcaggtgtgcagcctgagacgaggctgagtattactgcctgctctagttacgtggggtgggtccgtttggggtcggttcgggcgggagggaccgaagcgtcggacccgtccgtaggtccacggacccgaacgggccttccgcccccgttcgttccgaccttcctcgttccccacccctccttccgaaccgcgccg

SEQ ID NO: 415430 - DNA, 551 bp, Homo sapiens
  misc_feature: GZ8MTXP01C4QZM.8.43.D10.1.454.CMB.2.raw
  modified_base (287)..(287): a, c, t, g, unknown or other
  modified_base (326)..(326): a, c, t, g, unknown or other
  modified_base (534)..(534): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcaccagccactgattanagtacaaacaacagacactctcggacccctgcccggtcncaggcctcccgtccgttcggggaccaaagcctacgcccctagactctgtcgaggtgtcgcagcccgtgaggacgaggctagagtattactgacctgctctattagtgggggtgggtccgttgggtcggttcggcggacggaccgaagcgtcgacccgtccgtggtcacgcccgaacggccgtcgccccttcggccactctccgtcccnccctccttcgccgcgcg

SEQ ID NO: 415431 - DNA, 536 bp, Homo sapiens
  misc_feature: GZ8MTXP01DQGS4.8.43.D10.1.454.CMB.2.raw
  modified_base (517)..(517): a, c, t, g, unknown or other
  modified_base (532)..(532): a, c, t, g, unknown or other
tcagctcgcgtgtccacgaccggtgctcgatttagactagcagtaaggggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcacggctccctccttcggggccaaagcctgcccctgacaactgtcagggtgtgcaggcctgaggacgaggctgagtattactgcctgctctattagtggggtgggtccttggggtgttcggcggagggaccaagctgaccgtcctaggtcagccaaaggctcgccccttcgggttcactctcgttcccnccctccttccgaacncgcg

SEQ ID NO: 415432 - DNA, 528 bp, Homo sapiens
  misc_feature: GZ8MTXP01A9WSZ.8.43.D10.1.454.CMB.2.raw
  modified_base (362)..(362): a, c, t, g, unknown or other
  modified_base (500)..(500): a, c, t, g, unknown or other
  modified_base (524)..(524): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggtactatccaaactggttccagcagaaactggacaagcacccaggccactgattatagtacaaacaacagacactcctggacccctgcccggttctcaggctccctccttggggccaaagctgccctgacnctgtcagggtgtgcagcctgaggacgaggctgagtattactgcctgctctattatggggtgggtccgttgggtgttcgggcggagggaccaaagcgtgaccgtctagggtcacgccaagggctcgccccttcggttcnctctcgttcccgccctcttccgcncgcg

SEQ ID NO: 415433 - DNA, 756 bp, Homo sapiens
  misc_feature: GZ8MTXP01DA6Q5.8.43.D10.1.454.CMB.2.raw
  modified_base (378)..(378): a, c, t, g, unknown or other
tcagctcgcgtgtccacgaccggtgctcgatttagactagcagtaaggggggcaccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcactggagcagtcaccagtggttactatccaaactggttccagcagaaactggacaagcacccaggccactgatttataagtaacaaacaacagacactcctcggacccctcgtcccggtctcgacggcctccgtccgttcggggaccaaagctcgccctagacncgtgtacgaggtgtcgacgagcccgtaggacggaccggaaggtcgtaggtaaggttaacttaccgtcggtccctaggtcttcgttaaagtttacgggtttgggggggttcgggggttccggtttgggggttcgggtttaccgggggaccggggaacgggggtaacccgtaaaacgggtccgttaaccggggtaaccccggttacccggttaacgggttaacccgaaaccgggttaccccggaaacggggttccccgttaccccgggtcccccccgtttaccggggttccccttaacccgtttccccggtttaccccggtttcccccccgggtccccctttaccccgttacccggtaaccccgaaccccgggccccggg

SEQ ID NO: 415434 - DNA, 560 bp, Homo sapiens
  misc_feature: GZ8MTXP01D6DOR.8.43.D10.1.454.CMB.2.raw
  modified_base (290)..(290): a, c, t, g, unknown or other
  modified_base (368)..(368): a, c, t, g, unknown or other
  modified_base (409)..(409): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtaacaaacaacagacactcctggacccctgcccggttctcaggcctccctcttcggggccaaagctcgccctgacnctgtcagggtgtgcagcctgaggacgaggctgagtattacngcctgctctattatgggggtggtccgtttgggtgttcgggcggagggtaccaaacggtctaggacccgtccgtagggtcacgccccgaaggccgtccgcccccgttcggttccacttcctcgttccccacctccttcgaaccgcgaaccgg

SEQ ID NO: 415435 - DNA, 569 bp, Homo sapiens
  misc_feature: GZ8MTXP01DTG98.8.43.D10.1.454.CMB.2.raw
  modified_base (291)..(291): a, c, t, g, unknown or other
  modified_base (370)..(370): a, c, t, g, unknown or other
  modified_base (381)..(381): a, c, t, g, unknown or other
  modified_base (397)..(397): a, c, t, g, unknown or other
tcagctcgcgtgtccacgaccggtgctcgatttagactagcagtaagggggcaccaggggtcccttccaatatcagcaccatggcctggactcctctctttctgttcctcctcacttgctgccccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtaacaaacaacagacactcctgacccctgcccggtctcacggcctcctccgttcggggaccaaagctgccctagacnctgtcagggtntgcagcctgaggacgnggctgagtattactgcctgctctattacgtggggtcgggtccgtttgggtcgttcgggcggtagggaccgaaaggcgtacggaccgtcgtaggtcacgcccgaaacggcgtccgcccccgttcggttccttaccgtctcgttccccgtccctcccgttcgtccgaacgccgg

SEQ ID NO: 415436 - DNA, 585 bp, Homo sapiens
  misc_feature: GZ8MTXP01BDY71.8.43.D10.1.454.CMB.2.raw
  modified_base (290)..(290): a, c, t, g, unknown or other
  modified_base (378)..(378): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtaacaaacaacagacactcctcggacccctgccccggttctcacggcctccctccgttcggggcccaaagcctcgcccctagaccnctgtcagggtgtgcagccctgaggacgaggctgagtattactgcctgctctattacgtggggtggtcgttgggtggttcggcggagggaccaaggctcgacccgtcgtaggtcgtacgcccgaacggccgtaccggcccccttacgggttccacccgttctcccggttcccctacccttcccgttccgaaccgttaaccgaacccgg

SEQ ID NO: 415437 - DNA, 566 bp, Homo sapiens
  misc_feature: GZ8MTXP01B78BL.8.43.D10.1.454.CMB.2.raw
  modified_base (290)..(290): a, c, t, g, unknown or other
  modified_base (371)..(371): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtaacaaacaacagacactcctcggacccctgcccggttctcacggctccctccgttcggggccaaagctgccctgaccnctgtcaggtgtgcagcctgaggacgaggctgagtattactgcctgctctattacgtgggggtgggtccgtttggggtcgttcgggcggagggaccaagcgtcggaccgtccgtggtcacgcccgaacggccgtaccgccccgttcggttccaccgttcctccgttccccgcccctccgttccgtccgaacgccgg

SEQ ID NO: 415438 - DNA, 530 bp, Homo sapiens
  misc_feature: GZ8MTXP01D24IW.8.43.D10.1.454.CMB.2.raw
  modified_base (288)..(288): a, c, t, g, unknown or other
  modified_base (370)..(370): a, c, t, g, unknown or other
  modified_base (473)..(473): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaactggttccagcagaaacctggacaagcacccaggccactgattanagtaacaaacaacagacactcctggacccctgccccggttctcacggcctccctccttcggggccaaagctgcccctagacnctgtcaggtgtgcagcctgaggacgagctgagtatactgcctgctctattagtggggtgggtccgttgggtgtcggtcggaggacaagctgaccgtcgtgtcngcccaaggcgtcgccccttcgttccactcctcgtccccaccctccttcgccgcgccg

SEQ ID NO: 415439 - DNA, 551 bp, Homo sapiens
  misc_feature: GZ8MTXP01ECD5H.8.43.D10.1.454.CMB.2.raw
  modified_base (287)..(287): a, c, t, g, unknown or other
  modified_base (328)..(328): a, c, t, g, unknown or other
  modified_base (369)..(369): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcaccagccactgattanagtaacaaacaacagacactcctggacccctgcccggttcncacggcctcccctccgttcggggccaaagctcgccctgacnctgtcaggtgtgcagcctgaggacgaggctagagtaagttactgcctgctctattatggggtggtccgttgggtgttcggcggtacgggacgaagcgtgacccgtcgtaggtcacgcccgaggccgtcgcccccttcggttccaccttctccgttcccgccctccgttcgccgttaacgccg

SEQ ID NO: 415440 - DNA, 552 bp, Homo sapiens
  misc_feature: GZ8MTXP01AFFIN.8.43.D10.1.454.CMB.2.raw
  modified_base (288)..(288): a, c, t, g, unknown or other
  modified_base (368)..(368): a, c, t, g, unknown or other
  modified_base (377)..(377): a, c, t, g, unknown or other
  modified_base (536)..(536): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacagcaccaggccactgatttanagtacaaacaacagacactcctcggacccctgccccggttctcaggcctccctccgttcgggccaaagcctgccctgacnctgcaggtntgcagcctgaggacgaggctggagtattactgcctgcttactagtttagtgggggtgggtccgttggggtcgttcgggcgggtagggaccgaagccgtcgacccgtccgtaggtcagccccgaaggccgtccgccccttcggttccactctcgtccccncctccttcgccgcgcg

SEQ ID NO: 415441 - DNA, 531 bp, Homo sapiens
  misc_feature: GZ8MTXP01DT8KM.8.43.D10.1.454.CMB.2.raw
  modified_base (288)..(288): a, c, t, g, unknown or other
  modified_base (310)..(310): a, c, t, g, unknown or other
  modified_base (366)..(366): a, c, t, g, unknown or other
  modified_base (472)..(472): a, c, t, g, unknown or other
  modified_base (527)..(527): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgtactatccaaactggttccagcagaaacctggacaagcacccaggccactgatttanagtacaaacaacagacactccnggacccctgcccggttctcacggctccctccttcggggccaaaagctgccctgacnctgtcaggtgtgcagccctgaggacgaggctgagtattactgcctgctctattagtggggtgggtccgttggggtgttcggcggagggaccaagcgtgaccgtccngggtcagcccaagcgtcgccccttcggttcacgtctcgtcccaccctccttcgcncgcg

SEQ ID NO: 415442 - DNA, 567 bp, Homo sapiens
  misc_feature: GZ8MTXP01BPCQL.8.43.D10.1.454.CMB.2.raw
  modified_base (329)..(329): a, c, t, g, unknown or other
  modified_base (368)..(368): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaactggacaagcacccaggccactgatttatagtaacaaacaacagacactcctggacccctgcccgttcncaggcctccctccgttcggggccaaagctgccctagacnctgtcaggtgtgcagcctgaggacgaggctgagtatactgcctgctctattacgtgggggtgggtccgttgggtcggttcgggcgggagggaccgaaggcgtcggaccgtccgtgggtcacgcccgaacggccgtccggcccccgttcgggttccacctccgttcggtccccgtcccctccgttccgaacgaaccgccg

SEQ ID NO: 415443 - DNA, 564 bp, Homo sapiens
  misc_feature: GZ8MTXP01AGNQ4.8.43.D10.1.454.CMB.2.raw
  modified_base (291)..(291): a, c, t, g, unknown or other
  modified_base (375)..(375): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactataccaaactggttccagcagaaacctggacaagcacccaggccactgatttanagtaacaaacaacagacactcctcggacccctgccccggttctcacggctccctccgttcggggaccaaagctcgccctagacncgtgtcgaggtgtgcacgccctagaggacggaggcgtgagtatactgccctgctctattagtggggtgggtcgttgggtggttcggcggaggacgagcgtgaccgtccgtaggtcacgccgaagccgtcgcccccgttcggttccttaccgtctccgttccccaccctccgttaccgaacgaaccgccg

SEQ ID NO: 415444 - DNA, 612 bp, Homo sapiens
  misc_feature: GZ8MTXP01DQQLK.8.43.D10.1.454.CMB.2.raw
  modified_base (289)..(289): a, c, t, g, unknown or other
  modified_base (362)..(362): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggtactatccaaactggttccagcagaaacctggacaagcacccaggccactgatttanagtacaaacaacagacactcctggacccctgcccggttctcaggctcctccttgggccaaagctgccctgacnctgtcaggtgtgcagcctgaggacgagctgagtattactgcctgctctattagtgggggttcgggtccgtttgggtcggtttcggcggggtacggggtaccaaagggccgttcggacccggttccgtagggttccgaacggttccccgaaagggcccgtcggccccccgtttccgggttccttaacccgttccgttaccggtttcccccgtaaccccttccccgttacccgtaacccgaaccggtcccgg

SEQ ID NO: 415445 - DNA, 628 bp, Homo sapiens
  misc_feature: GZ8MTXP01BI6Q3.8.43.D10.1.454.CMB.2.raw
  modified_base (220)..(220): a, c, t, g, unknown or other
  modified_base (284)..(284): a, c, t, g, unknown or other
  modified_base (371)..(371): a, c, t, g, unknown or other
  modified_base (579)..(579): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcaccagtggttactatccaaactggtcagcagaaactggacaagcaccagcactgattanagtacaaacaacagacactcctcggacccctcgcccggttctcacggtcctccccgtccgttcggggaccaaagctcgccctagacnctgtcaggtcgtgcgagcctgaggacggacggctaggtacgtagttacgtcgtccgtgtcttacttagtttaggttcgggggttcggggtcccggtttggggttcgggtttccggggaccggggtacggggaccgtaaacgggtccgtccggtaccggtccgtacggtccgacggacccgacggccgtccggcccccgttcggttccnccgtccgtccggttccccgccctcccgttccgaaccgttaaccggccgg

SEQ ID NO: 415446 - DNA, 578 bp, Homo sapiens
  misc_feature: GZ8MTXP01CR7N3.8.43.D10.1.454.CMB.2.raw
  modified_base (285)..(285): a, c, t, g, unknown or other
  modified_base (326)..(326): a, c, t, g, unknown or other
  modified_base (359)..(359): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaactggtccagcagaacctggacaagcaccagccactgattanagtaacaaacaacagacactcctcggacccctgcccgttcncagcctcctcctcgggccaaagctgccctgacnctgtcagggtgtgcagcctgagacgaggcgtagagtattacgtcgcctagctctattagtgggggtcggtccggttgggtcggttcgggcgggaacgggacgaaacgtcgtacgtaccgtccgtaggtcgacggcccgaacggccgtaccgtccccgttacgggttccaccttccgtcccgttcccctacccctccgttaccgtaaccgccggaaccgg

SEQ ID NO: 415447 - DNA, 602 bp, Homo sapiens
  misc_feature: GZ8MTXP01DO3G6.8.43.D10.1.454.CMB.2.raw
  modified_base (375)..(375): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtaacaaacaacagacactcctggacccctgccccggttctcacggcctccctccgttcggggccaaagcctcgcccctcgacnctgtcaggtgtgcagcctgaggacgaggctgagtattactgcctgctcttattacgtgggggtcggggtccgttggggttggtttcgggcgggtacgggacccgaaaggcgtcggaccgtccgttacgggtcgaacggccccgaaagggccgttccggccccccgttccgggttccaccgttccttcggttcccctacccctcccgttccgtaaccgaacggtccgg

SEQ ID NO: 415448 - DNA, 537 bp, Homo sapiens
  misc_feature: GZ8MTXP01DF3EM.8.43.D10.1.454.CMB.2.raw
  modified_base (288)..(288): a, c, t, g, unknown or other
  modified_base (363)..(363): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccagccactgattanagtaacaaacaacagacactcctggacccctgcccggtctcaggctccctcttcggggccaaagctgccctgacnctgtcaggtgtgcagcctgaggacgaggctgagtattactgcctgctctattagtgggggtgggtccgttgggtgttcgggcggaggggaccaaagctggaccgtcctaaggtcacgccccaaaggcctcgcccccttcggcactctcgttcccaccctccttcaacgaacgcg

SEQ ID NO: 415449 - DNA, 561 bp, Homo sapiens
  misc_feature: GZ8MTXP01AE6KS.8.43.D10.1.454.CMB.2.raw
  modified_base (367)..(367): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaactggtccagcagaaacctggacaagcaccaggccactgatttatagtacaaacaacagacactcctcggacccctgcccggttctcaggcctcccgtccgttcggggccaaagctgccctgacnctgtcaggtgtgcagcctgagacgaggctgagtatactgcctgctctagttagtgggggtggtccgttggggtcggtttcgggcgggagggacccgaaggccgtcggtacccgtccgtacgggtcacggcccgaaaggccgtccgcccccgttcggttcttacgtctcgtcccaccctccgttcgaacgcgccg

SEQ ID NO: 415450 - DNA, 579 bp, Homo sapiens
  misc_feature: GZ8MTXP01C36OR.8.43.D10.1.454.CMB.2.raw
  modified_base (289)..(289): a, c, t, g, unknown or other
  modified_base (368)..(368): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgattanagtaacaaacaacagacactcctggacccctgcccggtctcaggcctcctccgttcgggccaaacgctcgccctagacnctgtcaggtgtgcagcctgagacgaggctgagtattactgtcctgctctattacgtgggggttcggtcgtttgggtggttcgggcggacgggaccgaagctcggaccgtccgtaggtcacggcccgtaacgggccgtccggcccccgttcgggttccttaccgttccttccggttccccacccgttcccttaccgtaaccgaaccgtccgg

SEQ ID NO: 415451 - DNA, 556 bp, Homo sapiens
  misc_feature: GZ8MTXP01ES771.8.43.D10.1.454.CMB.2.raw
  modified_base (321)..(321): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcaccagccactagtattataagtaacaaacaacagacactcctcgaccctnccgtccgtctcacgcctccctccgtcggaccgaacgctcgcctcgacactcgtcgaggtgtgcgacgacgtacggacggacggacggcgtagtagtattacgtcgtcgtcgtctcttagttagttgggtcgggtcggttgggttcggttcgggcgggaacgggacgacgcgttcgtaccgtccgttacggttcgacgccgacggccgtccgtccccgttccgtccgttccgtccg

SEQ ID NO: 415452 - DNA, 614 bp, Homo sapiens
  misc_feature: GZ8MTXP01BRV81.8.43.D10.1.454.CMB.2.raw
  modified_base (287)..(287): a, c, t, g, unknown or other
  modified_base (331)..(331): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccaggtccaattctcagactgtggtgactcaggagccctcactgactgtcgtccccgaggaggacagtcactctcacctgtgcttccagcactggagcagtcaccagtgttactataccaaatggtccagcaagaactggacaagcaccgagccactgtatttanagtaacaaacaacagacactcctcggacccctcgtcccggttcncgacggccctacccgtccgttcgggaccaaagcctcgccctagacctcgtgtcgagggtgtcgcacgccgtagaggacgaggctagagttattactcgcctgcttacttagtttaggtgggggttcgggttccggtttggggtcggtttcggggcgggtacgggaaccgaaggtcgtccggaccgttccgtaggtcgacgcccgtaaacggccgtccgtcccccgttacggttccttaccgttccttccgttcccctacccctccgttaccgaaccgcggccg

SEQ ID NO: 415453 - DNA, 550 bp, Homo sapiens
  misc_feature: GZ8MTXP01D9QQS.8.43.D10.1.454.CMB.2.raw
  modified_base (219)..(219): a, c, t, g, unknown or other
  modified_base (252)..(252): a, c, t, g, unknown or other
  modified_base (262)..(262): a, c, t, g, unknown or other
  modified_base (272)..(272): a, c, t, g, unknown or other
  modified_base (315)..(315): a, c, t, g, unknown or other
  modified_base (474)..(474): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcacagtgtactatcaatgtcagcagaacngacagcaccngcatgattanagtaacaaacaacagacactcctcggacccctcgcccggttcncacggtcctcccgtccgttcggggaccaaagctcgcccctagacctcgtgtacgagggtcgtgcgtacgcccgtaggagacggaggctagagttatactgcctgctctattagtggggtggtcgttggtgtcggcggacggacgagcgtcgaccgtcgnggtcacgccgacgccgtaccgccccgttcggttccttacctcgtccgtccccaccctccttaccgtaaccgcgccg

SEQ ID NO: 415454 - DNA, 528 bp, Homo sapiens
  misc_feature: GZ8MTXP01EX0BX.8.43.D10.1.454.CMB.2.raw
  modified_base (367)..(367): a, c, t, g, unknown or other
  modified_base (524)..(524): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcaggcctccctccttcggggccaaagctgccctgacnctgtcagggtgtgcagccctgaggacgaggctgagtatactgcctgctctatatggggtggtcttgggtcgttcggcggtagggaccgaagctgaccgtctaggtcagcccaaggctcgccccttggttccactctcgttcccacccgtccttcgcncgcg

SEQ ID NO: 415455 - DNA, 618 bp, Homo sapiens
  misc_feature: GZ8MTXP01BTC65.8.43.D10.1.454.CMB.2.raw
  modified_base (367)..(367): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgattatagtacaaacaacagacactcctggacccctgcccggttctcaggctccctccttcggggccaaagctcgccctgacnctgtcaggtgtgcagcctgaggacgaggctgagtattactgccctgcttctatttagtgggggttcggggtccgtttgggggtcggtttcggggcgggtaacgggggaccaaagggtcgtcggaccccgttccgtaacgggtccgtaacggccccggtaaacggccgtaccggtccccccgttccggttccttacccgttccttaccggttcccctacccccgtcccttaccggtaaccgaaccggcccgg

SEQ ID NO: 415456 - DNA, 555 bp, Homo sapiens
  misc_feature: GZ8MTXP01BYACB.8.43.D10.1.454.CMB.2.raw
  modified_base (290)..(290): a, c, t, g, unknown or other
  modified_base (312)..(312): a, c, t, g, unknown or other
  modified_base (329)..(329): a, c, t, g, unknown or other
  modified_base (371)..(371): a, c, t, g, unknown or other
  modified_base (458)..(458): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgccttccagcactggagcagtcaccagtggttactatccaaactggttccagcagaaactggacaagcacccagccactgatttanagtacaaacaacagacactccnggacccctgcccgttcncacggcctccctccgttcggggaccaaagctcgccctagacnctgtcaggtgtgcagcctaggaggacgaggctagagttattacgtgcctgctactattagtggggtgggtccgttgggtggttcggnggacggaccagctcggaccgtcgtggtcacgcccgacggccgtccgccccgttcggttccaccgtctccgtccccgtccctccttccgccgaacgcg

SEQ ID NO: 415457 - DNA, 623 bp, Homo sapiens
  misc_feature: GZ8MTXP01D3L90.8.43.D10.1.454.CMB.2.raw
  modified_base (288)..(288): a, c, t, g, unknown or other
  modified_base (359)..(359): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttaccagcagaaacctggacaagcaccagccactgattanagtaacaaacaacagacactcctcgacccctgcccgtctcacggctccctccgttcggggaccaaagctcnccctacgacaacgtgtacgaggtgtacgcgacggccctggaacggacggaagggcgtagtaggttacttacgtcgtccgtgtcctacgttattagtggggggttcgggtcccggtttggggtcggtttcgggacgggaggggtaccgaaacggtctacggaaccgttccgtaggtcgacgcccgaacggttccgtccgtcccccttcggttccaccgttccgtccgttccccgccccgttccgttccgtaaccgccggaaccgg

SEQ ID NO: 415458 - DNA, 595 bp, Homo sapiens
  misc_feature: GZ8MTXP01AZVD8.8.43.D10.1.454.CMB.2.raw
  modified_base (331)..(331): a, c, t, g, unknown or other
  modified_base (374)..(374): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcaccgagccactgattatagtaacaaacaacagacactcctcggacccctgcccggttcncgacggcctccctccgttcggggaccaaagctcgccctagacnctgtcagggtgcgcagcctgaggacggaggcgtgagtacttacgtgtcctgtctcttagttagtgggggtcgggtccgtttggggtcggttcgggcgggacgggaccaaggccgtcggacccgtccgtacggtccgacggttccccgaacggttccgtccggtcccccgttcggttccttaccgtccttaccgtccccaccctcccgttcgaaccgcgccg

SEQ ID NO: 415459 - DNA, 616 bp, Homo sapiens
  misc_feature: GZ8MTXP01DSQ0Y.8.43.D10.1.454.CMB.2.raw
  modified_base (430)..(430): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttaactataccaaactggttccagcagaaactggacaagcaccagccatgatttatagtaacaaacaacagacactcctcggacccctgccccgttctcacggcctcccctcgttcggggaccaaagcctcgccctagacctcgtgtcgagggtgtgacaggccctaggaggacgagggctaggtaacgttattacngacctgtcttacttattagtgggggtcgggtccggtttggggtcgttcgggcggtaacgggaaccgtaaggccgtggtacccgtcgtacggtccacggcccgtaacggccgtacccggtcccccgttcgggttccaccgttccctcccgttcccctacccctccgttaccgtaaccaaccggtccg

SEQ ID NO: 415460 - DNA, 808 bp, Homo sapiens
  misc_feature: GZ8MTXP01BTIEY.8.43.D10.1.454.CMB.2.raw
  modified_base (264)..(264): a, c, t, g, unknown or other
  modified_base (290)..(290): a, c, t, g, unknown or other
  modified_base (335)..(335): a, c, t, g, unknown or other
  modified_base (383)..(383): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactataccaaactggtacagcaagaaaccnggacaagcacccgagccactgattanagtaaacaaacaacacgacactaccgtcggacccctgcccgttcncgacggccctcccgtccgttacggggacctaaagcctcgccctagacnccgtgtccgagggtgtcgacgtacgacccgttaggaacggaccggagggtaccgtaggtacggtttaaactttaccgtcggtacccgtcgggttaccttaacgtttagtttaacgggtgggggggggtttacgggggtttcccggggttttagggggtttccggggtttaccgggggtaccgggggtaaaccggggacccgtaaaacggggttcccgttaaccggggtaccccggtttaccggttaaccggggttaacccgaaccgggttacccccggaaacgggttccccggttacccccgggtccccccggtttacccggggttcccttaaccccggttttccccggttacccccggttttccccccggtcccccggttaccccggttacccggtaaaccccggttaaccccggggtcccggg

SEQ ID NO: 415461 - DNA, 593 bp, Homo sapiens
  misc_feature: GZ8MTXP01AF0FH.8.43.D10.1.454.CMB.2.raw
  modified_base (370)..(370): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgccccggttctcaggcctccctccgttcggggccaaagcctgccctgacnctgtcaggtgtgcagcctgaggacgaggctgagtattactgcctgctctatttagtgggggttcggggtccgtttggggtcggtttcgggcgggtaggggacccgtaaggcgtcggtacccgtccgtaacggggtcacggcccaacgggccgtccggcccccgttcgggttccaccttccgtccgttccccctacccgtcccgttccgtaaccgaaccgccgg

SEQ ID NO: 415462 - DNA, 578 bp, Homo sapiens
  misc_feature: GZ8MTXP01A4BTY.8.43.D10.1.454.CMB.2.raw
  modified_base (289)..(289): a, c, t, g, unknown or other
  modified_base (379)..(379): a, c, t, g, unknown or other
  modified_base (491)..(491): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcaccaggccactgatttanagtaacaaacaacagaccactcctcggacccctgccccggttctcgacggtcctcccctccgttcggggaccaaagctcgccctagaccnctgtcagggtgtgcacgcctgaggacggaggctgagttattactgcctgctctattagtgggggtcggtcgtttgggtggttcggcggagggaccgaagcgtcgaccgtcgnggtcacggcccgaacggcctccggtcccccttcggttccttaccgtccttccgttccccaccccgtccttaccgtaaccgaacgccg

SEQ ID NO: 415463 - DNA, 783 bp, Homo sapiens
  misc_feature: GZ8MTXP01AK9QO.8.43.D10.1.454.CMB.2.raw
  modified_base (279)..(279): a, c, t, g, unknown or other
  modified_base (318)..(318): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaactggtcagcagaactggacagcaccagcatgattanagtacaaacacagacactcctcgacccctgcccggttcncacgctccctcgttcggggaccaagcctcgccctagacctaacgtgtaccgtagggtcgtacgccgtacggtcccgtaggaacggggaacccggaaggggcccgttaagggtaaagggtttaaactttaaaccgttcgggtaccccgtttcgggtacctttaccgtttaagtttttaagtcgggggggggtttacgggggttccccgggttttaggggggtttaccggggttttcccgggggaccgggggttaaccggggaaccccggtaaaacgggtcccgttaccggggtaaaccccggtttccccgtaaggggttaaccccgaaacgggttacccccggtaaacggggttccccgttacccgggttccccccccgttcggggttaccccttacccgtttccccgttccgggtttccccctcccccgttccccgttcccggaacccgttaacccgggcccggg

SEQ ID NO: 415464 - DNA, 580 bp, Homo sapiens
  misc_feature: GZ8MTXP01EI789.8.43.D10.1.454.CMB.2.raw
  modified_base (221)..(221): a, c, t, g, unknown or other
  modified_base (281)..(281): a, c, t, g, unknown or other
  modified_base (324)..(324): a, c, t, g, unknown or other
  modified_base (366)..(366): a, c, t, g, unknown or other
  modified_base (494)..(494): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgccttccagcactggancagtcacagtgttactataccaactggtcagcagaactgacaagcaccagcactgattanagtaacaaacaacagacactacctcggacccctcgcccgttcncgacgtcctcccgtcgtcgggaccaaagctcgccctagaccncgtcgtcgtaggtgtcgcgacgccgtagacggacgaggctagagttactactgcctgtctacttattagtggggtggtcgttggtcggtcggcgggagacgaagtcgtcggtaccgtcgtggtaaccncgacccgagttccgtcccgtccccgttacggttccttaccgttcctcccggttccccacccctcccgaccgtaaccgccggaaccg

SEQ ID NO: 415465 - DNA, 560 bp, Homo sapiens
  misc_feature: GZ8MTXP01AQLR8.8.43.D10.1.454.CMB.2.raw
  modified_base (376)..(376): a, c, t, g, unknown or other
  modified_base (528)..(528): a, c, t, g, unknown or other
  modified_base (556)..(556): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttacatccaaactggttccagcagaaacctggacaagcacccaggccactgatttatagtacaaacaacagacactcctcggaccccctgccccggttctccaggcctcccgtccgttcgggggcccaaagcctgcccctgacnctgtcagggtgtgcagccctgacggacgaggctgagtattactgcctgtctctagttatgggggtgggtccgttgggtcggttacgggcggagggaccgaagctcggacccgtccgtggtccacgcccaagggcctcggcccccttcggccncctctccgtcccgccctaccttcgaacncgcg

SEQ ID NO: 415466 - DNA, 563 bp, Homo sapiens
  misc_feature: GZ8MTXP01C2001.8.43.D10.1.454.CMB.2.raw
  modified_base (287)..(287): a, c, t, g, unknown or other
  modified_base (372)..(372): a, c, t, g, unknown or other
  modified_base (461)..(461): a, c, t, g, unknown or other
  modified_base (493)..(493): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggtccagcagaaacctggacagcaccaggccactgattanagtaacaaacaacagacactcctcggacccctgcccggttctcacggcctccctccgttcggggaccaaagctcgccctagaccnctgtcgaggtgtgcagccgtagaggacgaggctgagtattactgcctgctctagttagtgggggtcgggtccgttggggtggttcgggnggacgggacaaggctcggaccgtcgtaggtcncgcccaaggcctccggccccgttcggttccacgttctccgttccccgccctcccgttacgccgcggccgg

SEQ ID NO: 415467 - DNA, 787 bp, Homo sapiens
  misc_feature: GZ8MTXP01C82JR.8.43.D10.1.454.CMB.2.raw
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcacgtggagcagtcaccagtgttactatccaaactgtccagcagaactggacagcaccagccactgattatagtaacaaacaacagacactcctacggacccctcgtcccggttctcgacggtccctcccgtccgttccggggacccaaagccgtacgcccctagaaccctaacgtcgtacgaacgggttcgtcggccgaacggccccgttaagggacggggtaaaccggagggtaccgttaggtaagggttaactttaaccgtcgggtaccccttggtaccttaccgttaagtttacggttcggggggttcggggttcccgggtttgggggttccgggtttcggggaccggggtaacgggtaaccggtaaacggtccgttacccgggtacccggttcccgtaaacgggttcccgaaccggttacccccggtaaacgggccccgttaccccgggtccccccccgtttccggggttccccttaaccccggttttcccgttaccccgggtttccccccccgttcccccgttccccggttaccccggtaaccccgttaaccccgggtaaccccgggg

SEQ ID NO: 415468 - DNA, 628 bp, Homo sapiens
  misc_feature: GZ8MTXP01A099O.8.43.D10.1.454.CMB.2.raw
  modified_base (218)..(218): a, c, t, g, unknown or other
  modified_base (255)..(255): a, c, t, g, unknown or other
  modified_base (278)..(278): a, c, t, g, unknown or other
  modified_base (293)..(293): a, c, t, g, unknown or other
  modified_base (300)..(300): a, c, t, g, unknown or other
  modified_base (317)..(317): a, c, t, g, unknown or other
  modified_base (601)..(601): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtcccaggagggacagtcactctcacctgtgcttccagcactggancagtcaccagtgttactatccaactgtcagcagaacngacagcaccagccactgatttanagtaacaaacaacanacactcncgaccctgcccggttcncacgcctccctcgtcggggaccaagctcgccctagacctctgtacgaggtgtcgacgagtccgtagacggacggtaggcgtagtaggttacttacgtcgtcctgtccttcgttaagtttcggttggggggttcggggttccggtttgggggttcgggtttccgggggacggggacgggtaaccgtaacggtccgtacggtaaccgttccggtacggccgtaacggcccgaacggttccgtccggtccccgttacggttccttaccgttccttccgttaaccccncccctccttaccgaacgccggaaccgg

SEQ ID NO: 415469 - DNA, 546 bp, Homo sapiens
  misc_feature: GZ8MTXP01AW4GX.8.43.D10.1.454.CMB.2.raw
  modified_base (219)..(219): a, c, t, g, unknown or other
  modified_base (253)..(253): a, c, t, g, unknown or other
  modified_base (275)..(275): a, c, t, g, unknown or other
  modified_base (316)..(316): a, c, t, g, unknown or other
  modified_base (356)..(356): a, c, t, g, unknown or other
  modified_base (385)..(385): a, c, t, g, unknown or other
  modified_base (540)..(540): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcacagtgtactatcaactgtcagcagaacngacagcaccagccactgattanagtaacaaacaacagacactcctcgacccctgcccggttcncacggcctccctcgttcgggaccaaagctcgccctagacncgtgtcaggtgtgcagcctgagacgagcngagttatactgcctgctctagttagtgggggtcggtcgttgggtcggttcggcggaggaccgaagcgtgacccgtcgtggtcacgacccgaaggccgtccgcccccgttcggttccttacctccgtccgtccccacccgtcccttaccgtaaccncgccgg

SEQ ID NO: 415470 - DNA, 576 bp, Homo sapiens
  misc_feature: GZ8MTXP01A04LY.8.43.D10.1.454.CMB.2.raw
  modified_base (369)..(369): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaactggacaagcacccagccactgatttatagtaacaaacaacagacactcctgacccctgcccgttctcgacggcctcccgtccgttcggggaccaaagctcgccctgacnctgtcagggtgtgcagcctgaggacggaggcgtagagtattactgcctgctctattagtgggggtcggtccgttggggtggttcgggcggtagggaccaagcgtcgaccgtccgtaggtccgacgcccgaacggccgtccgtcccccgttcgggttccaccgttccgttccgttccccgtccctcccgttaccgaaccgccggccgg

SEQ ID NO: 415471 - DNA, 558 bp, Homo sapiens
  misc_feature: GZ8MTXP01CHQNU.8.43.D10.1.454.CMB.2.raw
  modified_base (259)..(259): a, c, t, g, unknown or other
  modified_base (282)..(282): a, c, t, g, unknown or other
  modified_base (319)..(319): a, c, t, g, unknown or other
  modified_base (356)..(356): a, c, t, g, unknown or other
  modified_base (367)..(367): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgtactatccaaactggtccagcagaaccngacaagcacccagccatgattanagaacaaacaacagacactctcggacccctgcccgtncagctccctcgtcgggaccaaagctcgccctagaccnctgtcagggtngcagcctgacggacgaggctgagtattacgtgcctgtctacttagttagtggggtgggtccgttggggtcgttcgggcggagggaccaaggtcgtcggacccgtcgtaggtccacggccccaaggcctcggtccccttcggttcaccgttcctccgttcccctaccctccgttaccggaaccaaccggccg

SEQ ID NO: 415472 - DNA, 535 bp, Homo sapiens
  misc_feature: GZ8MTXP01D2Z00.8.43.D10.1.454.CMB.2.raw
  modified_base (290)..(290): a, c, t, g, unknown or other
  modified_base (382)..(382): a, c, t, g, unknown or other
  modified_base (498)..(498): a, c, t, g, unknown or other
  modified_base (531)..(531): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtaacaaacaacagacactcctggacccctgccccggttctcacggctccctccttcggggccaaagctcgccctagacaactgtcaggtntgcagcctgagacgaggctgagtattactgcctgctctattagtggggtgggcctttggggtcgttcgggcggagggaccaagctgaccgtctaggtcagcccgagcgtcgccccncggttcactctcgttcccacctccttcgaaccncgcg

SEQ ID NO: 415473 - DNA, 555 bp, Homo sapiens
  misc_feature: GZ8MTXP01BNEBX.8.43.D10.1.454.CMB.2.raw
  modified_base (289)..(289): a, c, t, g, unknown or other
  modified_base (332)..(332): a, c, t, g, unknown or other
  modified_base (375)..(375): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgattanagtaacaaacaacagacactcctcggacccctgccccggttcncgacggcctccctccgttcggggaccaaagcctgccctagacnctgtcaggtgtgcagcctgaggacgaggctgagtattactgcctgctctagttagtgggggtggtccgttgggtggttcgggcggtacgggacctaaggctcggtaccgtccgtaggtcacgccaacggccgtccgccccttcggcacgtcctccgtcccgccctccgttcgccgcgccg

SEQ ID NO: 415474 - DNA, 714 bp, Homo sapiens
  misc_feature: GZ8MTXP01AS2I9.8.43.D10.1.454.CMB.2.raw
  modified_base (219)..(219): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcaccagtggttactatccaaactggtccagcaagaacctggacagcaccagcactgattaatagtaacaaacaacagacactcctcggacccctgccccggttctcacggtcctcccgtccgtcggggaccaaaggctacgcccctaagaccaacgtgtaccgagggtcgtgcgtacgcccgtggacgggaacggacgggtacgtaggaacggttacttaacctcggtcccttacggccttaccgttaagtttacggttggggggttcggggtcccggtttgggggttcgggtttccggggcggggaaccggggaccgaaacggtccgtacggtaaccccggtaccggttacgggtaaccgtaaccggaccccgaaacgggccgtcccgggcccccccttcggggttccccttaacccgtttcccgttcccgggtttaacccccccccgtaccccgttccccggttacccggtaacccggccggtaaccgg

SEQ ID NO: 415475 - DNA, 619 bp, Homo sapiens
  misc_feature: GZ8MTXP01CQYVQ.8.43.D10.1.454.CMB.2.raw
  modified_base (280)..(280): a, c, t, g, unknown or other
  modified_base (356)..(356): a, c, t, g, unknown or other
  modified_base (366)..(366): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggtcagcagaactgacagcaccagcactgattanagtaacaaacaacagacactcctcggacccctgcccgtctcacgcctcctcgttcgggaccaaagctgccctgacnctgtcaggtntgctagccgtagaggacgaggctgagtattactgcctgtctctagttagttgggggtcgggtccggtttgggtcggttcgggcgggtacgggaccgaaaggtccgtacggtacccggtaccgtagggtccaccggacccgtaaacgggcccgtcccggcccccgttcccgggttccttacccgtttccccgttcccggtttaaccccctacccccgttaccccgttacccggtaacccgaacccgggtcccgg

SEQ ID NO: 415476 - DNA, 561 bp, Homo sapiens
  misc_feature: GZ8MTXP01BQ0LK.8.43.D10.1.454.CMB.2.raw
  modified_base (334)..(334): a, c, t, g, unknown or other
  modified_base (370)..(370): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtaacaaacaacagaccactcctcggacccctgcccggttcncaggcctccctcgtcggggaccaagctgccctgacnctgtcagggtgtgcagcctagaggacggagctagagtattacgtgctgcttctattagtgggggtggtcgttgggtggttcggcggagggaccaagctcggaccgtcgtaggcgtacgcccgaacggcctcggtcccccgttcggttccacgttcgtccgttccccgccctcccgttcgaaccgttcgccg

SEQ ID NO: 415477 - DNA, 618 bp, Homo sapiens
  misc_feature: GZ8MTXP01A1V16.8.43.D10.1.454.CMB.2.raw
  modified_base (362)..(362): a, c, t, g, unknown or other
tcagctcgcgtgtccacgaccggtgctcgatttagactagcagtaagggggcgccaggggtcccttccaatatcagcaccatggcctggactcttctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaactgacagcaccagcactgattatataacaaacaacagacactctcggacccctcgcccgttctcgacgcctcccgtccgtcgggaccaagctcgccctagacnctgtcgaggtgtgcaggcctaggacggacggaggctaggtagttacttacgtcgtccgtgtcttacgttattacggtggggggttcggtccggtttggggtcggttcggggcggggacgggtaccgaaggtccgtacggtacccgtccgtacgggctaacggacccgtaagggcccgtaccggtcccccgttcgggttcccttaccgttcccgtccgttcccctacccgtcccgttaccgtaaccgccggaaccgg

SEQ ID NO: 415478 - DNA, 569 bp, Homo sapiens
  misc_feature: GZ8MTXP01DCSL5.8.43.D10.1.454.CMB.2.raw
  modified_base (366)..(366): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacagtgttactatccaaactgtccagcaagaaactggacaagcacccaggccactgattatagtaacaaacaacagacactcctcgacccctcgcccgtctcgacggcctcctccgttcggccaaacgctcgccctagacnctgtcgaggtgtgcacgcgtgacggacggaggcgtgtagtagttactgcctcgctcttagtttagtgggggtcgggtccggtttggggttcggttcgggtcgggacggtaccgaaagtcgtacgtaccgtcgtacggtcacgccgacggcgtccgccccgttcggttcttacgtctacgtcccacctccttcgaacgcgtccg

SEQ ID NO: 415479 - DNA, 592 bp, Homo sapiens
  misc_feature: GZ8MTXP01DD12K.8.43.D10.1.454.CMB.2.raw
  modified_base (275)..(276): a, c, t, g, unknown or other
  modified_base (281)..(281): a, c, t, g, unknown or other
  modified_base (289)..(289): a, c, t, g, unknown or other
  modified_base (293)..(293): a, c, t, g, unknown or other
  modified_base (300)..(300): a, c, t, g, unknown or other
  modified_base (314)..(314): a, c, t, g, unknown or other
  modified_base (364)..(364): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcactggagcagtcacagtgttactatccaaactggtccagcagaacctgacagcaccagcannattanatacaaanacanacactcncgaccctgcccgtncagctcctcgtcggaccaagctcgccctagactaacgtgtcgaggttcgngcgagtcccgtagaggacggaggctagagttacttactcgcctagtctacttagttaggttgggggtcgggtcggtttggggtcggttcggggacggtacgggaccgaaggtccgtacggtacccgtaccggtacggtccgacgacccgtaacggccgtacccgtcccccgttcggttcccttaccgtcgtcccgttccccgccctcccgttccgaaccgaacgccgg

SEQ ID NO: 415480 - DNA, 546 bp, Homo sapiens
  misc_feature: GZ8MTXP01CCNCE.8.43.D10.1.454.CMB.2.raw
  modified_base (282)..(282): a, c, t, g, unknown or other
  modified_base (304)..(304): a, c, t, g, unknown or other
  modified_base (368)..(368): a, c, t, g, unknown or other
  modified_base (413)..(413): a, c, t, g, unknown or other
  modified_base (533)..(533): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatcaaactggttcagcagaactgacagcacccagccactgattanagtacaaacaacagacactccncgacccctgcccggttctcgacggcctccgtccgttacggggccaaagcctacgccctagaccnctgtccaggtgtgcgagcccgtgaggacggaggctgagtattacngcctgctctagttagtggggtggtccgttgggtggttcggcggacggaccgaagcgtgaccgtcgtgtcacgccgacgccgtccgccccgttcgcaccgtcctccgtccccgcccttccnccgccgaacgcgg

SEQ ID NO: 415481 - DNA, 646 bp, Homo sapiens
  misc_feature: GZ8MTXP01B4V3S.8.43.D10.1.454.CMB.2.raw
  modified_base (370)..(370): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacagcacccaggccactgatttatagtaacaaacaacagacactcctcggacccctgcccgtctcacgcctccctccgtcggggaccaaagctcgccctagaccncgtgtcagggtgtgcagcccgtgacggacggaggtcgtagagttacttacgtcgtccgtcgtctacttagttaggttcgggggttcggggtccgtttggggtcggtttcggggcgggtacgggaccgtaacggtccgtacggtacccgtccgttacggtccgaccggttaccccgaagggttcccgtcccggtcccccgttcgggttcccttacccgttcccgttcccggttaacccccaccccgttcccgttcccgaaccgttccggtaacccgg

SEQ ID NO: 415482 - DNA, 535 bp, Homo sapiens
  misc_feature: GZ8MTXP01DOLV9.8.43.D10.1.454.CMB.2.raw
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggtccagcagaaactgacaagcacccagccactgattatagtacaaacaacagacactctgacccctgcccgtctcaggctccctccttcggggcccaaaagctcgccctgacaactgtccaggtgtgcagccctgaggacgaggctgagtattactgcctgctctattactggggtgggtccgttggggtgttcggcgggtaggaccgaagctcgaccgtcctaggtcacgcccaaggcgtccgccccttcggttcacctctccgtcccaccctccttcgccgcgccg

SEQ ID NO: 415483 - DNA, 655 bp, Homo sapiens
  misc_feature: GZ8MTXP01DAROG.8.43.D10.1.454.CMB.2.raw
  modified_base (366)..(366): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccgtctcacggctccctccttcggggccaaagctcgccctgacnctgtccaggtgtgcagcctgaggacgaggctgagtattactgcctgctctattagtggggttagggtccgtttggggtcgtttcgggcgggtacggggaccgtaaaggtccgtcggtaacccgtcccgttaagggttaacccgaacgggccccgaaacgggttcccgttccgggcccccccgttcccggggttcccttaacccgtttccccgttacccgggttttccccccctaaaccccccgttcccccgtttccccgggtaaccccgttaaccccgggtccccgggg

SEQ ID NO: 415484 - DNA, 574 bp, Homo sapiens
  misc_feature: GZ8MTXP01DLK5G.8.43.D10.1.454.CMB.2.raw
  modified_base (219)..(219): a, c, t, g, unknown or other
  modified_base (287)..(287): a, c, t, g, unknown or other
  modified_base (560)..(560): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcaccagtgtactatccaaactggttccagcagaacctggacaagcacccaggccactgatttanagtaacaaacaacagacactcctcggacccctgcccggttctcacggcctccctccgttcggggccaaagcctacggcccctagacaacgttgtccgaagggttgtacgcgagccctggaggacgaggctgagtattactgctgctctattacgtggggttgggtccgttggggttcgttcgggcggtagggacccgtaaagtcgtcgtaccgtccgtaggtccaggcccaagggctacgccccttcggttcactccgtcgttcccgccctcnccgtaacgcgccgg

SEQ ID NO: 415485 - DNA, 617 bp, Homo sapiens
  misc_feature: GZ8MTXP01EX4MG.8.43.D10.1.454.CMB.2.raw
  modified_base (220)..(220): a, c, t, g, unknown or other
  modified_base (282)..(282): a, c, t, g, unknown or other
  modified_base (325)..(325): a, c, t, g, unknown or other
  modified_base (379)..(379): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcaccagtgttactatccaaatggtccagcagaactgacagcaccagccactgatttanagtaacaaacaacagacactccgtcggacccctgcccggttcncgacggcctcccgtcgttccgggaccaagctcgccctaagactcgtgcgaggtntcgcgacgccgtaggacggacgaggtactaggacgtttacgtacgtggccttacggcttacgttaagttcggttcggggggtcggttcggtttggggtcgggtttacgggaccgggtacgggaactaacggtccgtcggtaacccgtcgttaaggcgaaccgttaccgaggttcccgtccgtccccgttggttaccttcgtccgtccttaaccccctacgtccgacgtccgaacgtcg

SEQ ID NO: 415486 - DNA, 561 bp, Homo sapiens
  misc_feature: GZ8MTXP01CH8R3.8.43.D10.1.454.CMB.2.raw
  modified_base (323)..(323): a, c, t, g, unknown or other
  modified_base (362)..(362): a, c, t, g, unknown or other
  modified_base (375)..(375): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgtactatccaaactggtccagcagaaactggacaagcaccagccactgattatagtaacaaacaacagacactcctcgacccctgcccggttncacggcctccctcgtcggggaccaagctcgccctagacnctgtcgaggttgngcagccctagacggacgaggctagagttatactcgtcctgctactattagtcgggggtggtccgtttggggtcgttcgggcggtacgggaccgaagctcggtacccgttcgtaggtcgacgccgaacggcctccggccccttcggcaccgtcctccgtccccacccgtccttaccgccgaacgccg

SEQ ID NO: 415487 - DNA, 536 bp, Homo sapiens
  misc_feature: GZ8MTXP01C8B1H.8.43.D10.1.454.CMB.2.raw
  modified_base (291)..(291): a, c, t, g, unknown or other
  modified_base (367)..(367): a, c, t, g, unknown or other
  modified_base (450)..(450): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactgggagcagtcaccagtggttactatccaaactggttccagcagaacctggacaagcacccaggccactgatttanagtacaaacaacagacactcctggacccctgcccggttctcacggctccctccttggggccaaagctgccctgacnctgtcaggtgtcgcagcctgaggacgaggctgagtatactgcctgctctattagtggggtgggtccgttgggtgtcggtcggnggaccaagctgaccgtctaggtcacgccaggccgcgtccccgttcggttcacgtctcgtccctaccctccgttacgtccaacgccg

SEQ ID NO: 415488 - DNA, 586 bp, Homo sapiens
  misc_feature: GZ8MTXP01CAGTH.8.43.D10.1.454.CMB.2.raw
  modified_base (277)..(277): a, c, t, g, unknown or other
  modified_base (354)..(354): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgtactatcaaactggtcagcagaactgacagcaccagccatgattanagtaacaaacacagacactctcgaccctgcccgtctcgacgcctccctccgtcgggaccaaagctcgccctagaccnctgtcaggtgtgcagcccgtaggacgacgaggctagtagtacttactgcctgctctagttagtgggggtcggtcgttgggtcggttcgggcggacgggtacaacgcgtcggaccgtccgtagggtccacggccccgtaaggcccgtaccggcccccgttacgggttcccttaccgtttcccgttccgttccccctaccccgttccccttacgtaacccgccggtaacccggg

SEQ ID NO: 415489 - DNA, 577 bp, Homo sapiens
  misc_feature: GZ8MTXP01ET9N7.8.43.D10.1.454.CMB.2.raw
  modified_base (378)..(378): a, c, t, g, unknown or other
  modified_base (389)..(389): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgccccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccatgattatagtacaaacaacagacactcctcggaccccctgccccggttctcacggcctcccctccgttcgggggacccaaagctgcccctagacnctgtcagggtntgcagcctgaggacgaggctgagtatactgcctgctactagttagtgggggtcgggtccgttgggtcggttcgggcgggacgggaccgaagcgtgacccgtccgtggtccagccccgaaggccgtaccgcccccttcggttccaccgttcctcgttcccccacccgtcccttaccgccgccgaaccgg

SEQ ID NO: 415490 - DNA, 624 bp, Homo sapiens
  misc_feature: GZ8MTXP01A2NKN.8.43.D10.1.454.CMB.2.raw
  modified_base (289)..(289): a, c, t, g, unknown or other
  modified_base (312)..(312): a, c, t, g, unknown or other
  modified_base (329)..(329): a, c, t, g, unknown or other
  modified_base (370)..(370): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaactggacaagcacccaggccactgatttanagtaacaaacaacagacactccnggacccctgcccgttcncaggctccctccgttcggggaccaaagctcgcccctagacnctgtcaggtgtgcagcctgaggacgaggctgagtattactgcctgctctagttagtgggggtgggtccgtttggggtcgtttcgggcgggtagggtaacccgaaggtccgtcggtacccggttccgttaacggggtctaacggttccccgaaacgggccgtccgggtccccccgttccggggttccttaacccgtttccgttcccggtttccccgtccccgttccccgttccggtaacccgaaccggtcccggg

SEQ ID NO: 415491 - DNA, 584 bp, Homo sapiens
  misc_feature: GZ8MTXP01DCQM2.8.43.D10.1.454.CMB.2.raw
  modified_base (286)..(286): a, c, t, g, unknown or other
  modified_base (368)..(368): a, c, t, g, unknown or other
  modified_base (411)..(411): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaatggttccagcagaaacctggacaagcaccagccactgatttanagtacaaacaacagacactcctcggacccctgcccggttctcaggcctccctccgttcggggaccaaagctacgccctgacnctgtcgagggtgtgctagccctgaggacgagctgagtattacngtcctgctctattagtgggggtcgggtccgttgggtcggttcgggcggacgggaccaaggcgtacggaccgtccgtaggtccgaacggcccgaaggccgtccgtcccccgttcgggttcccaccgttcctccggttccccgtccccttcccgttccgtaaccgaaccgcccgg

SEQ ID NO: 415492 - DNA, 542 bp, Homo sapiens
  misc_feature: GZ8MTXP01BZE8H.8.43.D10.1.454.CMB.2.raw
  modified_base (290)..(290): a, c, t, g, unknown or other
  modified_base (368)..(368): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtacaaacaacagacactctcggacccctgcccgttctcaggcctccctccttcggggccaaagctcgccctgaccnctgtcgaggtgtcgcagccctgaggacgaggctgagtattactgctgctctattagtggggtggtcgttgggtggttcggcggagggacagctcgaccgtcgtggtcacgcccaacggccgtacgccccgttcgttccacctcgtccgtccccgtccctccttccgccgcgccg

SEQ ID NO: 415493 - DNA, 548 bp, Homo sapiens
  misc_feature: GZ8MTXP01CT16J.8.43.D10.1.454.CMB.2.raw
  modified_base (396)..(396): a, c, t, g, unknown or other
  modified_base (530)..(530): a, c, t, g, unknown or other
tcagctcgcgtgtccacgaccggtgctcgatttagactagcagtaagggggcaccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtaacaaacaacagacactacctggacccctgcccggtctcaggctccctcttcggggccaaagctgccctgacaactgtcaggtgtgcagcctgagacgaggcngagattactgcctgctctatatggggtgggtccgtttgggtgttcgggcggaggggaccaaaggctcggaacccgtcgtacggtcacggcccgaaaggccgtacgcccccgttcggttccacttctcgttcccnccctcttccgaacgcgcg

SEQ ID NO: 415494 - DNA, 562 bp, Homo sapiens
  misc_feature: GZ8MTXP01DLWS4.8.43.D10.1.454.CMB.2.raw
  modified_base (287)..(287): a, c, t, g, unknown or other
  modified_base (370)..(370): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcaccagccactgattanagtaacaaacaacagacactcctcgacccctgcccggttctcacggcctccctccgttcggggaccaaagctcgccctagacncgtgtcaggtgtcgcagcctagaggacgaggctgagtattactgcctgctctattagtgggggtcggtcgttgggtgttcgggcggaggaccgaagctcgaccgtccgtaggtcacggcccgaacggccgtccggcccccttcggttccaccgtccgtccgttccccgtccctccgttccgccgaaccgccg

SEQ ID NO: 415495 - DNA, 545 bp, Homo sapiens
  misc_feature: GZ8MTXP01DR3HZ.8.43.D10.1.454.CMB.2.raw
  modified_base (290)..(290): a, c, t, g, unknown or other
  modified_base (330)..(330): a, c, t, g, unknown or other
  modified_base (510)..(510): a, c, t, g, unknown or other
  modified_base (525)..(525): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactataccaaactggttccagcaagaaacctggacaagcaccagccactgattanagtaacaaacaacagacactcctgacccctgcccggttcncgacgcctccctccgttcggggaccaaagctcgccctagactctgtcgaggtgtgcagcctgaggacgagctgagtattactgctgctctagttagtgggggtggtcgttgggtcggttcggcggaggaccaagcgtcgaccgtcgtaggtcacgcccgaggccgtccgccccttcggcnccgtctccgtccccnccctccttccgaacgccgcg

SEQ ID NO: 415496 - DNA, 602 bp, Homo sapiens
  misc_feature: GZ8MTXP01EX9Z6.8.43.D10.1.454.CMB.2.raw
  modified_base (283)..(283): a, c, t, g, unknown or other
  modified_base (326)..(326): a, c, t, g, unknown or other
  modified_base (372)..(372): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgccccagggtccaattctcagactgtggtgactcaggagccctcactgactgtgtccccaggagggacagtcactctcacctgtgcttccagcactggagcagtcacagtgttactatccaaactggtcagcagaactggacaagcaccagccactgattanagtaacaaacaacagacactcctcggacccctcgcccggttcncgacggcctccccgtccgttcggggaccaaagcctcgccctagacncgtgtcgagggtgtcgcagcccgtagaggacggaggcgtgtagttacttacgtcgcctgctacttagttagtgggggtcggttcggttgggtcggttcgggcgggacggacgagtcgtacggtaccgtcgtcggtcacggttccgacggttccgtcccgtccccgttacggttccttccgtcccgttcccgttccccgtcccgtcccgttccgtaaccgccggtaaccgg

SEQ ID NO: 415497 - DNA, 596 bp, Homo sapiens
  misc_feature: GZ8MTXP01BOJP7.8.43.D10.1.454.CMB.2.raw
  modified_base (326)..(326): a, c, t, g, unknown or other
  modified_base (366)..(366): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatcaaactggtccagcagaacctggacaagcaccaggccactgatttatagtaacaaacaacagacactcctcgacccctgcccggttcncaggcctccctcgttcggggaccaaagctcgccctagacnctgtcgaggtgtcgcgagccgtgaggacgaggctagagttattacgtcgcctgctacgttagttagttggggggtcgggtccggtttggggtcggttcggggcggtacgggacctaaggccgtcggacccgttcggtacggtccgaaccgccgtaacggccgtccgcccccgttcggttccaccgttccgtccgttccccgcccttccgttaccgccgttaaccggccgg

SEQ ID NO: 415498 - DNA, 572 bp, Homo sapiens
  misc_feature: GZ8MTXP01ANWDV.8.43.D10.1.454.CMB.2.raw
  modified_base (364)..(364): a, c, t, g, unknown or other
  modified_base (375)..(375): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcactggagcagtcaccagtgttactatccaaactggtccagcagaacctggacaagcaccagccactgattatagaacaaacaacagacactcctcggacccctgcccggttctcacggcctccctcgttcgggccaaagctcgcctagacncgtgtcaggtntcgcacgccgtgaggacgaggctagagttattactgtcctgcttcttagttagtcgggggtggtccgtttggggtcggttacgggcggacgggaccgaacgtcgtcggtaccgtccgtaggtcacggcccaaggcccgtacgcccccgttcggttccttacctcgtcctccccaccctccttccgaaccgccgtccg

SEQ ID NO: 415499 - DNA, 775 bp, Homo sapiens
  misc_feature: GZ8MTXP01DF5A0.8.43.D10.1.454.CMB.2.raw
  modified_base (293)..(293): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgccttccagcactggagcagtcaccagtgttactatccaaactggttccagcaacgaactggacaagcacccaggccactgtaatttanagtaaacaaacaacagaccaactccgtacggaccccctcggccccggtttctaccacgggtccctccccgttccggtttacgggggacccctaaaacggcccgtcgcccccgtagaaccctaacgttcgtaccgtacgggttcgtcggacgtaacgggtcccgttagggaacggggtaccggtaagggtccgtaggtaaacggtttaacgtttaacgttcgggtaccccttgggtcccttacgtttaaagtttacggtttcgggggggggtttacggggtttcccgggttttgggggtttcggggttaccgggggtccggggaacggggtacccgtaaacggtccgttaccggtacccggttccgtaggtaaccgtacggaccccgtaacggttcccgtccggtcccccgttccgggttccttacccgttcccgttcccgttcccccgtccccgtccgttacccgtaaccgccgtaaccggg

SEQ ID NO: 415500 - DNA, 551 bp, Homo sapiens
  misc_feature: GZ8MTXP01D214F.8.43.D10.1.454.CMB.2.raw
  modified_base (290)..(290): a, c, t, g, unknown or other
  modified_base (332)..(332): a, c, t, g, unknown or other
  modified_base (368)..(368): a, c, t, g, unknown or other
  modified_base (533)..(533): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtacaaacaacagacactcctggaccccctgccccggttcncaggcctcctccgttcgggccaaagctgccctgacnctgtcaggtcgtgcagcctgaggacgaggctgagttactactgcctgctctattagtgggggtcgggtccgtttggggtcgttcgggcgggtacggaccgaagtccgtgacccgtctggtccagcccgaagggcctcgcccccttcggttcactcctcgtccccncctccttcgaaccgcgcg

SEQ ID NO: 415501 - DNA, 610 bp, Homo sapiens
  misc_feature: GZ8MTXP01DQ3EL.8.43.D10.1.454.CMB.2.raw
  modified_base (291)..(291): a, c, t, g, unknown or other
  modified_base (375)..(375): a, c, t, g, unknown or other
  modified_base (388)..(388): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttaactataccaaactcggttccagcaagaaacctggacaagcaccagccactgattanagtaacaaacaacagacactctcggacccctgcccggttctcacggtcctccctccgttcggggaccaaagcctgccctagacncgtgtcagggtgngcagcctggacggacgaggctgagttacttacgtcgacctgtcttactagtttagtggggggttcggggttccgtttggggttcgggtcgggtacggggaggtacccgaagtcgtcggaaccggtccgtagggtcacgacccgagggcctccggcccccttacggttccttaccgttccttccgttccccctacccgtcccgttaccgccgaaccggtccgg

SEQ ID NO: 415502 - DNA, 585 bp, Homo sapiens
  misc_feature: GZ8MTXP01CR8YW.8.43.D10.1.454.CMB.2.raw
  modified_base (290)..(290): a, c, t, g, unknown or other
  modified_base (330)..(330): a, c, t, g, unknown or other
  modified_base (369)..(369): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcaagaaacctggacaagcaccagccactgatttanagtaacaaacaacagacactcctcggacccctgcccgtcncacggctcccgtcgtcggggaccaagctcgccctagacnctgtcaggtgtcgcagcctgaggacggaggctaggagtacttacgtgcctgtctcttagttaggtgggggttcgggtccggtttgggtcggttcgggcggacgggtacgaagcgtacggaccgtcgtaggtcacggcccgaacgggcctaccgtccccgttcggttccaccgttccgtccgttcccctacccgtccgttaccgccgttcgaaccgg

SEQ ID NO: 415503 - DNA, 538 bp, Homo sapiens
  misc_feature: GZ8MTXP01B9NFO.8.43.D10.1.454.CMB.2.raw
  modified_base (372)..(372): a, c, t, g, unknown or other
  modified_base (384)..(384): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaacctggacaagcacccagccactgatttatagtaacaaacaacagacactcctcggacccctgcccggttctcacggcctccctccgttcggggccaaagctcgccctagaccnctgtcagggtgngcagcctgaggacggaggctggatattactgcctgctctattagttgggggtggtccgtttgggtcggttcggcggaggaccagcgtgaccgtcgtaggtcacgcccgagcgtcgccccttcgttccactctcgtcccaccctcttcgcgcgcg

SEQ ID NO: 415504 - DNA, 533 bp, Homo sapiens
  misc_feature: GZ8MTXP01D429K.8.43.D10.1.454.CMB.2.raw
  modified_base (278)..(278): a, c, t, g, unknown or other
  modified_base (288)..(288): a, c, t, g, unknown or other
  modified_base (298)..(298): a, c, t, g, unknown or other
  modified_base (313)..(313): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (521)..(521): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacagtgtactatcaaatggtcagcagaaactgacaagcacccagcactgattanagacaaacanagacactccngacccctgcccgttntcagcctccctccgttcgggcccaaagctacgccctagaccaactgtcaggtgtgcagcctgaggacgaggctagagttatacgtnctnctnttatgtggggtcggtcggttgggtcggtcggcggacggacgacgctcggaccgtcgaggtcgacgaccgacgccgtccgtcccgttcgttccactcgtcccgtccccgtccgtccnccgaaccgcgcg

SEQ ID NO: 415505 - DNA, 619 bp, Homo sapiens
  misc_feature: GZ8MTXP01DRYB1.8.43.D10.1.454.CMB.2.raw
  modified_base (286)..(286): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacagtgttactatccaaactgttcagcagaaacctggacaagcaccaggccactgatttanagtacaaacaacagacactcctcgacccctgcccggttctcacggctccctccgttcggggccaaagctcgccctagaccaacgtgtccagggttcgtagcgacgcccgtaggacggacggaggctagagttattactgcctgcttctattgtggggtcggggttccgtttggggttgttcggggcggtacggggaacgtaaacggcgtacggtacccggtccgtagggtaaccgacggcccgtaaacgggccgtccggtcccccgttcggttcccttccgttccgtcccggtttccccgccccgttcccgttccgtaaccgccggaacccgg

SEQ ID NO: 415506 - DNA, 727 bp, Homo sapiens
  misc_feature: GZ8MTXP01ETLRJ.8.43.D10.1.454.CMB.2.raw
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttaactataccaaacttggttaccagcaagaaacctggaacaacgcacccaggaccactagtaatttataagtaaacaaacaacagacactcctcggacccctcgcccggttctcgacggtcctcccgtccgttacggggaccaaagctacgccctagacaacgtgtaccgagggtgtcgacagacccgtaggacggacggaggtacgtaggtaagttaacttacccgttgcccgttggtaccgttacttaaagtttaggttcggggggttcgggggttccggttttcgggggttcggggttaccggggtaccggggaacggggtaaccgtaaacgggtccgtaacgggtacccgtttaccggacgggttccgaaccggacccgaacgggttcccgttccggccccccggttcgggttacccttacccgtttcccgttcccgtttccccccggtccccttcccggttacccggtaaccgaacccggtaacccggg

SEQ ID NO: 415507 - DNA, 650 bp, Homo sapiens
  misc_feature: GZ8MTXP01BBFC0.8.43.D10.1.454.CMB.2.raw
  modified_base (220)..(220): a, c, t, g, unknown or other
  modified_base (281)..(281): a, c, t, g, unknown or other
  modified_base (372)..(372): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcactggancagtcacagtgttactatccaaatggtcagcagaacctgacaagcaccagccactgattanagtaacaaacaacagacactccacggacccctgcccggttctcgacggcctcccgtccgttacggggaccaaagcctcgcccgtagaaccnctgtacgagggtcgtcgcgacgtcccgtaggacggacggaggcgtagagttacttacgtcgccgtgtcttcttagttagtgggggttcgggtcggtttggggtcggttccgggcgggtacgggaccgaacggtccgtccggtacccgttccggtacggtaaccgcggaccccgtaacggcccgtcccggtcccccgttccggttcccgttacccgttcccgttcccgttaaccccctaccccgttcccgttaccggaacccgttaaccggaacccggg

SEQ ID NO: 415508 - DNA, 580 bp, Homo sapiens
  misc_feature: GZ8MTXP01BZYJI.8.43.D10.1.454.CMB.2.raw
  modified_base (284)..(284): a, c, t, g, unknown or other
  modified_base (364)..(364): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaatggtccagcagaaactggacaagcaccaggccatgattanagtaacaaacaacagacactcctggacccctgcccgttctcaggcctccctccgttcggggccaaagctcgccctagacnctgtcgagggtgtgcagcctgaggacgaggctgagttattactcgcctgctctattagtgggggtcgggtccgttgggtcggttcgggcgggacgggtaccgaaggtcgtcggtaccgtccgtaggtcacggcccgaaacggccgtccgcccccgttcgggttccttaccgtccgttcccgtcccctacccctccttaccgaaccgttcggaaccg

SEQ ID NO: 415509 - DNA, 597 bp, Homo sapiens
  misc_feature: GZ8MTXP01CZ7FG.8.43.D10.1.454.CMB.2.raw
  modified_base (286)..(286): a, c, t, g, unknown or other
  modified_base (371)..(371): a, c, t, g, unknown or other
  modified_base (415)..(415): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacagtggtactatccaaactggtacagcagaaacctggacaagcacccagccactgattanagtaacaaacaacagaccactacctcggacccctgccccggtctcacgcctccctccgttcggggaccaaagctcgccctagacnctgtcaggtgtgcagcctgaggtacgaggctagagtattacgtncctgctctattagtgggggttcgggtccgttggggtcggttcgggccgggtacgggaccgtaaacggcgtacggacccgtcgtacgggtccaacgcccgaaacggttccgtaccgtcccccgttcgggttccaccgttccgttccgttcccctaccccgtcccttaccgtaaccgcggccgg

SEQ ID NO: 415510 - DNA, 679 bp, Homo sapiens
  misc_feature: GZ8MTXP01CKX3K.8.43.D10.1.454.CMB.2.raw
  modified_base (282)..(282): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgccccagggtccaattctcagactgtggtgactcaggacgccctcactgactgtcgtccccaggagggacagtcactctcacctgtgcttccagcacgtggagcagtcacagtgtactatcaaatggtacagcagaacctgacagcaccagcactgattanagtaacaaacaacagacactccgtacgacccctcggtcccgttctcgacggcctcccgtcgtccgggaccaaagctcgccctagactctgtacgaggttgcgacacgccgtagggacggaacggacggtcgtaggtaagttacgttacgtcgtccgttcgtccgttagttaacgttttggtcgggggggtttcggggttcccggggttttggggttcgggtttaccggggaccggggacgggtaaccgtaacggtcggtaccgggtacccggttaccgttaacgggtcccgaacggcccggtaacggttcccgtacccggtccccgttccgggttccttacccgttccgttaccccgttccccctaccccgttcccgaccgtaaccgttcgtcccgg

SEQ ID NO: 415511 - DNA, 587 bp, Homo sapiens
  misc_feature: GZ8MTXP01EFG9O.8.43.D10.1.454.CMB.2.raw
  modified_base (219)..(219): a, c, t, g, unknown or other
  modified_base (227)..(227): a, c, t, g, unknown or other
  modified_base (279)..(279): a, c, t, g, unknown or other
  modified_base (363)..(363): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcacngtgttactatcaactggtcagcagaactggacaagcaccagccactgattanagtacaaacaacagacactcctcgacccctgcccggttctcaggcctccctccgttcggggacccaaagctacgccctagaccnctgtcagggtgtgcgagcccgtgacggacgaggctgagtagttactgctgctctattagtgggggtgggtccgtttgggtcgttcggccggagggacctaaggctacggtaccgtccgtaggtccgacgacccgaacggttccgtccggtcccccgttacgggttccacccgttccgtccgttaaccccctaccccgtcgttacccgaaccgttccggaaccgg
